United States Patent 11,098,302 (IDENTIFICATION OF POLYNUCLEOTIDES ASSOCIATED WITH A SAMPLE) - sequence listing, part 41

SEQ ID NO: 139099 - DNA, 872 bp, Homo sapiens
  misc_feature: GYAE6OF01D3785.46.67.G01.1.454.CMB.1.raw
  modified_base (221)..(221): a, c, t, g, unknown or other
  misc_feature (221)..(221): n is a, c, g, or t
  modified_base (244)..(244): a, c, t, g, unknown or other
  misc_feature (244)..(244): n is a, c, g, or t
  modified_base (256)..(256): a, c, t, g, unknown or other
  misc_feature (256)..(256): n is a, c, g, or t
tcagactagcagtacacgaccggtgctcgatttagagtatacatattgggtttgggggacctcctgtgcaagaacatgaagcacctgtggtttgtcctcctgctggtggcagcctcccagattgggtcctgtccctggtgcaactgcaggagtccgggcccacgactgggtgaggtcccttcggacgacccctgtcccctcacctgcgctgtcctcgtggnccctcatcgagtgttgtttctgngggtctgggccnagccgtccggagggagggctaggaatacgtagttaggaagtcgttctctactaaggttaggtaggtacggtttacctaagttacctacggtcccgttctactaacgaacgtacggtaccgtacgtacaacctaattaccgtctccgtagggtaacccaccggtccaagtaactaacttaccgttacgttttacccgaaggtaaacgtagtacggttacgttacgttcggccggtaaccccggtaccgtacgttaccggtaaccggtaacggggttttactttaacggttccgtggtacggtacggtaacggtacggtaaccgttatttaaagttacggttaagtttttagggttttaggtaacgggttttttacggtttaaccgttacccggtaacccttaaccgggttaggttaaaccccggttacggggggtaacccccggggttacccggtaaccccccgggtaaccccgggggttaccggggggtaaaccccgggttaaacggggttaaccctttaaacccggggttcccgggttaaccccccgttttaacccgggtaacccctttttaacccccgggttacccggtttaccccccgtaaaaccccccgggg

SEQ ID NO: 139100 - DNA, 791 bp, Homo sapiens
  misc_feature: GYAE6OF01DNUNW.46.67.G01.1.454.CMB.1.raw
  modified_base (235)..(235): a, c, t, g, unknown or other
  misc_feature (235)..(235): n is a, c, g, or t
  modified_base (250)..(250): a, c, t, g, unknown or other
  misc_feature (250)..(250): n is a, c, g, or t
  modified_base (334)..(334): a, c, t, g, unknown or other
  misc_feature (334)..(334): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttggacgaccctgtccctcacctgcgctgtctctggtcgcctcatcagttagtgtttctcgnggggctgggtccggnagcctccgagggagggctggaatacagttggaagtgtcctctcagttagtggtacggttctattacagttcccgtctctcaagngtcgagtaccactatacttctcgtcggacaccgtacagactaatcctacgttttcccagaagtgtacggttagttcgttggtaccgacccggtccgtacgtacggtacggtacggggtttacgtttttaacgttaccgttggttaccggacggtacggacggttaccggttacgtttaagtttacggttagttttaggttttttacggggtagtttttacggggttttaacctttttaccggtaacccgttacccggttaaggttaacccgggttaccggggggtaaccccggggggttacccgttaacccccggggttaaccccccggggttacggggggacccgggttaaacgggggttaaaaccgtttacccgggttacccgggtttaccccgttaaccccggtttcccggtttaccccgtttaacccgggtccccccgttaaacccccccggg

SEQ ID NO: 139101 - DNA, 657 bp, Homo sapiens
  misc_feature: GYAE6OF01BTT1R.46.67.G01.1.454.CMB.1.raw
  modified_base (192)..(192): a, c, t, g, unknown or other
  misc_feature (192)..(192): n is a, c, g, or t
  modified_base (211)..(211): a, c, t, g, unknown or other
  misc_feature (211)..(211): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctnacctgcgctgtctctggtncctcatcagtgttgtttcttgtggggctgggtccgcagcctccggaggggaaggggctaggaatacagttggaagtgtctctcattaggtgggtacggtttccttaattaccgacgttcccgtcttctacgaaggtcgtcgtagtccaacctattactctcgtagaccacgtcagactaattccgttacgttttcccaggaacgtgttagtagtttcgtggtaccgacccgtcgtcgtacggacgttacgggttacttttacgttacgtggtcggacggaggtagtaccgttattagtttagtaggttttagttttgggtagtttgtttacgtttccgaacctaccgttagacggttcggggacgggtcctaccgggcccggtaggggaccgtaagggacttacggtcggtaccctaccggttacctccttaccgccctaacccgg

SEQ ID NO: 139102 - DNA, 746 bp, Homo sapiens
  misc_feature: GYAE6OF01D0TXY.46.67.G01.1.454.CMB.1.raw
  modified_base (153)..(153): a, c, t, g, unknown or other
  misc_feature (153)..(153): n is a, c, g, or t
  modified_base (173)..(173): a, c, t, g, unknown or other
  misc_feature (173)..(173): n is a, c, g, or t
  modified_base (196)..(196): a, c, t, g, unknown or other
  misc_feature (196)..(196): n is a, c, g, or t
  modified_base (253)..(253): a, c, t, g, unknown or other
  misc_feature (253)..(253): n is a, c, g, or t
  modified_base (315)..(315): a, c, t, g, unknown or other
  misc_feature (315)..(315): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggccttcggagaccctgtccctnacctgcgctgtctctggtcncctcatcagtgtggtttcttcgngggctgggtccgcagcctccgagggaagggctaggaatacgagttggagtgtctctnatgtggagttcctattacagtccgtctctacgaagagtcgagtcaccatatctacgtggacncgtaccagactaactctacgtttttcccagaacgtagtagtaacggtttctacggttcgaccccggtaccgtcgtacggaaccggtacggggttacgtttttaattaaccggttgttacggtacggaaggtacggtaaccgggtactttaatttaaggttaggtttaggtttttttagggacggttttagggtttttaactttaccggtaaccgttaaccccgtaggtaaccggttaccggggtaccgggggtaccctacccggtaccccggtaccggggtacccggaaggggtaacttaccggttcggtaccgtacccgttcctaccgttacgacccctccgaaaccgacccgggtacccgacgtttcccggtcccgttcccccgacggtccccaccccgttacccctacggaacggtaccgtaaccccg

SEQ ID NO: 139103 - DNA, 755 bp, Homo sapiens
  misc_feature: GYAE6OF01AXNC3.46.67.G01.1.454.CMB.1.raw
  modified_base (231)..(231): a, c, t, g, unknown or other
  misc_feature (231)..(231): n is a, c, g, or t
tcagactagcagtacacgaccggtgctcgatttagagtatacatattgggtttgtcctcctgctggtggcagctcccagatgggtcctgtccctggtgcaactgcaggacgtcgggcccacgactggtgaggtcccttcggacgccctgtcccctcacctgccgtctgtctcgtggtcgccctcatcaggttagttcggtttccttcggtggggtcgttcggggtcccggnacgtccgtcccggagggggacggggtctagggaactacgagttaggagttcgtctacgtctagtggtggtacggttcctattacgacgtccgtctactcgaagagtcgagtccaacgatctctcgaggaccacgtccgacgtactaattccgtacgttttacccagtaacgactaggtacttcgtgtccgaccgtcgcgtacgaacgtcggttattaacgtcgtggtacgcggaagtacggtacgtacttaacgttgtttacggttaggtttacggtaggtttacggtttaacgttaccgtaaccgtaaccgtttaggacggttaccgggtcggggtaccttacccgggacccggttacggggtaccggtaacggtacgttaccgttacgggtaccccgtaccgttacccgtaccttaccggaccccgtaccgacccggtaccgtcccgtaccggtccccgttacccgtaccccccgttggtacccccttaccccgtaccgtaacccgtacgtccgtaccccgg

SEQ ID NO: 139104 - DNA, 654 bp, Homo sapiens
  misc_feature: GYAE6OF01B3KH0.46.67.G01.1.454.CMB.1.raw
  modified_base (291)..(291): a, c, t, g, unknown or other
  misc_feature (291)..(291): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactgggtgaggcccttcgggagaccctgtccctcacctgcgctgtctctggtgcctccatcagtagtggtttcttcgtggggctgggtccgcagcctccgaggggagggctaggaatacattgggaagtgtctctcatagtggagttctattacagtccgtctctacagngtcgagtcacatactctctaggacaccgtccagacaactcttacgttttcccagaagtacttggagtttctcggtacgaccggcccgtcgtagaccgtacgggttacttttattaccgtggtacgacggtagagaccggtattaagtttagttgtttagtttttggagtttaggtttactttaccgaacctaccgtagacgttaccgggacggggtcctaccggtccccggtaggggacccgaagggtacgtacgtacggtcccgaccgttctaccgtacgtcccctaccgaccgaccgggtcccacggttcccgtccccttccccgcgtaccccaccccttacccgacaaccggctaccccg

SEQ ID NO: 139105 - DNA, 606 bp, Homo sapiens
  misc_feature: GYAE6OF01ADB0S.46.67.G01.1.454.CMB.1.raw
  modified_base (209)..(209): a, c, t, g, unknown or other
  misc_feature (209)..(209): n is a, c, g, or t
  modified_base (287)..(287): a, c, t, g, unknown or other
  misc_feature (287)..(287): n is a, c, g, or t
  modified_base (334)..(334): a, c, t, g, unknown or other
  misc_feature (334)..(334): n is a, c, g, or t
  modified_base (339)..(339): a, c, t, g, unknown or other
  misc_feature (339)..(339): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccgnagctccgagggaaggggctggaatacattggaagtgtctctcatagtggaggttcctattacagtccgtctctcaagngtcgagtcaccatatctctggacacgtccagcaatctagttttcccngaagntgagttctgtcgaccgccgctggacacgggtcgtttatacgtgtgcgagagacggcttattatagtagttttggagtttaggttatttacgaacctacccgtagacgtacggacggggtcctccggtaccccgtggggtccgaagggtaactacgtcgggtactaccgtccttaccgttacgccctccgaaccgtaaccgggccctacgttcccggttcccgttcccccgtcggtccccaccccttcccgaccctaacgcgtacccg

SEQ ID NO: 139106 - DNA, 721 bp, Homo sapiens
  misc_feature: GYAE6OF01C9GY4.46.67.G01.1.454.CMB.1.raw
  modified_base (176)..(176): a, c, t, g, unknown or other
  misc_feature (176)..(176): n is a, c, g, or t
  modified_base (218)..(218): a, c, t, g, unknown or other
  misc_feature (218)..(218): n is a, c, g, or t
  modified_base (263)..(263): a, c, t, g, unknown or other
  misc_feature (263)..(263): n is a, c, g, or t
tcagactagcagtacacgaccggtgctcgatttagagtatacatattgggtttgtcctcctgctggtggcagctcccagatgggtcctgtccctggtgcaactgcaggagtcgggccccacgactgggtgaggccttcgggagacccctgtcccctcacctgcgctgtctctggtncctccatcagtagttggtttcttcgtggggctgggtcccggnagcctcccgaggggagggctaggaatacagttggaagtgtctctnataggtggaggttcctattacagtccgtctctcaagagtcgagtccacatatctcgtcggacacgtccagcaatctagttttccagagatgtagttactgtacgacccgcgtcgtacgacgaccggggttacgtttagttaccgttgttcggacgtaggaacggtacggtacctttagtttacgttagtttacggtttttaggtagggtttagggttttacttttaccggtaacctacccggtttaagacggtttaccggggaccgggggtacccgttaccccggtaccccgggtcgggggaacccggtaacggggtaacgtttaccgttcgggttacccgtcccgttacccgtcccgttacgcccccttacccgaccgtaaccgggccctaccggttcccggtaccccttcccccgtcggtacccctaccccttaccctacccgaagccgtaccccg

SEQ ID NO: 139107 - DNA, 586 bp, Homo sapiens
  misc_feature: GYAE6OF01CDQW8.46.67.G01.1.454.CMB.1.raw
  modified_base (192)..(192): a, c, t, g, unknown or other
  misc_feature (192)..(192): n is a, c, g, or t
  modified_base (216)..(216): a, c, t, g, unknown or other
  misc_feature (216)..(216): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccggnaagtcgaacattgacacctatttaaatggtatcaacatagaccagggaccgccctaagcctacctaatctatgctgcatccagtttgcgaaaggtcgggtacccatcggagttcaagtggcaggtggatcgtagggactaggtatttcactctcaccatactagtaatctagactaacgtagaattatttcgactaactttacttacttgtacaaactataactttaactaagttcgttttacgacgtaacggtactaacgtaactaaacgtaaaacgttaacgtaactcggtaggtacctacggacctacaagttcgttcgttaccgttacaccgtttaccttaccccgacttacttcgtagttaaccc

SEQ ID NO: 139108 - DNA, 775 bp, Homo sapiens
  misc_feature: GYAE6OF01EV28E.46.67.G01.1.454.CMB.1.raw
  modified_base (194)..(194): a, c, t, g, unknown or other
  misc_feature (194)..(194): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgccaaccggtggganacagtgtaccaccatcacttggccgggacaagtcggaactattgactacttaatttaaattgtatacaacatacgaccgagggaccgaccctaagcctacctatctatgtctcgctactccgtagtttgacgtaaggtcgggtacccagtccggtaggttcgaggtggtacaggttaggagttcgtagggaactagttacttaccgtactccgtaccaccgtatacgtaagttaactcgttaacggtaacggtaagtaacggtttattttacggtaaacctttaaacgtttaactttaaccgttacggtaaacctaaaccgttaaacgtaacttttaaaccgttaacgttttcccggggtttaaccggtaacccggtaaacgggtaaccctaaccgttaaaacccgttaaaaccgttaaaaacgtttaaaccggaaccgtttacgggtaccggttaccgtaaccgtaacccgtaaccttaaacggtttcctttacctttccgtttaacccgttaccccgttttacccccgtttacccccggtaccctaacgttttacccgttaaccgttaaaccgttaccg

SEQ ID NO: 139109 - DNA, 647 bp, Homo sapiens
  misc_feature: GYAE6OF01C3WVS.46.67.G01.1.454.CMB.1.raw
  modified_base (190)..(190): a, c, t, g, unknown or other
  misc_feature (190)..(190): n is a, c, g, or t
  modified_base (296)..(296): a, c, t, g, unknown or other
  misc_feature (296)..(296): n is a, c, g, or t
  modified_base (594)..(594): a, c, t, g, unknown or other
  misc_feature (594)..(594): n is a, c, g, or t
tcagactagcagtacacgaccggtgctcgatttagagtatacatattgggtttggggagtctcggtcaggacacagcatggacatgagggtcccgctcagctcctggggctcctgctactctggctccgaggtgccagatgtgacatcgagctgacccagtctccatcctccctgtctgcaaccgtgganacagtgtcaccatcacttgccggcaagtcgaacatgacactattaagtgtatcaacatagaccagggacgaccctaagctactatctatcgctgctatccagtttnacgaagtcgggtccagtcgagttcagtgcagtgatgtaggactagtactttcacgtctacaacctagtactagtaactcgtacgactaacgttagtaatagttttgaacttaaacctttagttacctaggttacaaacagttaaactttaactacgtttacggttttacggaacccgtaaaggggtaacctaacggtaaaccttaaaccgtaaaaacgtttaaccggtaacgttaacggttacgggtcttaaccgggacctaaacccgttatttaccccggtatttaccctttaaccncggttttaccccctaccccggttaccctaaaccggttcttaacggttaacccg

SEQ ID NO: 139110 - DNA, 616 bp, Homo sapiens
  misc_feature: GYAE6OF01E2WWR.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgactaccttatttaaattggtatacaacatagaccgagggacgccctaagctacctaatctatgctgctactcctagtttcgactaaaggttcgggtacccagtcggtaggtttcaggtcggacgtaggtggtagtcgtaggggactaggtactttacgacttctaccgaacctatactagttaactcgtagacgtaacggtgtaagttattttagtaactttattacgtgtacaactaagtaattactaattgtttacgccgtaaggactacgtaactaaacgtaaacttaacgtaacgtaggtacgcgttacgacctaaccgtacttgtacgttacctttacgtaccttaccccgttcccactacttcgtagtaccgttaaccg

SEQ ID NO: 139111 - DNA, 708 bp, Homo sapiens
  misc_feature: GYAE6OF01E32HW.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtccctcacctgcgctgtctctggtgcctccatcagtagtgtttctcgtgggctgggtccggcagcctccgaggggaaggggctaggaatacattgggaagtgtcctctcagtaggtggaggttcctattacagtcccgtctctcgaagcgtacgacgtcaccgatacttctctggaccaccgtccagctaactctacgttttcccagaacgtatgtgttctgtacgaccgccgctgaccgtacgggtacgttttacttacgtggtacgcggtaaggacggacggtattaagtttagttagtttagtttttgggtaggtttcggttttacgtttaccgaacccttacccgtacgtagtaccggggtacggggtccctacccgggtaccccggtacgggggacccgaaggggtaaccttacggtccggttaccgtacccgttcccttacccgttacgcccccgtacccgaacccggtaaaccgggcccctaaccggttcccgggttccccttccccccgtcggtaccctaccccccgtaccctacccgaaacgcggtaccccg

SEQ ID NO: 139112 - DNA, 714 bp, Homo sapiens
  misc_feature: GYAE6OF01DDCCP.46.67.G01.1.454.CMB.1.raw
  modified_base (247)..(247): a, c, t, g, unknown or other
  misc_feature (247)..(247): n is a, c, g, or t
  modified_base (261)..(261): a, c, t, g, unknown or other
  misc_feature (261)..(261): n is a, c, g, or t
  modified_base (292)..(292): a, c, t, g, unknown or other
  misc_feature (292)..(292): n is a, c, g, or t
  modified_base (298)..(298): a, c, t, g, unknown or other
  misc_feature (298)..(298): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggacgtccgggacccacgacgtgggtgacggtccgttcggacgacccctgtcccctcaccgtgcgctgtctcgtggcacctcatcagttgtgtttctcggnggggctgggaccgnacgcctccggagggtaagggtcagtactagnggtagntcgtactcgagtaggtcggaggtttacgtactagtacgtccgtccttagccgtaaaggagtcgtacggtaccacctaattacttctaccggtgaaccgacgtccaacgactacacgtttacttaccgttagaagtaacgtgttacgtacgtacgtcggtaccgcccggacgtagtacgggtaccggttacgtttacgtttaaccgtagttacgggacgtaacggacggtagggtaccttagttaacgttaggtttggttacgtttgggtaagttactttacggtaactaaccgtacgtacggtcgggtaaccgggtccgacccggtacccggtccggggaacgtacggggaaacttcggtaccgttaccggtacccgttacggttacctacccggttacgacccgtaaaccccggg

SEQ ID NO: 139113 - DNA, 578 bp, Homo sapiens
  misc_feature: GYAE6OF01A46JB.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgagggaaggggctggaatacattggaagtgtctctcatagtggaggttcctattacagtccgtctctcaagagtcgagtcaccatatctctggacacgtccagcaatcagttttccctgaagatgagttctgtgaccgcgctgacacgggcgtttattactgtgcgagagacggctattatgtatttttggagttggttactttcgactaccctagactcggacggggtctcggaccccgtggggccgagggaactacgtcggtcaccgttcctccttacgccctaccgaccgaacgggccccagtcccggtacccttccccccgtcggtccctacccctccctcccaacggccgtacccg

SEQ ID NO: 139114 - DNA, 709 bp, Homo sapiens
  misc_feature: GYAE6OF01AVBIS.46.67.G01.1.454.CMB.1.raw
  modified_base (398)..(398): a, c, t, g, unknown or other
  misc_feature (398)..(398): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccgcagctcccgagggaaggggctggaatacagttggaagtgtctctcagtgtggaggttcctattacagtccgtctctacaagagtcgagtcaccatatctctggacacgtccagcaatctacgttttccctagaagtatgtagttctgtcgaccgccgctagacgtacgggttacgttagttttttacgngtggacggtagacggtaccggtacttaagtttagttaggtttaagtttttggggtaagttttagggttttaacgtttaccgtaacctacccgtaggtacgtaccggggtaccgggggtacccgttaccggacccccgggtcgggggtaccgtaacgggggtaactaccggttacgggtacctacccggttaccttcccgttacgtcccgtaccccgaaccgtaacccgggtcccttaccggtccggtttcccccgttccccccgtacggtccccctacccctaccctacccggtaacgtcggtacccccgg

SEQ ID NO: 139115 - DNA, 793 bp, Homo sapiens
  misc_feature: GYAE6OF01AJGFK.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggacgaccctgtccctcacctgcgctgtctctggtcgcctcatcagttagttgtttctcgtggggctgggtccgcagcctccggaggggaacgggctaggaatacgtagttaggaagtgtcctctactaagtaggtacggtacggttccttaagttaccgtagtcccgttcctcgtacgaagtacgtacgacgtaccaacctattacgtcctcgtacggacctacgtccaacgtacctaacttaccgttacgtttttacccgaggtaacgtagtacgttacggtttccgtggtacccggacccggtccgtacgtacggtaaccggttaccgggtttacgttttaacgttaccggttggttacggaacgggtacggtaacggtaccggttactttaacgtttagtttagggttttacgttttaggggtaaggttttacgttttacgttaccgtaccgtaccgttaggtaaccggtaccggggtacgggtacccgtacccggtacccggtcggggaccgtagggtaaccgttcgtaccggtacctccggtaccgttccgttaccgacccgtacccgaaccgggtaccgtcccgtacggttccccggttaccccgttaccccgaccgtcccctaccctcccgaaccgcgtcccgtacccg

SEQ ID NO: 139116 - DNA, 742 bp, Homo sapiens
  misc_feature: GYAE6OF01C4KBT.46.67.G01.1.454.CMB.1.raw
  modified_base (240)..(240): a, c, t, g, unknown or other
  misc_feature (240)..(240): n is a, c, g, or t
  modified_base (408)..(408): a, c, t, g, unknown or other
  misc_feature (408)..(408): n is a, c, g, or t
  modified_base (452)..(452): a, c, t, g, unknown or other
  misc_feature (452)..(452): n is a, c, g, or t
  modified_base (466)..(466): a, c, t, g, unknown or other
  misc_feature (466)..(466): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcgcctcatcagtagttggtttctcgtggggctgggtccgcagcctccgaggggaaggggctaggaactanagttggaagtgtctctgaagttaggtgggtaacggttttccctaagtttaaccgacggtttccccgtcttaccgtacgaaaaggtcggtaccggtaagtacccaacctattaccttcgtccgtaggaccacgtccaagactaactcgttaacgtttcccaggaaactntagtagttctggtcgacccgtcgcgttacggacgtaccgggttnttttaacgtagtgnggacgaggacggtaccggtatttagtttataggtttagttttagggtaggttagttacgttacgtaccgtaacccgttaagtacggtcgggaccggggtcctacccgggacccggtaggggaccgtaaggggaacttcggtacggtcctaccgtccttacgtcctcccgaccgaacccggaccgggtaccctaccggttccccgggttcccccttccccccgggtacggtcccccctaacccccttccctaacccgaaacggtaccgtacccccgg

SEQ ID NO: 139117 - DNA, 638 bp, Homo sapiens
  misc_feature: GYAE6OF01DG5IY.46.67.G01.1.454.CMB.1.raw
  modified_base (228)..(228): a, c, t, g, unknown or other
  misc_feature (228)..(228): n is a, c, g, or t
  modified_base (236)..(236): a, c, t, g, unknown or other
  misc_feature (236)..(236): n is a, c, g, or t
tcagactagcagtacacgaccggtgctcgatttagagtatacatattgggtttgggggagtctcggtcaggacacagcatggacatgagggtccccgctcagctccgtggggctcctgctactctggctccgaggtgccagatgtgacatcgagctcgacccagtctccatccctccctgtctgccaaccggtgggacgacagtcgtccaccatcacgttgccggganaagtcganattcgacaccttatttaatggtatcaacatagaccgagggaccgaccctaagcctactaatctatgctgctatcctagttgactaaaggtcgggtcccagtcgaggttcaggtgcgaggtgtagtcgtagggacagtactttcgaccttctacacctatctaagtactcgtagacctaagtagtaagttattttacgaacttaatttaactacgttagtaacctaaataacgttaacttaaacttacgtttacggtttaccggaaccgtaaacggtacgtaacctaacgttaaacttaaacgttaaacgagttaggtaccgcttaacggaaccctaccgttaattacccgttcgttacccttacctaccgttacccttaccccgtacttcttcgtagtaccg

SEQ ID NO: 139118 - DNA, 642 bp, Homo sapiens
  misc_feature: GYAE6OF01DMOZ6.46.67.G01.1.454.CMB.1.raw
  modified_base (191)..(191): a, c, t, g, unknown or other
  misc_feature (191)..(191): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaccggtggganacagtgtccacatcacttgccgggacagtcgaactattgactaccttatttaaagtgtatacaacatacgaccgacgggaccgaccctaagctactatctatcgctgctatcctagtttcgacgtaaggtcgggtacccagtacgtaggttcagtggacaggtgagtcgtagggactagtactttcacttctacactatacgtaagtactcagtacgtaaggttagtaagttagtttcgaacttaactttattacttacgtacaaacgtagttaattacgtaagtttcggtttaccgaacggtaacggtacctaacgtaacttaaacgtaaaaccgttaacgtaacgttacggtacggtaccgttacgaccgtaacctacgtttaccgttcgttaccttaccgttaacgtttcccccttacccggacctaacgtttcctaacgttaacccg

SEQ ID NO: 139119 - DNA, 752 bp, Homo sapiens
  misc_feature: GYAE6OF01DUFU6.46.67.G01.1.454.CMB.1.raw
  modified_base (725)..(725): a, c, t, g, unknown or other
  misc_feature (725)..(725): n is a, c, g, or t
  modified_base (749)..(749): a, c, t, g, unknown or other
  misc_feature (749)..(749): n is a, c, g, or t
tcagactagcagtacacgaccggtgctcgatttagagtatacatattgggtttggggagtctcggtcaggacacagcatggacatgagggtccccgctcagcctccgtggggctcctgctactctggctccgaggtgccagatgtgacatcgagctcgacccagtcctccactccctcctgtctcgaccgaaccggtgggacgacgtagtcgtaccacctatcctacgttcggacccgggactaacggtaccggaactacgttacgaacctaaaccttttaaattttaaacgttaggttaactaacaaaactacgtaaaccggaaccggaaccggggtaacccggtaccctaaaggtacccttaacctaaacttccttaagtcgtaccttcggacctaccgttacccgtttaaggtttaccggtaaacggtaacggggttacccggggtaccctaacggttacgggttaacgggtttaccgtaagggtcggtacgtaggttaggtacgtcggtagggaactagttacttaccgacttccacaactatacgtaacgttactcgtacgaacgtacgtaagtaagtttagttacgtaacttaactttacgttacttacgtaactaagtaacgttaacttaacgttacgtttacggtttaaccgaacggtaacggtactaacgtaactaaataaacgtacgtagtacggtcgatcgactactatcgttntactctcttcctaccgatactgtntac

SEQ ID NO: 139120 - DNA, 849 bp, Homo sapiens
  misc_feature: GYAE6OF01E4MH2.46.67.G01.1.454.CMB.1.raw
  modified_base (184)..(184): a, c, t, g, unknown or other
  misc_feature (184)..(184): n is a, c, g, or t
tcagactagcagtacacgaccggtgctcgatttagagtatacatattgggtttgtcctcctgctggtggcagctcccagatgggtcctgtccctggtgcaactgcgaggagtccgggcccacgactgggtgaggtcccttcgggacgacccctcgtcccctcacctgcgtctgtctcgtggtcncctcatctagtgttggttctcggtgggctcgggtccgcacgccgtaccggaggggaggtctaggtaatacgtagttaggattgtcctcgtatagttacggtacggtacgttacctaacgttaccgtacggttcccgtctaccgtaacgtaacggtaccggtacggtacttacccaacctaagttacctccgtacgtacggacctaccgtacctaacgtaccttaacttccgttaccgttacaaggtagtacgtcgttacgtccggtacggacccgtaccgtccggtacgtaaccggttaccgttacggttaaccgtttacgcggtaggtaccggtaggtaacggtaccgttaaccgttagttaagtttcggtttaaggtttacggtttacggtaacggtttacgttaaacccgtccgaacccggttaaccggtacgggtacccgggtccgggtaaccccggtccggtaacccgggtcccgggtacgggtaacgtaccgggttacccgttacgtccccgggttacccctaccggttaccctaccggttaccccgtaccccgaaccgggtaaccccggtccctaccccgtacccggttccccccggttcccctacccccggcccgtaacccgtacccccacggaacccgtaggtccccggtaacggg

SEQ ID NO: 139121 - DNA, 721 bp, Homo sapiens
  misc_feature: GYAE6OF01DMEJ5.46.67.G01.1.454.CMB.1.raw
  modified_base (140)..(140): a, c, t, g, unknown or other
  misc_feature (140)..(140): n is a, c, g, or t
  modified_base (194)..(194): a, c, t, g, unknown or other
  misc_feature (194)..(194): n is a, c, g, or t
  modified_base (235)..(235): a, c, t, g, unknown or other
  misc_feature (235)..(235): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagntgtgacatcgagctcgacccagtctccatcctccctgtctgcaaccggtggganacagtcgtacaccatcacttcggccgggcaaggtcggaatntagactacttattaattgtatacactatacgacgagggaccgtaccctaagcttacctaatctatcgactcgactactaccgtaggtttagaacgtaaacgggttccggggtaccctaggttacggttaacgggtttaggtagggtacgtaacggttcggggtaacttcgggtaggaactagttaactttcaacgtcctaccgactagtactacgttaatccgtagtaactaacggttagtaacttactttacggtaacttaaactttacgttacgttacgtaactaaacgtagttaaacctttacgttaatttaccgggtttacggaaccggtaaacggtaccaaccgttaaacttaaacctaaaagtttaaacgacggtttagtccgggtactaccggtaacctaaccgtagttacccgtttaggttacccttacgtaccctttccccggtaaccctcttaaacctcgttaacgtatttaccgg

SEQ ID NO: 139122 - DNA, 559 bp, Homo sapiens
  misc_feature: GYAE6OF01EWI9R.46.67.G01.1.454.CMB.1.raw
  modified_base (212)..(212): a, c, t, g, unknown or other
  misc_feature (212)..(212): n is a, c, g, or t
  modified_base (250)..(250): a, c, t, g, unknown or other
  misc_feature (250)..(250): n is a, c, g, or t
  modified_base (323)..(323): a, c, t, g, unknown or other
  misc_feature (323)..(323): n is a, c, g, or t
  modified_base (327)..(327): a, c, t, g, unknown or other
  misc_feature (327)..(327): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtcccctcacctgcgctgtctctggtncctcatcagttagtggtttctcgtggggctgggtccgnagctccgagggaagggctggaatacattggaagtgtctctcatagtggaggttcctattacagtccgtctctnaagngtcgagtcaccatatctcgtggacacgtcagcaatctacgtttccagaacgtatgtagttctggtcgaccgcgctgacgtacgggtctttattacgtgtcgcgagagacggtcttagttatgttagttttggagtttgttacgtttcgactaccgtagtcgtccgggacgggctaccggtacccgtggggaccagggaactagtcggtcctaccgtctccttgccctacccg

SEQ ID NO: 139123 - DNA, 628 bp, Homo sapiens
  misc_feature: GYAE6OF01E5HFY.46.67.G01.1.454.CMB.1.raw
  modified_base (193)..(193): a, c, t, g, unknown or other
  misc_feature (193)..(193): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgcaccatcacttgccgggcaagtcggaacattgactaccttatttaaattggtatcaacatagaccagggacggccctaagctcctaatctatgctgacactccagttttagactaaacggtcgggtaccccagtacggtaggttcaggtggcaggtggatcgtaggacagtatttcactcgtccacctatcagtatctgacaacgtgaagtattttgactaaactttacttaactcgttacaactaacgtaaactttaactaagttacggtttccggaaccggtaacgggtaactaaccgtaaccttaaactaaacgttaaaaccgtaacgttacggtacggtacctcggacctaacctaacttaccttgttacctttaccgtactttaccccgttaccccggtaccctacgtttccgtcggttaaccg

SEQ ID NO: 139124 - DNA, 745 bp, Homo sapiens
  misc_feature: GYAE6OF01E5CUQ.46.67.G01.1.454.CMB.1.raw
  modified_base (354)..(354): a, c, t, g, unknown or other
  misc_feature (354)..(354): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggacgaccctgtccctcacctgcgctgtctcgtggtcgccctcatcgagttagtggttttccttcgtggggtctggggtccggacaggtcctcccggaggggaacggggtcctagggaaactactagtttagggaagtgttcctctctaagttaggtggtacgtttccttaattacgngttccgtctctacgaagacgtcgacgtccaccgtatacttctcgtaggacctaccgtccagacgtaacttccgttacgttttacccgagtaacggtagttgtagtttcgtcgtaccggaccccgtccggtacgtacggaaaccggttaccggggttacgttttttaacgttacgtagggttacggacggtaacggaacggtaaccggttattaacgtttaggttgtttacgggtttttagggttaggtttaggttttacgtttaaccgtaccttaacccgtaggtacgtaccgggtaccgggggccttaccccgggacccggttcgggaccgggtaggtaaccgttcgttacggtacctaccggttacctccgttacgccccgtaacccgg

SEQ ID NO: 139125 - DNA, 699 bp, Homo sapiens
  misc_feature: GYAE6OF01DU1BO.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtgggagacagtgtcaccatcacttggccgggacaagtcgaacattgacactatttaatgtatacaacatagaccagggaccgccctaagctactaatctatgctgctatccgtagtttgacgtaaaggtcgggtacccagtcggaggttcaggtggcaggtggatcgtagggactagtactttacacttcacacctatactagtaacttcgtacgactaacggtagtaaagttatttacggactaaacgtttattacgttacgtacaaacgtaagtaaactttaacgaagttttaggttttacccggaaccggtaaacggggtaactaacccgtaaacttaaaccgtaaaaacgtttaaaccggtaacgtttacggttaccgggaccttaaacggtacccgtaaacccgttaagttttacccggttacgtttaaccccgttttacctaaacccgtttttccccccgtttaacccccggaacccctttaaactttccggttaacgttaaacccgg

SEQ ID NO: 139126 - DNA, 792 bp, Homo sapiens
  misc_feature: GYAE6OF01CSH0Q.46.67.G01.1.454.CMB.1.raw
  modified_base (215)..(215): a, c, t, g, unknown or other
  misc_feature (215)..(215): n is a, c, g, or t
  modified_base (258)..(258): a, c, t, g, unknown or other
  misc_feature (258)..(258): n is a, c, g, or t
  modified_base (278)..(278): a, c, t, g, unknown or other
  misc_feature (278)..(278): n is a, c, g, or t
  modified_base (349)..(349): a, c, t, g, unknown or other
  misc_feature (349)..(349): n is a, c, g, or t
  modified_base (388)..(388): a, c, t, g, unknown or other
  misc_feature (388)..(388): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcagggagtccgggcccacgactggtgaggccttcggagaccctgtccctcacctgcgctgtctcgtggtcncctacatctagttgttcggtttctcgtggggctggggtccgcngccgtccggaggggacgggntaggaatacagttaggagtctctctactagtaggtggtacgttctacgtacgacgtccgtctcgtacaagngtacgagtaccactatactctcgtacgacaccgtaccanacctaattaccttacgttttacccgagtaacgtagtacgttacgtttccgttggtaccggtaaccccgtccggtactacggtaaccggtaccgggtttaacgttttacgttaccgttacgggtcggtaacccggtagggaacggtacccggttaactttaagttttcggtttaaggtttttaagggtttttgggttaacggtttcgggtttttactttaacccggtaacccggttacccgttaacggtacgggttcccggggtaaccgggggtcccgtaccccggggtaccccggggtaccgggggtaaccggtaaacggggttaacccgttccgggttacccggttaccccggttaacccggttcccgtttaccccgttaccggtcccccgtaaacccccggg

SEQ ID NO: 139127 - DNA, 666 bp, Homo sapiens
  misc_feature: GYAE6OF01BT3M1.46.67.G01.1.454.CMB.1.raw
  modified_base (194)..(194): a, c, t, g, unknown or other
  misc_feature (194)..(194): n is a, c, g, or t
  modified_base (198)..(198): a, c, t, g, unknown or other
  misc_feature (198)..(198): n is a, c, g, or t
  modified_base (655)..(655): a, c, t, g, unknown or other
  misc_feature (655)..(655): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatccctccctgtctgcaaccggtgganacgngtgtccacatcacgttcggccggacaaggtcggaactgttacgactaccttatttaaatggtatacaacatagaccgaggaccggaccctaagcctacctatctatcgctgctactccgtaggtttcgacgtaacggtcgggtcccagttcgtaggttcaggtggacgtaggtggacgtcggtagggactagtacttcaccttcgtaccaccgtaatacgtaagttactcgtagaccgtaacgtagttaagttacgttttacgaactttaacgtttacttacttacgtaacctaaagttaacgtaactttaacgtaagtttacgggttttaaccgaaccggttaaacggaccgtaaccgtaaacgttaaaccgtaaaacgttaaccgtaacgtacggttacgtacgtacgacctacgttacgttcttcgttccttactaccgttcctacccgacttntcgtagtaccg

SEQ ID NO: 139128 - DNA, 807 bp, Homo sapiens
  misc_feature: GYAE6OF01CJRW3.46.67.G01.1.454.CMB.1.raw
  modified_base (201)..(201): a, c, t, g, unknown or other
  misc_feature (201)..(201): n is a, c, g, or t
tcagactagcagtacacgaccggtgctcgatttagagtatacatattggggtttggggagtctcggtcaggacacagcatggacatgagggtccccgctcagctccgtggggctcctgctactctggctccggaggtgccagatgtgacatcgagctcgacccagtcctccacttcctccctgtctggcaaccggtggganacagtgtaccactatcacgttcggccgggactaaggtaccggaactagttacgaaacctaccttaagttttaaacgtcggttaactaacgaaactagtaacggaaccgaacgggggtaccctacccgtaagtaccttacccgtaatcgtaacgtcgtactcgactacgtcccgttaaggtttcgaacggttaaacgggttccgggtaccctaagttccggtacggttacgagggttcggacgtacgggtggtactcgggtaggaacgttacgttaacttcccgaccgttactaccgaacttactaacgacgttaacgtcgtacgtaacgtaacggttagtaaacgtttacgtttacgtaactaacgttttacgttaccgtaagtaaaccgtaaacgttaacggttaaacttaaccgttaagggtttccggtttaacccgggaaccggtaaacggtaacctaaaccggttaaacctaaaaccgttaaacgtaaaccggtacggttaagtacggtacccgtacgttaccgtaacgttacgttcttaccgtttacccgttataccccgtttaccccgttacccgtacgttcttaaccggttcgtaaacg

SEQ ID NO: 139129 - DNA, 821 bp, Homo sapiens
  misc_feature: GYAE6OF01AFFUN.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttcggccgggacaaggtccggaactagtttcgaacctaacctttaattttaaaagttgggttaattacaaactaattaacggaaccccgaaggggacccggacccctaaaggccttacccttaaattccttaagtcgccttgcctaacttccctaaggttttcgacgtaaaggtcgggggttacccctagttaccggtacggtttacgaggttcggacgtaggtacgggtattccgtaggggtaacctaggttaacttttaccgaaccgtttccctaccgtaaccctaagttaccctaaacggtttaacttccgttacggacccgtaaacggttacggtaaagtttaacgtttttacgaacccgtttaaaacctttacttttaaccgttacggttaaccctaaaaccgtaagttaaaacctttaacgttaacgtttacggtttttaccgggaacccggttaaacgggtaacctaaacccggtaacgttaaaccgtaaaaacggtttaaaccgtaacgttaggtacggtactacggtaccctaccgtattaccgttcgttacccgttctaccgttaccccgttaccccgtaccttaacgttccgttagtaaccg

SEQ ID NO: 139130 - DNA, 641 bp, Homo sapiens
  misc_feature: GYAE6OF01DP95H.46.67.G01.1.454.CMB.1.raw
  modified_base (211)..(211): a, c, t, g, unknown or other
  misc_feature (211)..(211): n is a, c, g, or t
  modified_base (227)..(227): a, c, t, g, unknown or other
  misc_feature (227)..(227): n is a, c, g, or t
  modified_base (387)..(387): a, c, t, g, unknown or other
  misc_feature (387)..(387): n is a, c, g, or t
  modified_base (400)..(400): a, c, t, g, unknown or other
  misc_feature (400)..(400): n is a, c, g, or t
  modified_base (405)..(405): a, c, t, g, unknown or other
  misc_feature (405)..(405): n is a, c, g, or t
tcagactagcagtacacgaccggtgctcgatttagagtatacatattggggtttgggggagtctcggtcaggacacagcatggacatgagggtccccgctcagctcctggggctcctgctactctggctccggaggtgccagatgtgacatcgagctcgacccagtctccatccctccctgtctgacaaccggtggaacgacagtgcaccntcagttcggccggganaagtcggaactattgactaccttatttaaagtgtatacaacataacgaccgtaacgggaccggaccctaaggcctacctaatctaatcgtctgactactccgtagtttcgacgtaaaggtcgggtaccagtcgaggttcagtggacagtgatcgtagganagtcttacactcncgacntacaacgtatctacgactaacgtaggtaacttattagtaacttaacttttataccttacgtaactaacgtaagtaacttaattaacgttcgtttacgggaaccgtaacgggactaaccgtaaacttaaacgtaaaacgttaacgtaaacgtcggtacgtacctagaaccctccgtaagttccttcggtttacctacgttcccttaccgttacccacttacgtccgtattaacccgg

SEQ ID NO: 139131 - DNA, 805 bp, Homo sapiens
  misc_feature: GYAE6OF01BT4P9.46.67.G01.1.454.CMB.1.raw
  modified_base (190)..(190): a, c, t, g, unknown or other
  misc_feature (190)..(190): n is a, c, g, or t
  modified_base (297)..(297): a, c, t, g, unknown or other
  misc_feature (297)..(297): n is a, c, g, or t
  modified_base (519)..(519): a, c, t, g, unknown or other
  misc_feature (519)..(519): n is a, c, g, or t
tcagactagcagtacacgaccggtgctcgatttagagtatacatattgggtttgtcctcctgctggtggcagctcccagagtgggtcctgtccctggtgcaactgcagggagtccgggcccacgacgtgggtgagggtcccttcgggacgtacccctgtcccctcaccctggccgcttgtctcgtggtcnccctcatcgtaggttagttcggttttctcggtcggggcgttcggggtccgcacgccgtaccggagggggaacgggctaggaatacgtagtagggaattgtctcgtanagttaggtcggttacgttacctattacgacgttccgtctacgtagaacgtcgtcgataccacctatacgttcgtacgacgtaccacgtacacgtactaacttccgttaccgttttccgaagagttacgtagttacgttcgtcggaccggaccgtccgtacgtacggaaccgggttcggtttacgtttacgtagtcggtacggacggtaggacggtaccgttntttacgtttagttagtttagggttttagggtacggttttacggtttacgttaccgaacccgtacggttaacggccgggtaccggggtacgggtacccttacccgggacccgggtacggggaccgtaagggtaaccgttaccgggttccttacccggtacccgttccgttaccgtacccgcccgtaacccggtaaccggccgggtaccccttacggttccccgggtacccccttaccccggccgtaacccccgttacccctaccggaaccgacgtccggtaccccgg

SEQ ID NO: 139132 - DNA, 656 bp, Homo sapiens
  misc_feature: GYAE6OF01EVKO5.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccggcagcctcccgaggggaaggggctaggaatacagttaggaagtgtactctcatagtggtaggttcctattacagtccgtctctacaagtagtcgacgtcaccatactctcgtggaccacgtcagacaattctacgttttccctagaagtatgtagttctgtcgaccgccgcgtacgacgtacggggtacttttaacgtacgtgtcgacgtagacggtacggtacttagttagtgttagttttggagtttgtttacttcgacctaccgtagtacgtacggacgggtctaccggacccgtcggggaccgtagggtaacttcgtacggtacctaccgttccttaccggttaccgtacccgtacccgaaccggaaccgggtccctaacggttcccgttccccgttccccggtccgtcccctacccctaccctacccgaacgtccgtaccccg

SEQ ID NO: 139133 - DNA, 572 bp, Homo sapiens
  misc_feature: GYAE6OF01DPYDC.46.67.G01.1.454.CMB.1.raw
  modified_base (197)..(197): a, c, t, g, unknown or other
  misc_feature (197)..(197): n is a, c, g, or t
  modified_base (223)..(223): a, c, t, g, unknown or other
  misc_feature (223)..(223): n is a, c, g, or t
  modified_base (232)..(232): a, c, t, g, unknown or other
  misc_feature (232)..(232): n is a, c, g, or t
  modified_base (255)..(255): a, c, t, g, unknown or other
  misc_feature (255)..(255): n is a, c, g, or t
  modified_base (367)..(367): a, c, t, g, unknown or other
  misc_feature (367)..(367): n is a, c, g, or t
  modified_base (377)..(377): a, c, t, g, unknown or other
  misc_feature (377)..(377): n is a, c, g, or t
  modified_base (383)..(383): a, c, t, g, unknown or other
  misc_feature (383)..(383): n is a, c, g, or t
  modified_base (393)..(393): a, c, t, g, unknown or other
  misc_feature (393)..(393): n is a, c, g, or t
  modified_base (408)..(408): a, c, t, g, unknown or other
  misc_feature (408)..(408): n is a, c, g, or t
  modified_base (413)..(413): a, c, t, g, unknown or other
  misc_feature (413)..(413): n is a, c, g, or t
  modified_base (427)..(427): a, c, t, g, unknown or other
  misc_feature (427)..(427): n is a, c, g, or t
tcagactagcagtacacgaccggtgctcgatttagagtatacatattgggtttgggggagtctcggtcaggacacagcatggacatgagggtccccgctcagctcctggggctcctgctactctggctccggaggtgccagatgtgacatcgagctcgacccagtcctccatcctccctgtctgcaaccggtggganacagtgtcaccatcacttggccgggnaagtcgaanatgacactatttaatgtatcaanatagaccagggaccggccctaagcctactaatctatgctgcactccgtagtttcgagaaaggtcggggtacccagtcggaggttacagtggcaggtgatcgtgggactagtntttacactcncaactntacagtatcngactagtataagttntttanacttaattattacngtacaaactagttaaactactaatttggtttacgaccgaagggtaccaacgtaactaaactaaagttaacgaactggtcgactagcctaacgtattcgtcgttccttatacctttcccgttaccccgaccttatcgtacgttaac

SEQ ID NO: 139134 - DNA, 683 bp, Homo sapiens
  misc_feature: GYAE6OF01CY4DF.46.67.G01.1.454.CMB.1.raw
  modified_base (227)..(227): a, c, t, g, unknown or other
  misc_feature (227)..(227): n is a, c, g, or t
  modified_base (313)..(313): a, c, t, g, unknown or other
  misc_feature (313)..(313): n is a, c, g, or t
  modified_base (379)..(379): a, c, t, g, unknown or other
  misc_feature (379)..(379): n is a, c, g, or t
  modified_base (395)..(395): a, c, t, g, unknown or other
  misc_feature (395)..(395): n is a, c, g, or t
tcagactagcagtacacgaccggtgctcgatttagagtatacatattgggtttggggagtctcggtcaggacacagcatggacatggagggtccccgctcagctccgtggggctcctgctactctggctccgaggtgccagatgtgacatcgagctgacccagtctccatccctccctgtctacgcaaccggtgggagacagtgacaccatcacgttcggccggganaaggtacggaacagttggcctaacttaatttaaagttggtatacaacatagacgaggaccgaccaagtctactaatcgtactgctncatcctagttcgacgtaaaggtcgggtacccagtccgaggttacaggtggacaggtaggcttacgngggacagtattctacncttacacctatactagtaatcagacaagtagtaattattttacgaacttaaactttacttaacgtacgttaacaaacgtaacttaaacgttaacgtaactttagggtttaacccggaaccgtaaacggggtaacaaaccggtttaaacctaaaactaaaaacggttaaaccggtaaacgttacgggttacggtacccgtaagtacctaaccggtaattaccgttccgtttaccgtttaccttacctaccccgttttaccccgaaccggttctttacctgggttaaacc

SEQ ID NO: 139135 - DNA, 665 bp, Homo sapiens
  misc_feature: GYAE6OF01BE66B.46.67.G01.1.454.CMB.1.raw
  modified_base (193)..(193): a, c, t, g, unknown or other
  misc_feature (193)..(193): n is a, c, g, or t
  modified_base (221)..(221): a, c, t, g, unknown or other
  misc_feature (221)..(221): n is a, c, g, or t
  modified_base (259)..(259): a, c, t, g, unknown or other
  misc_feature (259)..(259): n is a, c, g, or t
tcagactagcagtacacgaccggtgctcgatttagagtatacatattgggtttggggagtctcggtcaggacacagcatggacatgagggtccccgctcagctcctggggctcctgctactctggctcggaggtgccagatgtgacatcgagctgacccagtctccatccctccctgtctgcaaccgtggganacagtgtccaccatcacttggccggganaagtcgaactattgactacttatttaaatgtatacaanatagaccgagggaccgaccctaagcctacctatctatgctgcactcctagtttcgacgtaacggttcgggtaccctagttcggtacggttacagggttcggacgtaggtcggtagttcggtagggtaactagtactttaccgacttacctacaacctataccgtaagtaactcgtagtaccgtaacgttagtaagttaatttcgaactttaacttattacgttacgtaacaacgtaagttaacttacgtaagtttcgttacggaaccgtaaggactaaccgtaacttaaacgtaaacgttaaccgtaagttcgtaggtaccgttaacgtaccgtaacctagttaccgttcttaccgttaccgttaaccttaccccgttcccaacccttttcgtacgttacgtaacg

SEQ ID NO: 139136 - DNA, 604 bp, Homo sapiens
  misc_feature: GYAE6OF01ADLB1.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacacttatttaaattggtatcaacatagaccagggacggccctaagcctcctaatctatgctgcatcctagtttcgactaaaacggtcggggtcccagttcggaggtttacaggtggacgaggtggatcgtagggactagtatttcactctacaccatcaagtaactctacgacgtaacgtgtaaagttattttagacttaaactttatttactagtacaaactagtaattaactaagtttcgtttacggaaccgtaagggactaacgtaaccttaactaaagttaaaccgtagttagtggtacctacgacctaaccgtattaccgttgttacccttctactttcccttaccccgactacttcgtagtaaccg

SEQ ID NO: 139137 - DNA, 847 bp, Homo sapiens
  misc_feature: GYAE6OF01EFJ59.46.67.G01.1.454.CMB.1.raw
  modified_base (199)..(199): a, c, t, g, unknown or other
  misc_feature (199)..(199): n is a, c, g, or t
  modified_base (237)..(237): a, c, t, g, unknown or other
  misc_feature (237)..(237): n is a, c, g, or t
tcagactagcagtacacgaccggtgctcgatttagagtatacatattgggtttggggagtctcggtcaggacacagcatggacatgagggtccccgctcagctccgtggggctcctgctactctggctccgaggtgcagatgtgacatcgagctgaccctagtcctccactccctccctgtctgaccaaccggtggganactagtcgtccaccattcctacgttcggacccgggtanaacggtaccggaacctattacgaaccttaacctttaaagttttaaacgttggttactaacctaaacgtaacgtaacggaacccggtaaccggggtaacccggtacccccttaaaggtcccttaacccttaacgttaccttaacgtacggtcctaccgtaccgtaaccgttaccgttaaggttttaccggaaccggtaaacggggtttccgggtacccctaggttaccgggtaaggtttaccggaggtcggtacgtagtcgggtacttggtacgggtactaagttcttactaccgtacctacgtaaccacttacgtaagttactcgtacgtaacgtaacgttaagtaaacgtttacgtttaacggtaacctttaaacgttttacgtttaaccgtacggttaaaccctaaaggtttaaacgtttaaacttaactttaacggttttacgggtttaccccggtaaaccggtaacggtaaccccgtaaacgttaaaccttaaacgttaaaaaccgttaacggtaaacgttcggtaacgtactaccgtactaacccgttagttacctcgtttaccttcgtaccgtttcccctaccgttatacgttcgtcgttaacg

SEQ ID NO: 139138 - DNA, 693 bp, Homo sapiens
  misc_feature: GYAE6OF01EMLT7.46.67.G01.1.454.CMB.1.raw
  modified_base (175)..(175): a, c, t, g, unknown or other
  misc_feature (175)..(175): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactgggtgagggcctttcggagaccctgtccctcacctgcgctgtctctggtncctccatcagtagtggtttctcgtggggctgggtccggcagcctcccgaggggaaggggctaggaatacattggaagtgtctctcagttagtggtaggttcctattacagttccgtctctcaagtagtcgagtcaccatattctctggacacgtccagcaatctagttttccctgaacgatgtagtttctgtcgaccgccgcgtgaacgtacgggtcgttttaataccgtggtacgacggtagacggacggtacttaagtttattaggttagtttttagggtagtttaggttttacgtttaccgtaacctacccgtaggtacgttacgggtaccgggggtcctacccgggtaaccccggtcggggtaccgaaggggtaacttacggtcggtaccgtacccgttccgtacccgttacgtccctacccgaacccggtaaccggtcccctaccggttcccggttaccccttcccccggtccggtaccctaccccctaccctacccgtaacgccgtaccccg

SEQ ID NO: 139139 - DNA, 883 bp, Homo sapiens
  misc_feature: GYAE6OF01EBH45.46.67.G01.1.454.CMB.1.raw
tcagactagcagtacacgaccggtgctcgatttagagtatacatattgggtttggggagtctcggtcaggacacagcatggacatgagggtccccgctcagctccgtggggctcctgctactctggctccggaggtgccagatgtgacatcgagctacgaccctagtcctccacttccctccctgtctcgaccgtaaccggtgggacacgtaggtcgtaccacctacttacctaccgttccgggaccgggtaacgtaaacggtaccggtaaactagtttacggaaccttaaaccgttttaaagtttttaaaagtttcgggtaaacttaacccgaaaacgtaacgttaaccgggaacccgggaacgggggtaacccccggtaaccccttaaaggtaccctttaacccttaaattaccgttaacgtcggtaccgtttacggtacctaaccgtttacccggtttaaggtttacggaaaccggtttaaaacgggggttccggggttaacccctagggtttaccggttaacgggtttacgaacggggttcggaacggtagggttaacgggaccgttacgggtaacggggtaacctaagtttacctttacaacccgttacctaacccgaaaccgtattaaccgtaacggttaacttccgtacggtaacgtaacgttaagtaatttacgtttacgtaactttaaactttacgtaactactaacgtaaacttaagttaacttagttacgtttcggttaaccgaaccgtaacggtaactaaccgttaaactaaacgttaaacgttaacgagtaggtacgtcctaacgtacctacgttacgttcttcgttaccctactacccgttcccctacgttaccttacgtctagtaccg

SEQ ID NO: 139140 - DNA, 723 bp, Homo sapiens
  misc_feature: GYAE6OF01CGM0D.46.67.G01.1.454.CMB.1.raw
  modified_base (173)..(173): a, c, t, g, unknown or other
  misc_feature (173)..(173): n is a, c, g, or t
  modified_base (215)..(215): a, c, t, g, unknown or other
  misc_feature (215)..(215): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggccttcgggagaccctgtccctcacctgcgctgtctctggtncctcatcagttagttggtttcttcgtggggctcgggtccggnacgcctcccgaggggaacggggctaggaatacgagttggaagtgtctctcataggtggtacggttcctattactacgtccgtctctacgaagcgtacgagtactacctatactctcgtacggacctacgtccagtctaaactcgtacgttttcccagtaacgtatgtacgttctgtcgacccgtcgcgtgacgcgggtactttatcgtgtcgcggtagaggtacggtacttattagttacgtttagtttttacggaggttttacggtttacgtttaccgtacctaacccgtaaggtccggttacgggaccgggggtccttacccgggaccccggtaccgggggaccgtaaacgggggtacttaaccggttcggtacccgttaacccggtcccgtttaccgtcccgtacccgttacccgaccggtaaccgggtccctaaccggttcccggttacccctttccccggtaccgtcccctacccctacccgtacccaagggtcccgtacccg

SEQ ID NO: 139141 - DNA, 619 bp, Homo sapiens
  misc_feature: GYAE6OF01DN93M.46.67.G01.1.454.CMB.1.raw
  modified_base (259)..(259): a, c, t, g, unknown or other
  misc_feature (259)..(259): n is a, c, g, or t
  modified_base (297)..(297): a, c, t, g, unknown or other
  misc_feature (297)..(297): n is a, c, g, or t
  modified_base (353)..(353): a, c, t, g, unknown or other
  misc_feature (353)..(353): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggcccttcgggagaccctgtccctcacctgcgctgtctcgtggtcgcctccatcagtagttggtttctcgtggggctgggtccgcagctccgaggggaagggctaggaatacagttggaagtgtctctnagtagtggtagttcctattacagtccgtctctacaagngtcgatccacctatatctctggaccacgtaccagctaatcgtactttccagaagtntagtagttcgtagtcgacccgcgctaggacgacgggttctttaatacgtgtagcgagagacgtacttatagtgttagtttggtagttgtttacttacgtaacctaccgtagtacgtacgggacgggtccgtaccggaccccgtggggaccctaagggtacctacgtcggttacctacccgttcttccgttacgcccgtaccgaaccgtaccggaccctacgttcccggtcccctccccgtcgtccctacccctcaccacgcgtccg

SEQ ID NO: 139142 - DNA, 576 bp, Homo sapiens
  misc_feature: GYAE6OF01B7VT7.46.67.G01.1.454.CMB.1.raw
  modified_base (379)..(379): a, c, t, g, unknown or other
  misc_feature (379)..(379): n is a, c, g, or t
  modified_base (391)..(391): a, c, t, g, unknown or other
  misc_feature (391)..(391): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggcctttcggagaccctgtccctcacctgcgctgtctctggtgcctccatcagtagtggtttcttcgtggggctgggtccggcagctccgaggggaaggggctggaatacagttggaagtgtctctcatagtggaggttcctattacagtccgtctctacaagagtcgagtcaccatatctctggacacgtcagcaatctattttcccagtaacatgtagttctgtacgaccgccgctagacgacgggtntttatactgtgngagagacgtctattatgtagttttggagttgttattcgactacctagactcggcgggtacctccgacccgtacgggccgagggtaactacgtcggtacaccgttctccgttcgccctccaccgtacggccctacgtccgtcccttcccccgtcggtccctaccctaccctccgaacgcgtacccg

SEQ ID NO: 139143 - DNA, 656 bp, Homo sapiens
  misc_feature: GYAE6OF01ES3UV.46.67.G01.1.454.CMB.1.raw
  modified_base (590)..(590): a, c, t, g, unknown or other
  misc_feature (590)..(590): n is a, c, g, or t
  modified_base (613)..(613): a, c, t, g, unknown or other
  misc_feature (613)..(613): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcacatcacttggccgggcaagtcgaacatgactactatttaaatgtatcaacatacgaccgagggaccgaccctaagctacctaatctatgctgcactccgtagtttgacgtaagggttcgggtccctagtcggaggttcgaaggtcggacgagtcggtacttcggtaggggaactaggttacttccacctcgtaccaacctatactaaggttaactcgtacgtaaccgtaaggttacgtaaatttacgttttacgaacctttaaacgttttcttaacttacgtaaacctaagtaacgtaactttaacgtaacgtttcgtttaccggaaccggtaagggtacctaaacggtaaacttaaacgaaaacttaaacggacctggtaccggttnaccgtaccgtactattaccgttnttaccctctaaccgttcccttaccctacttactccgtataccg

SEQ ID NO: 139144 - DNA, 658 bp, Homo sapiens
  misc_feature: GYAE6OF01DLUEB.46.67.G01.1.454.CMB.1.raw
  modified_base (267)..(267): a, c, t, g, unknown or other
  misc_feature (267)..(267): n is a, c, g, or t
  modified_base (370)..(370): a, c, t, g, unknown or other
  misc_feature (370)..(370): n is a, c, g, or t
tcagactagcagtacacgaccggtgctcgatttagagtatacatattgggtttgtcctcctgctggtggcagctcccagatgggtcctgtccctggtgcaactgcagggagtccggggccccacgactggtgaggcccttcgggagacccctgtcccctcacctgcgctgtctctggtgcctccatcagtagttggtttcttcgtggggctgggtccgcagcctcccgaggggaagggctaggaatactagttggaagtgtctctanagtaggtggtacggttcctaagttacacgttcccgtctctacaagagtcgacgtcaacctatatctcgtggaacacgtcagactatcgtacgtttccgagaanatgagttcgtgtcgaccgcgcgtcgacgtcgggttactttatacgtggtagacggagacgtacggtacttagttagtagtttagtttaggtagttcggtttacgttcgacctacccgtagacggtcgggaccgggtccgtacccggacccggtcggggaccgtagggtactacggtcgtaccgtaccgttaccgtccgttaccgccctaccgaccgtacgggccctacggttcccgtcccgttccccgacggtacccctacccctaccgtacccaaggtccgtacccg

SEQ ID NO: 139145 - DNA, 733 bp, Homo sapiens
  misc_feature: GYAE6OF01CXJJH.46.67.G01.1.454.CMB.1.raw
  modified_base (474)..(474): a, c, t, g, unknown or other
  misc_feature (474)..(474): n is a, c, g, or t
tcagactagcagtacacgaccggtgctcgatttagagtatacatattgggtttgggggagtctcggtcaggacacagcatgggacatggacgggtccccgctcagcctccgtggggctcctgctactctggctccgaggtgccagatgtgacatcgagctagaccagtcctaccatccctccctggtctacgacgaaccggtgggacgacagttgacaccattccgacgttcggaccggcgaagtcggaactagttaccgaactaaccgtttaatttaaacgttggttaaccacaagtacgaacggaccgaacggggtaccacccgtatccttacctaatcctaagtcgcttacgactacttccgaagtttcggaacgtaacgggttcgggaccctagttaacgtcgggttacaggtcggacgttaagcggtaagttccggaagggtacacggtttaccttaacggtctacccngtaacgagtttaccaacgttactcgaacgaccgtaaggtattaacggtatttacgaacctttaataaccgtttactaagtaaccctaagtaaggtaaacttagtacgttcggttaccgggaacgaaggtaaccctaagttaaaaccctagtaaaaaccttaggtaacgttcggtactaactaccgaccttaacggtaccttcggttaccttaccgttactacccttaccctacctacggtacccttagttacgtaaccg

SEQ ID NO: 139146 - DNA, 634 bp, Homo sapiens
  misc_feature: GYAE6OF01BOAOI.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtcttcaaccggtgggagacagtgtccaccatctacgttcggccggacaagtccggaaacagttcgaacctacctttatttaaagttggtatacaactagtagaccgacggggaccgacccctaagctacctaatctatgctgcctactcctagtttacgacgtaaggtcgggtccctagtcggtagttcgaggtcgacgtagtgagtcggtacggactacgtacttcctactcctacactatacgtagtaactcgtagactaaggtataagttactttagacttaagttacttacgtagtaacaaacgtagttaattaacgtacgtttaccgttacgaaccggtaagggtactaacgtaaactaaacgttaaaacgtacgacgttgtacgtacctgaaccccacgtacttctacgttcttacctcgtaccccttcctaccttataccgttgtaactcg

SEQ ID NO: 139147 - DNA, 722 bp, Homo sapiens
  misc_feature: GYAE6OF01CPQJZ.46.67.G01.1.454.CMB.1.raw
  modified_base (400)..(400): a, c, t, g, unknown or other
  misc_feature (400)..(400): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcgcctcatcagtagttcggtttctcgtggggctggggtccgcagccgtaccgagggggaacgggctaggaatacgtagttaggaagttcgtcctactagtagttaggtacgggtacgtttcctattaccgtagttcccgttctactacgaaggtacggtacgacgtacccaacctattacttctacgtcggaccaccgtaccagactaatcttacgttttccgagaagtntagtagttcagtcgaccgccgctcggtacgtacggtacttttacgtcgtggtcggacgtacgacggtacgtacttagttagttagtttaagtttttagggaggtttacggttttacttaccgtaacctaccgtaggttaccgtaccggggtacgggtaccctaccgggtaccccgggagggtaccgaacggtacgtacgttccggtaacctccgttacctaccgtccgtccctacccgacggacccggtaccctcggttccccggttccccttaccccgtccgtcccctacccgtacccctaacgaccgtaccgtaccccgg

SEQ ID NO: 139148 - DNA, 936 bp, Homo sapiens
  misc_feature: GYAE6OF01C2CIE.46.67.G01.1.454.CMB.1.raw
  modified_base (254)..(254): a, c, t, g, unknown or other
  misc_feature (254)..(254): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggccttcggacgaccctgtccctcacctgcgctgtctctggtcgcctccatcagtagttgtttctcgtgggtctgggtccgcagcctcccgaaggggaacgggctaggaatacagttggaagtntctctatagttagtggtacggttccttaagtaccgtacgttacccgttctcttacgaaggtacgtcgaacgtcaaccctagttactccttacgtaggaacccaccgttccgaacggtactaaacgtttccgtaacgtttttccccgaaaggtaacgtaagtttacggttaacggttttacgttcggtaccggtaaccccggtccgttacggtacggtaaacccggttaccgggggttttaccgttttttaaacttaacccggttgggtccggtaaccgtaaacgggtaaccggggtaacccggtttacgtttaaagttttaacggtttaaggtttttaaggttttttacggggtaaggtttttaacgggtttttaccgttttaaccggaacccgtaaccccgttaaggtaccgggtttacccggggacccgggggtttaccctacccgggttaccccggggtacgggggtaacccggtaaacgggggttaacctttacgggttaccgggttacccgtaaccccggtttcccgtttaccccggttaacgtcccccgttaaacccggaaacccggtaaacccgggccccctttaacggtccccggttttccccccgttacccccggtacgtacccccctaacccccgttacccgttaacccgaacccgggtccgtaacccccgg

SEQ ID NO: 139149 - DNA, 702 bp, Homo sapiens
  misc_feature: GYAE6OF01AYSRV.46.67.G01.1.454.CMB.1.raw
  modified_base (172)..(172): a, c, t, g, unknown or other
  misc_feature (172)..(172): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcncctcatcagtagtggtttctcgtgggctgggtccgcacgccgtaccgaggggacgggctaggaatacgagttagggaagtcgtctctacagttaggtggtacggttcctaattaccacgtccgtctctacgaagtacgtcgagtccacctatactctcgtagacacgtcagactatcgtactttccgagaacgtatcgtagttcgtgtcgacccgcgtcgtacgacgacggttcgtttactcgtgtggacgagacggacggtctagttagtcgttagttttggtagtttggtttacttaccggtacctacccgtagtacgtcgggaccgggtccgtacccggtacccggtcgggaccggtaagggtaacgttaccggtaccggtacccgtacccgttacccgttaccgttacccgtcccgtaaccccgaaaccggacccgggttaccccgaaccggtttccccggttacccccttacccccggtacggtaccccctaccccttacccgtacccgaaggtccgtaccccgg

SEQ ID NO: 139150 - DNA, 772 bp, Homo sapiens
  misc_feature: GYAE6OF01DKZK1.46.67.G01.1.454.CMB.1.raw
  modified_base (232)..(232): a, c, t, g, unknown or other
  misc_feature (232)..(232): n is a, c, g, or t
tcagactagcagtacacgaccggtgctcgatttagagtatacatattgggtttggggagtctcggtcaggacacagcatggacatgagggtccccgctcagcctccgtggggctcctgctactctggctccggaggtgccagatgtgacatcgagctcgacccagtcctccactccctccctgtctcgcgaaccggtggacgacgagtcgtcacatctacgtcggccggganaacggtacggaactattacgaacctaacctttaagttttaaagttcggtactaacaaacgtacgtaacggaaccggaacgggacccgtacccctaaaggtccttaacctaatacgttaactcggtacctgtacctaacgtccgttaaggtttacggaacgtaaaacgggttccgggtacccctaggttaccggtaaggtttccgaagggttcggactagggtagattcggtagggaactagttacttacacgtcctactaaccgattacgtaacgttactacgtacgtaaccgtaacggttaagtaacgttaacttttacggtaacctttaaacgtttaacgtttaacgtaacgttaaccgaaacgtttaacgttaaacttaacgtttaacggttacggttttaacccgggaaaccggtaacggtaacctaaacggtaaactaaacgttaaaaccgtaaacgtagtacggttacgaccgtagacctactacgttacttccgtaccttacgtaccgttccttacccatcgttcgtagtacc

SEQ ID NO: 139151 - DNA, 742 bp, Homo sapiens
  misc_feature: GYAE6OF01B442M.46.67.G01.1.454.CMB.1.raw
  modified_base (194)..(194): a, c, t, g, unknown or other
  misc_feature (194)..(194): n is a, c, g, or t
tcagactagcagtacacgaccggtgctcgatttagagtatacatattgggtttgggggagtctcggtcaggacacagcatggacatgagggtccccgctcagctcctgggggctcctgctactctggctccgaggtgccagatgtgacatcgagctgacccagtctccatcctccctgtctgcaaccgtggganacagtgtcaccatcacttcggccgggacaaggtcggaactagttcgactaccttaattttaaagttggtatacaactatacgaccgaacgggaccggaccctaagcctacctaatctatgctgctactcctagtttcgacgtaacggtcgggtccagttacgtaggttcgagtcggctaggtggtatcggtagggactagtactttacgacttctacacctacgtacgtagttaactccgtacggtacctaacggttaggtaaacgtttacgttttaccgaactttaaactttacttaacgttacgttaaacctaaacggttaattaaaacgtttaaccgttaacggtttttacgggtttaaccccgggaaacggtaaaccgggggtaaccttaaacccgttaaaacgttaaaacctaaaaacggtttaaaccgaaacgtttggtaaccggtacctaacggtaccctaaacccgtacgtttaccgttacgttccctttaacccgacctttccccgttacccgtacccttacgttacctacgttaaccg

SEQ ID NO: 139152 - DNA, 620 bp, Homo sapiens
  misc_feature: GYAE6OF01ACJB2.46.67.G01.1.454.CMB.1.raw
  modified_base (212)..(212): a, c, t, g, unknown or other
  misc_feature (212)..(212): n is a, c, g, or t
  modified_base (238)..(238): a, c, t, g, unknown or other
  misc_feature (238)..(238): n is a, c, g, or t
  modified_base (250)..(250): a, c, t, g, unknown or other
  misc_feature (250)..(250): n is a, c, g, or t
  modified_base (288)..(288): a, c, t, g, unknown or other
  misc_feature (288)..(288): n is a, c, g, or t
  modified_base (609)..(609): a, c, t, g, unknown or other
  misc_feature (609)..(609): n is a, c, g, or t
tcagactagcagtacacgaccggtgctcgatttagagtatacatattgggtttgtcctcctgctggtggcagctcccagatgggtcctgtcccctggtgcaactgcaggagtcgggcccacgactggtgaggccttcggagacccctgtccctcacctgccgctgtctctggtgcctccatcgagtagtggtttctcgtgggctgggtccgnagcctccgaggggagggctggatacnttggatgtctcncattagtggaggtcctattacagttccgtctctcaagngtcgagtcaccgatactctcgtggacacgtccagcaatcctagttttcccgagaacgtagtacgtacgtttcgtggtaccgacccggccgtacgtacggaccgtaccgggtttacgttttaactacgttggtcggacgtaggacggtacggcttaagttattggttagtttttgggagtttggttacgtttacgcctacccgtagacgtccgggacgggtctacccgcccggtgggccagggtaactcgtggtcctaccgtcctccgttacgccgtacgaccgacggtcccagtccgtcccgttcccgcggccaccctccncaagcgtaccg

SEQ ID NO: 139153 - DNA, 758 bp, Homo sapiens
  misc_feature: GYAE6OF01BFW8G.46.67.G01.1.454.CMB.1.raw
  modified_base (209)..(209): a, c, t, g, unknown or other
  misc_feature (209)..(209): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggccttcggacgaccctgtccctcacctgcgctgtctcgtgtcgcctccatcagtgtgtttctcgtgggctgggtccgnagctaccgaggggaacgggctaggaactacgagttgggaagttcgtctctacagtaggtggtacggttacctagttacagttccgtctctacgaagtacgtacgacgtccaaccgtatactcttacgtacggaactaccgtacgacgacctaattccgttacgttttcccaaggtaacgtagttacggttacgttcgtacggtacggcccgtccgtacgttacggaaccggtacgggttacttttattaccggtggtacgacggtaagtacggtacggtactttaacgtttaggtttagtttacggttttagggagttttacggtttaccgttacgaacccttaccggttaaggccgttacggggaccggggttcccttacccgggaacccgggttgggacccgtaagggtacttaccggtcggtaccctaccgttaccttccgttaccgcccgtaaccccgacggaacccggtccctacggttccccggttcccgttacccccgacggtaaccccctaccccgtacctaaccggacgccgtaccccgg

SEQ ID NO: 139154 - DNA, 654 bp, Homo sapiens
  misc_feature: GYAE6OF01ED34C.46.67.G01.1.454.CMB.1.raw
  modified_base (192)..(192): a, c, t, g, unknown or other
  misc_feature (192)..(192): n is a, c, g, or t
  modified_base (344)..(344): a, c, t, g, unknown or other
  misc_feature (344)..(344): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccgtgganacagtgtccacatcacttgccgggcaagtcggaacattgactacttaatttaaatgtatacaacatagaccgagggaccgtaccctaagactacctaatctatgctagactatacctagtttgacgtaaggtcgggtacccagtcgtagttnacgtgcagtggatgaggactagtactttcactcgtacaactatactaagtactaccgtagaaccgtaagttagtaaagttattttagaaccttaaactttacgtttaacgtacgtaaccgaaataagtaaaccttttaacgaacttttcgggttttaaaccgaaccggtaaacgggaaccttaaaccgggtaaacttaaaacgaaaacgtttaaacgtaccgttaggtacggttcctagtaccaaaccgttattacggttacttacttaacgtacctttccttaccccggattacctttcgtagtaaccg

SEQ ID NO: 139155 - DNA, 692 bp, Homo sapiens
  misc_feature: GYAE6OF01BFIE9.46.67.G01.1.454.CMB.1.raw
  modified_base (171)..(171): a, c, t, g, unknown or other
  misc_feature (171)..(171): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttctcgtgggctgggtccggcagcctcccgaggggaacgggctaggaatacagttggaagtgtctctcagtagtggtacgttcctattacagtccgtctctcaagagtcgagtcaccatactctcgtggacacgtccagctaatcgtacgttttccagaagtatgtacgtttcgtgtcgacccgtccgtctacggacgtacgggtacttttacttacgtgtcggacgtagacggtacggtacttaattagtgttagtttttgggtaggtttggtttacgtttacgtacctaaccgttagtacgtccgggtaccggggtccgtcccggacccggtcggggaccgtaacggggtaacttaccggttcggtacccgtacccggttcttacccgttacgtcccctacccggaaccgtaacccgggtcccctaacggttcccggtacccccgttccccccggtacggtacccctacccccgtcccgtaacccgaacgtcccgtaccccg

SEQ ID NO: 139156 - DNA, 816 bp, Homo sapiens
  misc_feature: GYAE6OF01CT69J.46.67.G01.1.454.CMB.1.raw
  modified_base (172)..(172): a, c, t, g, unknown or other
  misc_feature (172)..(172): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggcccttcggagaccctgtccctcacctgcgctgtctctggtncctccatcagtagttggttttcttcgtggggtctcgggtccggcacgccgtcccgaaggggaagggggctaggaactacgattgggaagttcgtctctcagtaggtggtacggttccttagttactacgtccgtctctacaagtagtcgatcaccattactctctggactaccgtaccagacctaattccgttacgttttaccccgagaagtacgttggtaacgtttctgggtccgaaccccggtcccggtaccgtacggaaccggtaccggggtttacttttaacgtttaccgttggtacggtaccggaaggtaccggaacggttacttaacgtttaagttagttttaaggtttttcgggtaaggttttacggttttacgttttacccgacccttacccgtaacggttacggtacccggggaccgggggtacccttaccccgggaacccccggtacgggggtacccggtaaggggtaacttaccggttccggttacccgtacccgttcctttacccgttaccgaccccgttacccgaacccggtaaccgggtccccttaacggttccccggtttacccccgttcccccgtcccgggtaccccctacccccgttacccgtaaccctaacggacccgtaccccgg

SEQ ID NO: 139157 - DNA, 776 bp, Homo sapiens
  misc_feature: GYAE6OF01ACYIS.46.67.G01.1.454.CMB.1.raw
  modified_base (174)..(174): a, c, t, g, unknown or other
  misc_feature (174)..(174): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtccctcacctgcgctgtctcgtggtcncctccatcagttagttggttttctcgtggggtctggggtccgcacgccgtacccggaagggggaacgggctagggaatacgtagttagggaagttgtcctctacagttaggtggtacgttccttaagttacacgttcccgtctctacgaaagtgtcgagttaccaccgtattactcctacgtggacctaccgtccagactattaccgttacgtttccagaagtagtggtacttcgtcggtaccgacccgtccgtcgtacggaccgtaccgggtttacttttagtacgtgggtacgacggagtacgtaccgttattagtttacgttaggtttaggttttaggtaggtttaggtttacgtttacccgtaaccgtacccgttaaggtaccggtaccggggtaccggggtacccgtacccggtacccggttacggggaaccggtaacggggttaccttaccggttcggtacccgttacccggttaccgttacccgtaccgtaccccgtacccgaacccggtacccggtcccgtaaccggttcccggttacccccttccccggtaccgtccccctacccgtaccctaccggaccgtccgtaccccgg

SEQ ID NO: 139158 - DNA, 764 bp, Homo sapiens
  misc_feature: GYAE6OF01DG5ZS.46.67.G01.1.454.CMB.1.raw
  modified_base (197)..(197): a, c, t, g, unknown or other
  misc_feature (197)..(197): n is a, c, g, or t
tcagactagcagtacacgaccggtgctcgatttagagtatacatattgggtttggggagtctcggtcaggacacagcatggacatgagggtccccgctcagctcctggggctcctgctactctggctccgagtgccagatgtgacatcgagctgacccagtcctccatccctcctgtctgacctaaccggtgggaanactagtcgtccaacctatccacgttcgggacccgggacaaggtaccggaactagtttacgaacctaaccgtttaattttaaagtcgtatacaaacgtagtacgaaccgacgggacccgaccctaagcctactaagtctatcggctgactactccgtagttcgacgtaacgggttccgggtacctagtcggtaaggttccgaggttgacctagggtcggtaacttcggtagggaactacggttaccttttaccacttacctaccgtaacctagtaactacgttaacttccgagtaccgtaacggttagtaacgtttatttaccggtaacttaaccgttttacgtaacgttaccgtaaacgaacgttaagtttaaacttaacgttacggttttacggtttaaccgaaccgggtaaaccgtaccgtaaccgttaaaccttaaaacggtaaaaccgtttaaccgtacgttacgggtacgtcccgtaactacccgttaaccgttacttcgttaccgtttaccgttaccgtaacctttccccgttacccgactttaactccggttaattaccg

SEQ ID NO: 139159 - DNA, 876 bp, Homo sapiens
  misc_feature: GYAE6OF01D55P7.46.67.G01.1.454.CMB.1.raw
  modified_base (210)..(210): a, c, t, g, unknown or other
  misc_feature (210)..(210): n is a, c, g, or t
tcagactagcagtacacgaccggtgctcgatttagagtatacatattggggtttgggggagtctcggtcaggacacagcatggacatggacgggtccccgctcagctccgtggggctcctgctactcgtggctccggaggtgccagatgtgactagtcgagctacgaccctagtcctccacttccctcctgtctcgacgtttttaccggnggagacgtgtcgtaccaccactccgtacgtcgggaccgggtacgtaacggtacggaactagttacgaaccttaacgtttaaagttttaagttacggttaactaaccaaacgtaaggtaaccggaacccggaaccgggggtaacccggtaacccttaaacggtcccttaacccttaaacgtcgttacgtccgtaccgttcgacgttaccgttaccggttacgggttttacggaaccggttaaacggggttccggggtaaccctaggttaccggtacgggtttacgagggtcggacgtagggttgtacggttacggtaggacgttaacgttatttacccgtactacccgtacccgtaactaaccgttacgtaaacgtttaccgtacgttaccgtaaaccgttaacggtttaacggttaactttaacgtttacgtaaactttaaaccgttttaaccgtaacgttaaccgtaaactaaaccgttaaaggtttaaactttacggttttaacggtttaaccgggttaacccggtaaccgggtaaaccggtaaccttaaacggtaaacttaaaacgtaaacgttaaccgtaaggttcgtacgtaccgaccgtaccgtacttacgttcttaccttacctcctaccgttcccgtaccttactagttcgacttacg

SEQ ID NO: 139160 - DNA, 1018 bp, Homo sapiens
  misc_feature: GYAE6OF01DTOZX.46.67.G01.1.454.CMB.1.raw
tcagactagcagtacacgaccggtgctcgatttagagtatacatattgggtttggggagtctcggtcaggacacagcatggacatgagggtccccgctcagcctccgtggggctcctgctactctggctccgaggtgccagatgtgacatcgagctgacccagtcctccactccctccctgtctcgcgaaccggtgggagacagttcgtaccacctaatccgacgttcggccgggataacggtacggaactagttacgactaaacctttaatttaaaagttggtaactaccaacgtagtaacggaacccgaacgggacccggtaccctaacgtaccttacctaattacctatcggctacgtacactttacccgtaagtttccggaacgtaaacgggttccggggtaccctacggttacgggtacggttacggtaggtacggggtaccgttaaggggttacgggttacgtaacgggttacgggggtaaacctaaacgggtttactttttaacccggaacccgtttacccctaaaccggttaaacccctaaaccggttttaacggaaaacgggttttaaacttacccgtttacgggtaaaacccgtttaaaccggggtttaaggtttaaaaccgtttttaacggggttttaaacccgttaaccttttaaaaacccgggtttttttaacttttaaaccgttaaccggtttaaaacccttaaaaacccggttttaaacggttttaaaaaccctttttaacggttttaaaccgggttttaaccggggttttaaccccggaaaacccggggttaaaaccgggggtaccctttaaaaaccggtaaaacccgtttaaaacgtaaaaaaccggtttaaaccgggttaaccgggttaaggttacccgggttacctaaccgtaaccccggttaacctttaaccgggttaccctttcccggtttaccgttaccccttaaccggtttcccccttaacccggttaacccttacgtttccacggtttaaaccg

SEQ ID NO: 139161 - DNA, 552 bp, Homo sapiens
  misc_feature: GYAE6OF01BR27C.46.67.G01.1.454.CMB.1.raw
  modified_base (211)..(211): a, c, t, g, unknown or other
  misc_feature (211)..(211): n is a, c, g, or t
  modified_base (247)..(247): a, c, t, g, unknown or other
  misc_feature (247)..(247): n is a, c, g, or t
  modified_base (325)..(325): a, c, t, g, unknown or other
  misc_feature (325)..(325): n is a, c, g, or t
  modified_base (351)..(351): a, c, t, g, unknown or other
  misc_feature (351)..(351): n is a, c, g, or t
  modified_base (449)..(449): a, c, t, g, unknown or other
  misc_feature (449)..(449): n is a, c, g, or t
  modified_base (456)..(456): a, c, t, g, unknown or other
  misc_feature (456)..(456): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctccatcagtagtgtttctgtggggctgggtccgnagctccgagggaagggctggaatacattagggaagtgtctctcattaggtggtaggttccttattacgagttcccgtntctacaagagtcgagtcacatatctntggactacgtccagcaatctacgttttcccagaagatgtattcgtgtcgaccgtcgctacggacgtacgggtacttttatcgtggtgcgagagacgtnttatgtnttagtttgagttggttattcgactaccagcgtcggacgggctccggcccggtgggacgaggtactacgtggtccaccgttctctacgtcctacccg

SEQ ID NO: 139162 - DNA, 789 bp, Homo sapiens
  misc_feature: GYAE6OF01CMXMV.46.67.G01.1.454.CMB.1.raw
  modified_base (217)..(217): a, c, t, g, unknown or other
  misc_feature (217)..(217): n is a, c, g, or t
  modified_base (318)..(318): a, c, t, g, unknown or other
  misc_feature (318)..(318): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggtccttcggacgaccctgtccctcacctgcgcttgtctcgtgggtcncctccatcagttagttgttcttcgtggggctggggtccgctacgccgtaccggaggggtaacgggcgtaggtaaatacgtagttaggaagtcgtctcctanagttggtagggtacgttacctattaacgacgttccgttctctaacgaaggtacgtaccgacgttaccaaccctattaatccgttacgtacgggtaaaccctacccgttacccaaggtaaccctaaacgtttaccgtttaaccgtttttaccccgaaggtaaaacggttagtacgggttaacgtttccggttccgggtaccggtaaccccgtcgggtacgtacggaaccggttacgggtttacttttacgttacgttcggtaggacgtaggtaacggtaccggttatttaacggttagttacggttttaaggttttagggaacggtttgtttaacgtttaccgaaccttacccggtagttaacgggtccgggggtaccggtcgtaccccgggtccgggtacgggtaaccggtacgggttaaacctcggttaccgtacgtacccgttcgttaccctacggtacccctacccgg

SEQ ID NO: 139163 - DNA, 631 bp, Homo sapiens
  misc_feature: GYAE6OF01CB3TU.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctcatcagtagtggtttctcgtggggctgggtccggcagctcccgagggaagggctggaatacattggaagtgtctctcatagtggaggttcctattacagtccgtctctcaagacgtcgagtcaccatactctctggacacgtcagcaatctacgtttcccagaagatgtagttctgtacgaccgccgcgtagacgacgggttctttaattacgtggtcgcggtaagacggtacggtacttattagtgtttagtttttagggtaggtttaggtttagtttaccgactacccgtaggtaccgtcgggacggggtcctccggtacccggtggggtaccgagggtaactacgtcggtacctccggttacctccgttacgccctaccgtacccgaacggtccctacgtccggttaccccttccccgtcggtccctaccccgtcctaccgtaacgcgtacccg

SEQ ID NO: 139164 - DNA, 616 bp, Homo sapiens
  misc_feature: GYAE6OF01D6DHE.46.67.G01.1.454.CMB.1.raw
  modified_base (191)..(191): a, c, t, g, unknown or other
  misc_feature (191)..(191): n is a, c, g, or t
  modified_base (217)..(217): a, c, t, g, unknown or other
  misc_feature (217)..(217): n is a, c, g, or t
  modified_base (256)..(256): a, c, t, g, unknown or other
  misc_feature (256)..(256): n is a, c, g, or t
  modified_base (438)..(438): a, c, t, g, unknown or other
  misc_feature (438)..(438): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtggganacagtgtcaccatcacttggccgggnaagtcggaacattgactacttaatttaatggtatacaanatacgaccgagggaccgaccctaagcctacctaatctatgctgcctatccgtagtttgacgtaaacggttcgggtacccagtcggtaggttacgaggtggcgtaggtggatcggtagggtactaaggttactttccacgtctaccaaccatactaagtaatcgtagactaagtagtaagttntttacgacttaactttattactagtacaactaagtaacttactaagtttcggtttaccggaccgtaagggactaacgtaacttaaacgtaaacttaacgtaacgttaggtacgtactcgtacctacctattacttcgttaccttactaccttccttacccgactacttcgtagtaccg

SEQ ID NO: 139165 - DNA, 676 bp, Homo sapiens
  misc_feature: GYAE6OF01BKZYL.46.67.G01.1.454.CMB.1.raw
  modified_base (176)..(176): a, c, t, g, unknown or other
  misc_feature (176)..(176): n is a, c, g, or t
  modified_base (195)..(195): a, c, t, g, unknown or other
  misc_feature (195)..(195): n is a, c, g, or t
  modified_base (206)..(207): a, c, t, g, unknown or other
  misc_feature (206)..(207): n is a, c, g, or t
  modified_base (220)..(220): a, c, t, g, unknown or other
  misc_feature (220)..(220): n is a, c, g, or t
  modified_base (579)..(579): a, c, t, g, unknown or other
  misc_feature (579)..(579): n is a, c, g, or t
  modified_base (664)..(664): a, c, t, g, unknown or other
  misc_feature (664)..(664): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtcgaggccttcggacgaccctgtccctcacctgccgctgtctcgtggtcncctcatcagtgtgttctgngggctgggcgnngctcgagggaggnagatcagttggattcgtctcagagtggtgtagttctatacacgtccgtctctactagacgtcgacgtcacctatactctcgtacgacacgtccagtactatctacgttttccagtaatacgtagtacgttcgtaggtaccgacccggtccgtcgtacggtaaccggtaacgggtttcgtttaaacgttccgttagggcgttacgggaacgtacgggtaccgtattaacgttagttacgttaagttttagggtaggtttagttacgttacgtacccgtaacggtagaccggtacggggaccgggttccgtacccggtacccgggtcggggaccgaacgggttaacgtcgtacggtacccnccgttacctcgtaccgtcctaccgaaccgtccggtcctaccggtcccgttcccgtaccccgtccgtaccctcccttaccgaccgngtaaccgtcccg

SEQ ID NO: 139166 - DNA, 743 bp, Homo sapiens
  misc_feature: GYAE6OF01EIOH7.46.67.G01.1.454.CMB.1.raw
  modified_base (194)..(194): a, c, t, g, unknown or other
  misc_feature (194)..(194): n is a, c, g, or t
  modified_base (658)..(658): a, c, t, g, unknown or other
  misc_feature (658)..(658): n is a, c, g, or t
tcagactagcagtacacgaccggtgctcgatttagagtatacatattgggtttggggagtctcggtcaggacacagcatggacatgagggtccccgctcagctccgtggggctcctgctactctggctccgaggtgccagatgtgacatcgagctgacccagtcctccatcctccctgtctgcaaccggtgganacagtgtacaccatccacgttcggccgggactaagtccggaactattacgacctaaccgtttaattttaaaagttggtaattaccaactagtaacgaccgacgggaccgtaccctaagcctacctaaatcctaatgtaccttgacctacttaccctaggtttacgacgtaaaggttcggggtaccctagtcggtaaggttcaggtcggtacaggtcggacttcggtaggggactaggtacttttaccaccttacctaccgtaacctacgtaactagttaaactccgttacgaacgtaacggttagtaaagtttacgttttacgaaccttaaactttacgttactaaccggtaacctaaacgtacgttaaactttaccgtaagttttacgggtttaccggaccggtaaaagggtcctaaacgtaacctaaaagttaaacttaaaccggtaacgttgtaaccggtntaccggaaaccttactacgttacttacgttacccttacgtaacccgttttccctaaccccgtacttacttaccgtggttaaaccc

SEQ ID NO: 139167 - DNA, 672 bp, Homo sapiens
  misc_feature: GYAE6OF01A026B.46.67.G01.1.454.CMB.1.raw
  modified_base (661)..(661): a, c, t, g, unknown or other
  misc_feature (661)..(661): n is a, c, g, or t
  modified_base (668)..(668): a, c, t, g, unknown or other
  misc_feature (668)..(668): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctcgacccagtcctccatccctccctgtctgcgaaccggtggagacagtcgtacaccatctacgttcggaccgggtacaaggtccgaactattacgaactacttaatttaaattggtatacaactagtaacgaccgacgggaccgaccctaagtcctacctaatcgtactcgtctcgactacttccgtaggtttacgaacgtaacggtcgggtacctacgtcggtacgttcgtaggtcggacgtaggtcggtagtcgtagggaactagttacttctacctcgtacaacctaggttacctaagttactccgtacgtacgtaacggtagtaaactttagtttaacgttaactttacgtacgttacttaaccaagttaacgtaacttttaacgtagtttcggttaaccgggacgtaacggtactaacggtaacttaaacgtaaagttaacgacgttgtacgaccttacgaccttacgacgttcttacgtctttactcccgtacactcttanctacgtntacg

SEQ ID NO: 139168 - DNA, 632 bp, Homo sapiens
  misc_feature: GYAE6OF01D212B.46.67.G01.1.454.CMB.1.raw
  modified_base (192)..(192): a, c, t, g, unknown or other
  misc_feature (192)..(192): n is a, c, g, or t
  modified_base (217)..(217): a, c, t, g, unknown or other
  misc_feature (217)..(217): n is a, c, g, or t
  modified_base (228)..(228): a, c, t, g, unknown or other
  misc_feature (228)..(228): n is a, c, g, or t
  modified_base (253)..(253): a, c, t, g, unknown or other
  misc_feature (253)..(253): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgganacagtgtcaccatcacttgccgggnaagtcggaacnttgactacttaattaatgtatcaanatagacctagggacgccctaaagcctacctaatctatgctgctactccgtaggtttgacgtaaaggttcgggtaccccagtcggtaggtttcaggttcggactagggtcggattcgtagggacctaggtactttccaacctcgtaccaacctatacaagttactcgtcgaactacgtagtaagttatttacgaacttaactttattacgtgtacctaacgtagtaactttaacgaagtttacgtttacggaaccgtaaagggtacctaacggtaaacttaacgtaaaattaaccggtacgttaggtacggtactacgacctaaacctgttcgttcgtacctttcgaacttcccttaccgaccttactcgtacgtaaccg

SEQ ID NO: 139169 - DNA, 684 bp, Homo sapiens
  misc_feature: GYAE6OF01DYTG9.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtgggctgggtccggcagctccgagggagggctggaatacattggaagtgtctctcatagtggtaggttcctattacgagttccgtctctcgaagacgtcgaagtccaccatatctcgtggacaccgtccagctaactcgtacgtttttccctaggaaagtattaggtacgtttcgttaggttcggaccccgtccggtactacggtaaccgtaaccgggggttactttttaacttacgttggttacggacgtaacgggaacggtacggtacctttagtttaagttggtttaggttttttagggtaggtttggttttaacgttttccgaacctaccgttaggtacgttacggggaccggggttccgttacccgaccccgggttggggacccgtaaggggaacttcggtacgggtaccctacccggttcttaccccgttgccccttacccgg

SEQ ID NO: 139170 - DNA, 717 bp, Homo sapiens
  misc_feature: GYAE6OF01BZ6HI.46.67.G01.1.454.CMB.1.raw
  modified_base (225)..(225): a, c, t, g, unknown or other
  misc_feature (225)..(225): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtctccatcctccctgtctgcaaccggtgggacgacagtgtcaccatcacgttggaccgggganaaggtacggaactagttcgaacctaaccttaaattttaaaagttggtaactaccaaacagtacgaaccgtaaggggaccgaccctaagcctacctaaagtctaactgctcgactactcctagtttacgacgtaaaggtcggggtaccagttacggtaggttacaggtcggacgtagtcggatacgtgggaactagtactttacacttacacaaccgtatacgaagtaactcgtacgtacgtaaacgtgtaaagttacgttttagaactttaaacgttattaaccgttagtaacctaaacgtaaagtaaacgtttaacgtaacgtttacgggtttaccggaaccggtaaacgggtaacctaaaccggtaaaccttaaacgtaaaaacgttaaaccggaacgttaaggtacggtaccttacgaccctaactacttacgttacgttacccttctaacgtttccccgttacccgacctaacttcgtaagttaaccc

SEQ ID NO: 139171 - DNA, 575 bp, Homo sapiens
  misc_feature: GYAE6OF01BDXTU.46.67.G01.1.454.CMB.1.raw
  modified_base (192)..(192): a, c, t, g, unknown or other
  misc_feature (192)..(192): n is a, c, g, or t
  modified_base (229)..(229): a, c, t, g, unknown or other
  misc_feature (229)..(229): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaactntgactaccttaatttaaatggtatacaacatagaccgagggaccgccctaagctacctaatctatgctgcatcctagtttgacgtaaaggtcggggtaccctagtcgtaggttcaggtggcgagtggactcgagggactagtactttcactctcaaccatacagtaatctagacaacgtgaattatttgacttaactttattacgtactactaactataacttactaagttcgtttaccggacgtaaggactaacgtaactaaacgtaaattaacgaacgttgtacgtactacgtaccgactacttactcgttaccttactactccgttccacctactgtagtacg

SEQ ID NO: 139172 - DNA, 703 bp, Homo sapiens
  misc_feature: GYAE6OF01BOEZ9.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcggcccacgactggtgaggccttcggacgaccctgtccctcacctgcgctgtctctggtcgcctccatcagtgttgtttcttcgtgggctgggtccgcagcctccgaggggaacgggctaggaatacgtagttgggaagtgtctctacagtaggtggtacgttccttattacgtacgtccgtctactacgaagtacgtacgacgtcacctatacttcctcgtagacacgtccagtactaatctacgtttccagtaacgtatagtacgttcgtacgtcgaccgccgtcgtacgtaaccggtacggttcttttacgttacgtgttcggacgacggaacggtacgtacttagttattagtttagttttgggtaaggtttaggtttacgttaccgtaacccgtaccgttagtaccggttacggggtacgggtcccgttaccggtacccggttcggggaccgtaacgggtacttacggtcggtaaccgtccgttccttaccgtacgtccccgtaacccgacccggtaccgtcccgtacgtcccggttaccccttcccgcggtcccctaccccgtcccgtaacgaccgtccgtacccg

SEQ ID NO: 139173 - DNA, 785 bp, Homo sapiens
  misc_feature: GYAE6OF01EW937.46.67.G01.1.454.CMB.1.raw
  modified_base (219)..(219): a, c, t, g, unknown or other
  misc_feature (219)..(219): n is a, c, g, or t
  modified_base (772)..(772): a, c, t, g, unknown or other
  misc_feature (772)..(772): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgacggccttcggacgacccgtgtcccctcacctgccgtctgtctcgtggtcncctccatcagttgtgtttctcgtgggtcgtgggtccgcacgccgtccggaaggggacgggtctaggaaactacgtagttagggaacgttcgttcctacgtacgtaaggttagggttacgggtaaccggttttcccttaaacgttaccggtaccgggtttcccccgttaccgttaccgtaacgtaaaggtacggttaccggtaacgttcccctaaactaagttaccgttccgttcgtaacgggaaccctacccggttaccaaggtaacctaacgttaccgttttaacccggttttacccaaggtaaacgttcgttagggttaaccgtttcgtacgggtacccgaccggtccgtacgtacggtaaccggtacgggtttacttttacgttacgtggtacggacgtaaggtaccggtacgttacttagttagttggtttagttttggacgtttagttacttccgaacgtaccgttgacggtcccgggcggtacccttaccgggcccggttagggacccgtaggtaccgtcgaccgtacccgtaccttcctaccgtcnccccggtaacccg

SEQ ID NO: 139174 - DNA, 921 bp, Homo sapiens
  misc_feature: GYAE6OF01BCX5K.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatctacgttcggccgggactaacggtaccggaaactagttacgaacctaaccctttaaagttttaaaagttggttaactacctaaacctaagttaacgaacccggaagggggaacccggtacccctaaaggtccttaacccttaaacttaccgttaacttcggaccgttacggtacctaccgtttacccgttaggtttttacgaaccggttaaaacggggttcccgggggttacccctaaggttaccgggttaacgggtttccgtaacgggttacggggtaccgtaaggggttcggggtaaactttaccgggtacgggggtaacgtaacggtttaacttttacccgaaaccctttcccgttaaccctaaaccccgtaagttacccgttaaacgttaaccgttaccgttaacggtaacccgtaaaacgggtttaacgggttaaaagtttaaccgttttttaccggaaaccttttaaaccgttttaacttttaacccttaacggttaaaccctaaaaccgttaaagtttaaaaccgtttaaccgtttaaaacgttttcgggttttaacccgggaacccggttaaacgggtaacccgtaaacgttaaaaccgttaaacgtaaaacggttaaccgtaaacgttacggtacggtacctacgtacctaccgttatcgttacttcgttactaccgtttccctacccgacttactcgtcgtaacg

SEQ ID NO: 139175 - DNA, 854 bp, Homo sapiens
  misc_feature: GYAE6OF01C93X0.46.67.G01.1.454.CMB.1.raw
  modified_base (181)..(181): a, c, t, g, unknown or other
  misc_feature (181)..(181): n is a, c, g, or t
tcagactagcagtacacgaccggtgctcgatttagagtatacatattgggtttgtcctcctgctggtggcagctcccagatgggtcctgtccctggtgcaactgcaggagtccgggcccagacgtgggtgaggcccttcgggacgacccctgtccctcacctgccgtctgtctcgtggtcncctcatcgtagtagttggtttctcggtgggtctcgggtccgcagtccgtacccggaaggggaacggggtctaggtaactacgtagttagggaacgttgtcctcgtatagtaggtcggtacgttactattaccgtagtcccgtctacacgtaaagtcggtactacgtccacctatcttcctcgtacggacctaccgtcaacgtactaacttcgtttaccgtttaccgaggtaataggtaggttacgttccgtacggtaccgacccggtccgttacgttacggaacccggttaacgggtttcctttttaagtacgttacgggtacggtaccggtaaggtaacggtacggttaacgtttattttaagttggttttaagggttttaacgggttaggttttaacggtttacgttaccggtaacccggtaaccggttagtaccgggtaccggggtaccggggtacccgttaacccggggcccgggtaacggggtaccggtaaacgggtttaccgtaccggttacccggttaacccgtaccccgttaccgtaaccccggttcgtaaacccccgtaccgtaacccgggtacccggtttacccgtaccggttcccccgttacccgtcccccgttacggaccccccttaccgtaccccgttaacgacccggttcgacccccgg

SEQ ID NO: 139176 - DNA, 834 bp, Homo sapiens
  misc_feature: GYAE6OF01C8ZVR.46.67.G01.1.454.CMB.1.raw
  modified_base (291)..(291): a, c, t, g, unknown or other
  misc_feature (291)..(291): n is a, c, g, or t
tcagactagcagtacacgaccggtgctcgatttagagtatacatattgggtttgggggacctcctgtgcaagaacatgaagcaccgtgtggttgtcctcctgctggtggcagctcccagatgggtcctgccctggtgcaactgcaggagtccgggcccacgacgtggtagacggtccttacggaagcccctgtcccctacacccttggccgtcttcggtacctcgtcgggtcttcccaccaattccgaagttggttgttttcctcggtgggggtcctgggggttaacccgngaacggtcccgtacccggaaagggggtaacggggtacgttagggtaaactaaccgtaagtttagggtaaaaggttcggtctaccgttaaccgtaagttaaggttaccggggtaacggttttaccccttaagtttaaccgtaaccggtacccgttccttacgtaccgtaaaggtaccgtacggacgttaaccaacgtataactcgtcgtacggacctaccggtactacggaacactttactacgttttacccgagtaacgtacgttcgtacgttacgtacgtccggaaccgtcccggtagtacgtaacggtaccgggttatttaaccttacgtacggtcggacgtacggtacggtaacggtacgtttaagttaggttaacgtttaggtttaggttaggttagggtttaaccttaccggtaaccgtacccgtagtaccgttaccgggccggggtacctacccggacccgggttaggggaccgtaacggaacgtttacgggcgtacccgtacccgttaccggtaccctccgtcccggtaaacccgg

SEQ ID NO: 139177 - DNA, 709 bp, Homo sapiens
  misc_feature: GYAE6OF01DYVWX.46.67.G01.1.454.CMB.1.raw
  modified_base (200)..(200): a, c, t, g, unknown or other
  misc_feature (200)..(200): n is a, c, g, or t
  modified_base (697)..(697): a, c, t, g, unknown or other
  misc_feature (697)..(697): n is a, c, g, or t
tcagactagcagtacacgaccggtgctcgatttagagtatacatattggggtttggggagtctcggtcaggacacagcatggacatgagggtccccgctcagctccgtggggctcctgctactctggctccggaggtgccagatgtgacatcgagctcgacccagtctccatccctccctgtctgaccaaccggtggganactagtcgtaccacatcgacttcggccggataagtacggaactattcgaacctacgttaatttaaagttgtactaccaaacagtaacgaccgacgggacccgtaccctaagccttacctaatctatgctgctacgtctaggttcgaacgtaacggtcgggtacctagtcggtaggttcaggtcggtacgtaggtcggtacttcggtagggactaagttacgttaccaccgttacgtaccgtaacctattaccgtaattacgttccgtaacggaacctaaggttagtaaaactttcgtttacgaaccgtttaaacgttttgttaaccgttaacggtaacctaaaagtacgtttaaacgtttactaaacggtttcggttaccggaacctaaacgggacctaacgttaacctaaaagtaaacgttacggtaactaggtaccgcttaccgacgtacgttattaccgtccgttcttacccgactttaccgtaccccaagttntaccgtgtaacc

SEQ ID NO: 139178 - DNA, 860 bp, Homo sapiens
  misc_feature: GYAE6OF01AKX40.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctcgacccagttcctccatccctccctgtctgcaaccggtggagacagtgtcaccatcacgttcggccgggacaacggtcggaactagttcgaacctaaccgtttaattttaaaacgttggtacttacgaactagtaacggaaccgacggggtacccggtaccctaagcctaccttaagtctaagtcgctcgactacgtccgtagtttacgacgtaaagggtcgggtaccctagttcggtaggttcgaggtcggactagggtcggtagtcggtaggtacgtaagttactttacacgttcctaccgtaacctacgttaacgtaagttaacgtccgttagaacggttaaacgttacgttaaacgttttacgtttaaccgtaacctttaaaaccgttttacgtttaaccgttaaggttaaccctaaaacgttaagtttaaaaccggttttaacgtttaaacgggtttttacgggttttaacccgggaaacccggtaaacgggttaaacccgtaaaccggttaaaaccttaaaaccggtttaaaaacgtaaacccggtaacgtttacggggtaccgttacccgttaaaccggtaaccctaacccgtttaagtttaccccgtttccgggtttaaccctttaaccggttacccccttttcccccgggttaacccttaccgttaaacccttttcccgggtaacgtttaaaccccg

SEQ ID NO: 139179 - DNA, 641 bp, Homo sapiens
  misc_feature: GYAE6OF01B7E0C.46.67.G01.1.454.CMB.1.raw
  modified_base (213)..(213): a, c, t, g, unknown or other
  misc_feature (213)..(213): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggacgaccctgtccctcacctgcgctgtctctggtcncctccatcagtgttggtttctcgtggggctgggtccgcagcctccgagggacgggctaggaatacagttggagtgttactctcagtagtgggtaggtttcctagttacacggtcccgtcttcgtacaagtacggtacgtagtcaaccgtatactctcgtaggaccacgtccagtacaacttctacgttttcccaagtaagtatggtaacgttcgtcgttacgcccggtccgctacggacgtacgggttacgttttatacgtgtcgacgaggacgtcggtacttagttactgttagtttttggagtttggtttagttacgacctaccgtaggtacgtacgggacgggtccgtccggtaccccggtgggaccgtaagggacgttacggtccggtactacccgttaccgttaccgttcgtcccgtaacccg

SEQ ID NO: 139180 - DNA, 880 bp, Homo sapiens
  misc_feature: GYAE6OF01ANN45.46.67.G01.1.454.CMB.1.raw
tcagactagcagtacacgaccggtgctcgatttagagtatacatattgggtttgtccctcctgctggtggcagctcccagatgggtcctgtccctggtgcaactgcaggagtcgggcccacgactggtgaggccttcggacgacccctgtccctcacctgcgctgtctctggtcgcctcatcagtagtgtttctcgtggggctgggtccggcagccgtcccgaggggacgggctggaatacagttggaagtgtctctcgtagtggtcggtacgttcctattcagttccgtctctcaagtgtcgatcaccatactctccgtggacctacgtccacgtacaactccttacgttttccagtaacgtacttggtaacttcgtcggtaccgacccgtccgtcgttacggaccgtacggggtttacgttttaacgtacgttcgggtacgggtacggtaacggtacggtaaccggttaccgtttaagttttaagtttaaggttttaggtttttacgggttaagggttttaaccggtttttaaccggtttacccggttaacccgtaacccggtttacggtaacccgggttaacccgggggtacccgggggtcccccgttaacccggggtacccccggggttaccgggggtaaccccggtaaacggggttaaccggttaccggttacccgggtaccccggttaccccggtttcccgtttaccccgttacccggtccccttaaccccggaaacccccggggttaccccggacccccggttaacccggttccccggtttaccccccggtttcccccccggttaccggtacccccccttaccccccggttaaccccgttacccccggaaaccggtcccggttaaccccccgg

SEQ ID NO: 139181 - DNA, 652 bp, Homo sapiens
  misc_feature: GYAE6OF01CM440.46.67.G01.1.454.CMB.1.raw
  modified_base (172)..(172): a, c, t, g, unknown or other
  misc_feature (172)..(172): n is a, c, g, or t
  modified_base (210)..(210): a, c, t, g, unknown or other
  misc_feature (210)..(210): n is a, c, g, or t
  modified_base (316)..(316): a, c, t, g, unknown or other
  misc_feature (316)..(316): n is a, c, g, or t
  modified_base (341)..(341): a, c, t, g, unknown or other
  misc_feature (341)..(341): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcncctcatcagtagttggtttctcgtggggctgggtccgnacgcctccgaggggagggctggaatacagttggaatgtctctcagtagtggacggttcctattacagtccgtctctcaagagtcgagtcaccatatctcgtggacncgtcagacaatctagtttccagaanatgagttctgtcgacccgcgtctacgaccgtacgggttacgttttaactacgttgtcggacggtaggacggtacggtacttaagttacgtagtttagttttagggagtttaggttttacttacgaacctacccgtaggtacgtcgggaccggggtcctcccggtacccggtggggaccgaaggggtactacggttcggtccgtacccgtccttaccgttccgaccctccgaacccggaccgggacccctacggtccggttacccccttccccggtcgcccctacccgttcccaacccgaggaccgtcccgg

SEQ ID NO: 139182 - DNA, 651 bp, Homo sapiens
  misc_feature: GYAE6OF01DVA84.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctcctgtctgcaaccgtggganacagtgtcacatcacttggccgggacaaggtacggaactagttcgaactaccttaattttaaagttggtaatcaaacatagaccgagggaccgccctaagcctactaatctaatcgctgcacttcctagtttcgacgtaaagggttcgggtccctagtcgaaggttcaggtcggacgtaggtggatcgtaggactaagtctttcactctaccaaccgtatacgtagttaactctagaacgtaacggtagtaaacgtttagtttacgaacttaaacttttacttacgttacggtaacctaaacgtaacgttaaactttaacgttaagtttacgggttttaccggaaccgtaaacgggtactacgtaaacttaaacgtaaaattaccgtaacgttgtaggactcgacgtaacctagttcttacgtccttactacttcccgttacccatacttctgtaaccg

SEQ ID NO: 139183 - DNA, 721 bp, Homo sapiens
  misc_feature: GYAE6OF01BIH6I.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatccctccctgtctgaccaaccggtgggagacagttcgtaccaccatctacgttcggccggggactaaggtccggaaacctagtttacgaacctaacctttaattttaaagttggtaactacgaaacagtaacgaccgagggacccgtaccctaagtcctacctaatctagtcgcgtacgcacgttccgtaggtttcgacggtaacgggtccgggtaccctagtacgtagggttacacggtggacgtaggtggtacgtcgtagggactagttacgttccacgtacgtaccaacctatacgtaacgttacgtcgtacggaccgtaaggttagtaacgtttacgtttacgtaaccttaactttacgttacgtagtaacctaaacgtaagttaaacttacggtaatttcgggtttaccggaacgtaaggtaacctaacgtaacttaaacgtaaacgttaaccggtaagtggttacgacgtacgtaaccgtaccgttattacggttcttaccttaccgtaccgttcccttacccggtaccttagtccgttcgtaaccg

SEQ ID NO: 139184 - DNA, 925 bp, Homo sapiens
  misc_feature: GYAE6OF01C0L8X.46.67.G01.1.454.CMB.1.raw
  modified_base (98)..(98): a, c, t, g, unknown or other
  misc_feature (98)..(98): n is a, c, g, or t
  modified_base (177)..(177): a, c, t, g, unknown or other
  misc_feature (177)..(177): n is a, c, g, or t
  modified_base (281)..(281): a, c, t, g, unknown or other
  misc_feature (281)..(281): n is a, c, g, or t
tcagactagcagtacacgaccggtgctcgatttagagtatacatattgggtttgtcctcctgctggtggcagctcccagatgggtcctgtccctggtncaactgcaggagtcgggcccacgacgtggtgacggtccttcggacgaccctgtccctcacctgcgctgtctcgtggtcncctcatcagtgttcggtttctcgtggggcttcggggtccgcagtccctccggaagggggaacgggtctaggaaacttacgtaggttgggaagttcgtaccgttntactaggttaggtgggtacggtttccttaagtacgacgttccgtctctacgtaagccgtacgaacgtccaacctagttctccgtcgtacggacctccgtaccaagtcctaacgttcgttaaccgttttccaaggaaacgtcgtttacggttacgtttaccgtacgggtacccgtaccccggcccgtaggtaaccggtaacccggggtttaacggggttttctttttaaaaccggttcgtcggggttaccgggaacggttaacgggtaaccgggttacggttaccgttttaaagtttacggttttagggttttaacggttttttacggggacgggtttttaacggttttaccgttaacccggttaaacccgttaaccccggttaagggttaaccgggttacccggggggttacccggggttacccgaccccgggttaaccccggggtacggggtaccggtaaacgggtaccgtttaccggtacccgttaccgtacccgggtttaccttacccggtccgtacccccggtaccgtaacccgggaccccggttcccgttaaccggttcccccggtttacccccgtcccccggtacccggtaccccctaccccccgttacccgtaaaccgtcggtacccgtaccccggg

SEQ ID NO: 139185 - DNA, 736 bp, Homo sapiens
  misc_feature: GYAE6OF01DQU8R.46.67.G01.1.454.CMB.1.raw
tcagactagcagtacacgaccggtgctcgatttagagtatacatattgggtttggggagtctcggtcaggacacagcatggacatgagggtccccgctcagctcctgggggctcctgctactctggctccggaggtgccagatgtgacatcgagctcgacccagtcctccactcctccctgtctgaccaaccggtgggagacagtcgtaccaccatcacgttcggaccgggacaaggtacggaactattacgacctaaccttaattttaaagtcggtaactacaacagtacggaaccgaacgggaccgaccctaagccttaccgtaatcttagtcgctcgactacgtccgtagttcgaacgtaaggtccgggtacctagtacggtacgtcgaggtcggacgtaggtgtactcgagggtacagtacttcactctacactatctaagtactcgagacgtaacgtgtaaagttctttacgaacttaatttacgttacgttagtaaacctaaacgtaagttaaacctttaacggtaagtttaccgggttaccgaaacccggtaaggtaaccctaaaccggtaaactaaaacgttaaaacgttaaaccgggaaccttggggtaccgtacgtaacccgtaaccgtaacccgtttaagttcccggtttatttaccccgtttacccgtttaaccgttccccccggttttacccgaaccttcgggttttaactacccggttaaac

SEQ ID NO: 139186 - DNA, 656 bp, Homo sapiens
  misc_feature: GYAE6OF01CZU44.46.67.G01.1.454.CMB.1.raw
  modified_base (175)..(175): a, c, t, g, unknown or other
  misc_feature (175)..(175): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgagggccttcgggacgaccctgtccctcacctgcgctgtctctggtncctccatcagtagttggtttcttcgtggggtctggggtccgcagcctccgaggggaggggctggaaatacattggaagtgtctactcagtagtggtacggttccttaagttacacgtcccgttctctacaagagtcgagtcacctatatctctggactacgtcagctaactctacgtttccagaagtactgtattctgtcgaccgcgcgtgaccgacgggttgtttacttacgtgtgcgagacgacggtcttattatgttagtttggtagttgttattacgactaccgtagacgtacggacggggtctacccggtaacccggtcggggaccgtaagggtaacgtacgttcggtaccctaccggttcctttacccgttaccgtccctacccgtacccggaaccgggtccctacggttcccggttccccttcccccgtacgggtccccctaaccccttcccctacctaaccggtccgtacccg

SEQ ID NO: 139187 - DNA, 617 bp, Homo sapiens
  misc_feature: GYAE6OF01EARC1.46.67.G01.1.454.CMB.1.raw
  modified_base (211)..(211): a, c, t, g, unknown or other
  misc_feature (211)..(211): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctcatcagtgtgtttctcgtggggctgggtccgcagcctcccggagggacgggcgtaggaatacgtagttggagtgtctctcagtaggtggtacgttcctattacgacgtccgtctctacaagtcgtcgagtcactatactctacgtcggacacgtcacgactaatctacgtttccgagaagtgtagtacgttcgtgtcgacccgcgtcgtagacgtacggtactttatcgtgtgcgtagacgacgtcttagtagttgtttaggtttggtagttgtttacttaccgacctacgtagtacgtcggggaccgggtctacccggtacccggtggggaccgtaacgggtacgttaccggttcggtaccgttaccccgttccgttacccgtcgtcccccgtaaaccccgg

SEQ ID NO: 139188 - DNA, 764 bp, Homo sapiens
  misc_feature: GYAE6OF01AZVAM.46.67.G01.1.454.CMB.1.raw
  modified_base (94)..(94): a, c, t, g, unknown or other
  misc_feature (94)..(94): n is a, c, g, or t
  modified_base (139)..(139): a, c, t, g, unknown or other
  misc_feature (139)..(139): n is a, c, g, or t
  modified_base (222)..(222): a, c, t, g, unknown or other
  misc_feature (222)..(222): n is a, c, g, or t
  modified_base (251)..(251): a, c, t, g, unknown or other
  misc_feature (251)..(251): n is a, c, g, or t
  modified_base (266)..(266): a, c, t, g, unknown or other
  misc_feature (266)..(266): n is a, c, g, or t
tcagactagcagtacacgaccggtgctcgatttagagtatacatattgggtttgggggacctcctgtgcaagaacatgaagcacctgtggtttntcctcctgctggtggcagctcccagatgggtcctgtcccgtggtncaactgcgaaggcgtccgggcccagacgtgggtgacggtccgttcggacgaccctgtcccctcacctgctctgtctctggtcncctaccatcagttaggttgtttcttcggnggggctcgggtccgntacgccgaccggaaggggacggggctaggaactacgtagttcgggaagttcgtctcctagtaggttacggtgggttacgttccttaagtacctacgttccgtactactagaacgtgttacgatccaactatactccgtgtacggacctacgtacagaacttagttcctttacgtttaccagaagttcgtagttacgttcttacgccggtacccgtccgtacgtacggaaccgttacgggttacgttttaatacgttgggtacgtacggtaaggaccggtcggtttaattaagttttaggttgttttaaggtttttagggacggtttttaacggtttaccgttcgtaaaccccggttagtaccggtagggttaccccggggaaccggggtccgttacccggtacccccggggtagggacccgggttaaaggacccgtttaaggcccgggtttacccttaacccggttcccgttacgttaccggtaccccctaacccggg

SEQ ID NO: 139189 - DNA, 634 bp, Homo sapiens
  misc_feature: GYAE6OF01B0FKO.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgactggtgaggccttcggagacccctgtcccctcacctgccgctgtctcgtggtcncctccatcgagttaggttggtttccttcgtgggggctggggtccggcacgccgtcccggaggggaacggggcgtaggaatactagttgggaagtgtctctcataggtggtaggttcctattacagtccgtctctacgaagagtcgagtccactatactctcgtgacctaccgtccaacgactaatccttacgttttaccctaggaacgtattggtagtttcgtggtaccgaccgcccgtcgtacggaccgtacgggttacgttttattcgtggtcggacgaggtacgacgtacttagttattgttagtttggtagttgtttattcgactacctgtacgtcggacgggtctaccggccgtagggccgtaaggacgttaccgtcggtcctaccgttccgtccttccgcccgtaccccgg

SEQ ID NO: 139190 - DNA, 775 bp, Homo sapiens
  misc_feature: GYAE6OF01A8J4L.46.67.G01.1.454.CMB.1.raw
  modified_base (195)..(195): a, c, t, g, unknown or other
  misc_feature (195)..(195): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtctccatcctccctgtctgacaaccggtggganacagtcgtaccaccatccgtacgttcggacccgggacaacggtaccggaacttagttcgaaccctaaccttttaattttaaaacgttcggtaacttaccgtaaaaccaagtaaccggaacccggtaacgggggaaccccgtacccccgttaaaggtccccttaacccttaaacttccttaacgtcggtaccgttcgaccttacgttacccgttaggtttacggacggtaaacgggttccggggtaccctaggtacggtagttcgaggtggcaggtacgtagtcgtagggactaggtacttacacctcgtacctactactacgtaagttaacctcgtacggactaacggtattaaggttactttacgaacctttaaactttacttaacgttacgtactaaactaacgttaaactttaacggtacgttttacggtttaacccggacggtaaacgggtacctaaaccgttaaactaaaccgttaaagttaaccgtaaccggttaggaccgttaacctaccgtaaccacgttactcggttacttccgtaccttacgttcccttaaccgactcttacgtcctacg

SEQ ID NO: 139191 - DNA, 853 bp, Homo sapiens
  misc_feature: GYAE6OF01EJJ00.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggagacagtgtcaccatcacgttcggccgggcaagtcggaacattagacctaaccttaatttaaagttggtatacaacatacgaccgagggaccgccctaagcctacctaatctatgctgacatccgtagtttcgacgtaaaggtcgggtaccctagttccggtaggttacgacgggtggaccgtagggttacggacgttcgggtaaggggtactaacggttacttttaccgtaccttaccgttacccgaacctaacgttacggtaagtttaaacttccggttaacggaaccgttaaacgggtttaacggtaaacggttttacgttttacggtaaaccctttttaaaaccgtttttaacgttttaacccgtttaacggttaaacccgtaaacgtttaaacggttttaaaacttttaaccggtttaaaacgtttttccggggtttttaaaccccggaacccggggttaaaaccgggtaaccgtaaaacccgtttaaaccgttaaaaccttaaaaccggtttaaaaccggtaacgttacgggttaccggttacggttaacccgtaaccggtaacccttaacgtttacccggtttacgtttaccctttaaccgttacccgtttacccctttacccccggacctttaacgttccggttaacgttaaaccg

SEQ ID NO: 139192 - DNA, 857 bp, Homo sapiens
  misc_feature: GYAE6OF01DJDS3.46.67.G01.1.454.CMB.1.raw
tcagactagcagtacacgaccggtgctcgatttagagtatacatattgggtttgtcctcctgctggtggcagctcccagatgggtcctgtccctggtgcaactgcagggagtccgggcccacgactgggtgaggccttcgggacgaccctgtccctcacctgcgctgtctcgtggtcgcctccatcagtagttggtttcttcgtggggctgggtccgcacgcctaccgaggggaacgggctaggaactacgtagttaggaagtcgtctcgtacagtaggtggtacggtttacctacttacgtacggttcccgttctaccgtacgaaagtacggtacgtacgtaccaaccgtacttaacgttccgttacgtaggaaccctaccgttaccgacgaactaacgttaccgtttaccgttttaccccgaagtaagtagttacggtacgtttcgttacggtacggaccccgtccgtaccggttacggtaacccggtacggggtttaccttttaacgtttaccggtggtacgacggtaaggaccggtacggttacgttaagttacgtttaggttttagttttagggtaagttttcggtttacttaccggtaaccctacccgtaggtaccggtacggggtacccggggtcccgtacccggaccccgggtacggggaacccgtaaaggggttactaaccggttccggttacccgtaccccggttccgttaccccgttacccgtaccccttacccggaacccggtaccgggtacccccttccggtttccccggttcccccgtttccccggaccccggtaccccttaacccccgtacccggtaacccgaacggtcccgtaaccccggg

SEQ ID NO: 139193 - DNA, 730 bp, Homo sapiens
  misc_feature: GYAE6OF01A1EA2.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacgttggccgggacaaggtcggaactattcgacctaccttaattttaaattggtatacaactatacgaccgagggaccgccctaagctacctaatctatgctgctactcctagtttacgacgtaaacgggtcgggtaccctagttcggtacggttcgaggtcggacgtaggtggtacgtcggtaggggactagttacgtttaccactcctacaccgtaacttcgaagttaactcgtacgaaccgtaacggttgtaaacgtttacttttacggaaccttaaaacgttttacttaccgttaggtaacctaaacgtaagttaaacttttaaccgttaaggttttaccggttttaaccggggaacccttaaaaggggtacccctaaacggttaaacttaaaccgttaaaaacgttaaaccggtaacgttacgggtacggtaccttaaggtacccgtaaccgtactttcgtttacgttacccttaccttaccttcccccgttacccgacttacttccgttacggttacc

SEQ ID NO: 139194 - DNA, 816 bp, Homo sapiens
  misc_feature: GYAE6OF01C6RL6.46.67.G01.1.454.CMB.1.raw
tcagactagcagtacacgaccggtgctcgatttagagtatacatattgggtttgggggagtctcggtcaggacacagcatggacatggacgggtccccgctcagcctccgtggggctcctgctactctggcctccggaggtgccagatggtgacatcgagctacgacccagtcctaccacttccctccctgttctcgaccgtaaccgggtagggacgacgtaggtcgtaccaaccgtactacgtacgttcggccgggaacgtaacggtaccggaactagttacgtaaacctaacctttaagttttaaacgttaggtaactacaaacgtacgtaacggaaccgggaacgggtaacccggacccttaacggtacccttaacgttaactacttacgtcgactcgtactaaccgtaccgttaggttacgaaccggtaacgggtcggtacctaggtacggtaggtacgaggtacgcggtagtggtacgttcgaggtactagtacttcgtactacctactaccatactaagttactagtacgtacgtaagttagtaagtttacgttacgtaactaacgtttacttaacgtactaaacgtaaactaacgttaaacgtttaagtttaacggtttaccgggtttaaaccggtaaccggtaaacggggtaaacctaaacggttaaaaccgtaaaacgttaaaaccggttaaacggtaacggttacggtaccggtaacctaccgtaaccgtaaccgttacgttacccgtttcgttacccttactttacccgtacccgttaccctaaccttacgttcgtaacgttacg

SEQ ID NO: 139195 - DNA, 702 bp, Homo sapiens
  misc_feature: GYAE6OF01A2W98.46.67.G01.1.454.CMB.1.raw
  modified_base (192)..(192): a, c, t, g, unknown or other
  misc_feature (192)..(192): n is a, c, g, or t
  modified_base (218)..(218): a, c, t, g, unknown or other
  misc_feature (218)..(218): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttggccgggnaaggtcggaacattgactaccttatttaaattggtatacaacatacgaccgagggaccgccctaagctacctaatctatgctgcatccagtttgactaaaggtcgggtacccagtccgtaggttcaggtggacgtaggtggatcgagggactagtacttacactcgtacacctatactaagtaactcttagaaccgtaacggttagtaaagttacgttttacggacttaaacttttattacgttacgtaacctaaacgttaacgtaaagttttaacctaaacggttttcggttttaacccgggaaccgttaaaccggggtaaccttaaaccgtaaactttaaaacgttaaaacgtttaaacggaaccgtttaagggtccggtaccgttaacgtacccgaaaccgttagttacccggttagttaccctttacgtaacccgtttccccgttaccccgtacctaaacgtttccttaaacggttaacc

SEQ ID NO: 139196 - DNA, 632 bp, Homo sapiens
  misc_feature: GYAE6OF01DY24C.46.67.G01.1.454.CMB.1.raw
  modified_base (229)..(229): a, c, t, g, unknown or other
  misc_feature (229)..(229): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccgtgggagacagtgtccaccatcacttgccgggcaagtcgaacnttgacacctatttaaatgtatcaacatagaccagggacggccctaagctcctaatctatgctgcatcagtttgcaaggtgggtcccagtcgagttcagtgcagtgatcgtggatagtatttcactcacaccatcaagtatctagactaacgtagtaagttatttgactaactttattaactagtaccaaactacgtaaatttaactaagtttcggttttaccggaaccggtaagggaacctaacgttaaacctaaacgttaaaatttaaaccgtaaccgtttaggtaccggtaccgttaggaccctaacccgttaagttacctttaccggttacccttttaccacccgttttacccccgtttaacccccgtacccgtttacttcccgttaaggttaaaccccg

SEQ ID NO: 139197 - DNA, 726 bp, Homo sapiens
  misc_feature: GYAE6OF01E36C1.46.67.G01.1.454.CMB.1.raw
  modified_base (193)..(193): a, c, t, g, unknown or other
  misc_feature (193)..(193): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgtcaccatcacttgccgggacaagtcggaacattgactaccttaatttaaattggtatcaacatagaccagggaccggccctaagctacctaatctatgctgctactcctagttttagacgtaaaaggttcggggtaccccaagttacggtacggttacgaggtcggacgtaggtaggagttcggtagggaactaggttactttcgtactccgtaccacctataccgtaagttaactccgtaggtaccgtaacggtagtaaagttacgttttacgacttaaactttatttaacttacgttaaccaaacgtaaggttaaactttaacgttaagtttacggtttttaccgggaacccggtaaaacgggtaccctaaacggttaaaccttaaaacgttaaaaccgtttaaaaccggtaacgttacgggttacggtaccttaccggtaccctaaccgtaacgttaccttcgtttacccttacctacccgtttacccgttaccccgaccttaccgttccgtaacgtttaaccg

SEQ ID NO: 139198 - DNA, 581 bp, Homo sapiens
  misc_feature: GYAE6OF01EKLVN.46.67.G01.1.454.CMB.1.raw
  modified_base (171)..(171): a, c, t, g, unknown or other
  misc_feature (171)..(171): n is a, c, g, or t
  modified_base (337)..(337): a, c, t, g, unknown or other
  misc_feature (337)..(337): n is a, c, g, or t
  modified_base (568)..(568): a, c, t, g, unknown or other
  misc_feature (568)..(568): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttctcgtggggctgggtccggcagcctcccgaggggagggctaggaatacagttggaagtgtctctcagtgtggaggttcctattacagtccgtctctcaagagtcgagttcaccatatctctggacacgtccagcaatcattttcccngaagatgagttctgtcgaccgccgctgacgacgggtcgtttatactgtgcgtagagacgctattagtgttagttttggagttggtttatttcgacctaccgtagtactcgggaccggggtctccggacccgtggggccgtagggtaacttacgtcggtaccaccgtctcctacgtccctaccaccgacggtcccacgttccggtacccttcccccgagtcccaccctcccncaagcgtaccccg

SEQ ID NO: 139199 - DNA, 645 bp, Homo sapiens
  misc_feature: GYAE6OF01ENJRJ.46.67.G01.1.454.CMB.1.raw
  modified_base (176)..(176): a, c, t, g, unknown or other
  misc_feature (176)..(176): n is a, c, g, or t
  modified_base (291)..(291): a, c, t, g, unknown or other
  misc_feature (291)..(291): n is a, c, g, or t
  modified_base (331)..(331): a, c, t, g, unknown or other
  misc_feature (331)..(331): n is a, c, g, or t
  modified_base (366)..(366): a, c, t, g, unknown or other
  misc_feature (366)..(366): n is a, c, g, or t
  modified_base (374)..(374): a, c, t, g, unknown or other
  misc_feature (374)..(374): n is a, c, g, or t
  modified_base (396)..(396): a, c, t, g, unknown or other
  misc_feature (396)..(396): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactgggtgaggccttcgggagaccctgtccctcacctgcgctgtctcgtggtcncctcatcgagttgttgtttctcgtgggctcgggcgcagcctccgagggaggctaggatacgtagttaggatgtactcgtcagttaggtggtacgttcctattacgacgttccgtnttcacgaaggtcgtcgaacgtcaacctattactcgttcgnggaacctcgtccagctaattctaaccgtttcaganatgcgttntgaccgccgcgtcgtacgtacncgggttatttacgcgtgtgacgagtacggtacgtattattagttgttagttttaggagttacgtttattaccgactccgtagtacgtccgggtacgggcctaccggtcccggagggaccgtaagggtacgtggtccgtctacccggtcttacccggacgtacccacccgtaaccggaccggtccctacgttccccgttacccgttaccccggcgtaccccaccccttacccgacccaaaggcctacccg

SEQ ID NO: 139200 - DNA, 738 bp, Homo sapiens
  misc_feature: GYAE6OF01D5CN8.46.67.G01.1.454.CMB.1.raw
  modified_base (195)..(195): a, c, t, g, unknown or other
  misc_feature (195)..(195): n is a, c, g, or t
  modified_base (399)..(399): a, c, t, g, unknown or other
  misc_feature (399)..(399): n is a, c, g, or t
  modified_base (446)..(446): a, c, t, g, unknown or other
  misc_feature (446)..(446): n is a, c, g, or t
  modified_base (508)..(508): a, c, t, g, unknown or other
  misc_feature (508)..(508): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtcctccatcctccctgtctgcaaccggtggganacagtgtaccaccatctacgttcggaccgggacaacggtaccggaactagttacggaaccttaaccttaagttttaaaacgttggtaacttacaaaactagtaacggacccgaaggggtacccggtaccctaagtcctacctaatcgtatcgctcgcacttccgtagttagacgtaacggtcgggtaccctagtccgtaggttnggtagcgtaggtgaactcggagggtacacggttactttacacttacncctaactacgtacgtaacgttaacgtccgtaagaccgtaaaggtggtaaatttacggttaanaccttaaatttacgtaagttacgtaacctaaagtaacgttaacttaactacgttttaacgtttaccgggaaaccgttaaaggggaacctaaaccgttaaacgaaaccgtttaaaaaacttaccgggtaaaccgttggttaaccggaccttaacggacctaaccgtacgttacttccgtaccccgtttaaacccgttttacccctaccgcccttaatcgggtacttaaccc

SEQ ID NO: 139201 - DNA, 683 bp, Homo sapiens
  misc_feature: GYAE6OF01C77ZY.46.67.G01.1.454.CMB.1.raw
  modified_base (194)..(194): a, c, t, g, unknown or other
  misc_feature (194)..(194): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgaccaaccggtggganactagtcgtccaccatccacgttcggccgggactaaggtccggaaactattacgaacctaacctttaattttaaaacgttggtaactacaaaactagtaacgaacccgaacggggacccggaccctaagccttacctaatctatgcctagcatccgtagtttcgactaacgggtcgggtaccctagtccggtaaggttcaggtggtcgaaggttgtaactcggtacggggtactacgtacgttttaccacgtttactaccaacctactacgtagttaaactccacgtaaccgtaagtagtaacgtttagtttcgaacttaacgtttatacgtcgtaacaagtaataacttaactagttttcggtaacgacggtaacggaactacgtaaataacgtaaagttaacgacttggtacgacgttacgacccttaacgtcttactcgttaccttaccgtaccgttcccttaaccccattattccgcgtttaacg

SEQ ID NO: 139202 - DNA, 872 bp, Homo sapiens
  misc_feature: GYAE6OF01BBATU.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagcctcccagatgggtcctgtccctggtgacaactgcagggacggtccgggcccacgacgtgggtcggacggtcccgttacgggaccgtaccccttcgtccccctcacccgtggccgcttggtccttcgtggtccgccctaccgtatccgtaaggttcggttcggttttccgtcggtcggggggtcgttcggggtcccggctacggtcccgtcccgggaagggggaagggctaggtaactacgtaaggttagggaagttcgtcctacgtacgtagttagggtaggtacggtttacccttaagttacccgtacggttccccgttacctaccgtaccgtaaaaggcggttaccgtaccgtaccaacctattacgtcctcgtacggactaccgtccagtactaacttcgttaccgtttaccgaggtaacgtagttcgttagggtttcgtacggttaaccgggacccggtccgtacggttacgggtaacccggttacgggttaccgttttaacgttacgttgggtacggtacggacgggtaacggtccggtattttaacgttagtttgttttaaggttttcgggtaagttttcggttttaaccgtttaaccgaaccgtacccgtaagggttagggtcccggggtaccggggtccccgtaccccggggtacccgggttacgggggaccggtaaagggggttaccttacgggttcccgtaacgttcccccggttaccttaccccggtacccgtccccgtaaccccggg

SEQ ID NO: 139203 - DNA, 637 bp, Homo sapiens
  misc_feature: GYAE6OF01BQBFL.46.67.G01.1.454.CMB.1.raw
  modified_base (193)..(193): a, c, t, g, unknown or other
  misc_feature (193)..(193): n is a, c, g, or t
  modified_base (226)..(226): a, c, t, g, unknown or other
  misc_feature (226)..(226): n is a, c, g, or t
  modified_base (388)..(388): a, c, t, g, unknown or other
  misc_feature (388)..(388): n is a, c, g, or t
tcagactagcagtacacgaccggtgctcgatttagagtatacatattggggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcacatcacttgccggcaagtcgaacnttgacactatttaaatggtatcaacatagaccagggacgccctaagctacctaatctatgactgcatccagttttgacgtaaaggtcggggtcccagtcggtaggtttcaggtggacaggtgatcgtgggactagtattcactctacacctatcaagtactntagactaacgtgtaacttattttagaccttaaactttattacttacgtactaaactagtaaactttaactaacgtttcggttttaccggaaccgtaaacggggaacctaaccgtaaacgttaaccgtaaaacgtttaaaccggaaacgttggtacggtacctacggtacctaaccgtaagttccgttagttaccctttaccgtaacctttccccgttaccccggtaaccttacttccgttgttaacccg

SEQ ID NO: 139204 - DNA, 659 bp, Homo sapiens
  misc_feature: GYAE6OF01C0UD9.46.67.G01.1.454.CMB.1.raw
  modified_base (249)..(249): a, c, t, g, unknown or other
  misc_feature (249)..(249): n is a, c, g, or t
  modified_base (266)..(266): a, c, t, g, unknown or other
  misc_feature (266)..(266): n is a, c, g, or t
  modified_base (340)..(340): a, c, t, g, unknown or other
  misc_feature (340)..(340): n is a, c, g, or t
  modified_base (358)..(358): a, c, t, g, unknown or other
  misc_feature (358)..(358): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgactggtgaggccttcggagaccctgtcccctgacctgccgtctgtctcgtggtcgtacctccgatcagttaggttcggttttctcgnggggtcttggggtccgnacgtccgtccgaagggagggcgtaggaatactagttaggaagtgtctctcagtaggtggtacgttcctattacncgtaccgtctctcgaagngtcgagtccaccattactctacgtcgacgtacgtcagtacaacgtactacgttttccgagtaacgtatggttacttacgttcggtccggtaacccggtccgtacgtcgaaccggttacgggttacgttttacgtacgtcgttacggcgagacggtacgtcttagttagttagtttagtttcgggtagtttcggttatttaccgaactaccgttagacgtccggtacgggtctaccggaccggtcggtacggaaggtacgttacgtgttaccgtacgttaccttctcccggtcgtaaccccg

SEQ ID NO: 139205 - DNA, 577 bp, Homo sapiens
  misc_feature: GYAE6OF01C2R76.46.67.G01.1.454.CMB.1.raw
  modified_base (345)..(345): a, c, t, g, unknown or other
  misc_feature (345)..(345): n is a, c, g, or t
  modified_base (364)..(364): a, c, t, g, unknown or other
  misc_feature (364)..(364): n is a, c, g, or t
  modified_base (410)..(410): a, c, t, g, unknown or other
  misc_feature (410)..(410): n is a, c, g, or t
  modified_base (552)..(552): a, c, t, g, unknown or other
  misc_feature (552)..(552): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagttggtttcttcgtggggctgggtccggcagcctcccgaggggaaggggctaggaatacattggaagtgtctctcagtaggtggaggttcctattacagtccgtctctcaagagtcgagtcaccatatctctgacacgtcagcaatctacgtttccagaagntgagttctgtcgaccgcgntcgaccgacgggtctttaattacgtgtgcgagacgacggcttagtntagttagttttaggagttggtttattcgacctaccgtagcgtcgggacgggtcctccggacccgtgggaccagggtactcgtcgtacaccgtctccgttacgccctccgacgaccggccctagttcccggtcccttccccgngccccaccctccaccgagcgtaccc

SEQ ID NO: 139206 - DNA, 618 bp, Homo sapiens
  misc_feature: GYAE6OF01DOY39.46.67.G01.1.454.CMB.1.raw
  modified_base (192)..(192): a, c, t, g, unknown or other
  misc_feature (192)..(192): n is a, c, g, or t
  modified_base (195)..(195): a, c, t, g, unknown or other
  misc_feature (195)..(195): n is a, c, g, or t
  modified_base (456)..(456): a, c, t, g, unknown or other
  misc_feature (456)..(456): n is a, c, g, or t
  modified_base (577)..(577): a, c, t, g, unknown or other
  misc_feature (577)..(577): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtctccatcctcctgtctgcaaccgtggganacngtcgtcaccatcacttggccggacaacggtcggaactattcgacctaacctttaattttaaagttggtaatcaaacagtacgacccgaagggaccggccctaagcctactaatctagtcgctgctactccgtagtttcgagtaaacggtcgggtacccagtcggaggttcaggtcggcgtagtggtactcgtagggtaactgttaacttcacttcctacaactgtacaagttaactcgtagacgtaaggtaagtaactttnttacgacttaagtttctacgtacaacaatattaacttaacgttagtttgttacccgaagaaacgggtctaaccgtaataaactaacgtaaacgagttccgtagacctgtaaccaacgttcntttacgtcttacctccttccctcccgatactcgttataccg

SEQ ID NO: 139207 - DNA, 653 bp, Homo sapiens
  misc_feature: GYAE6OF01A7LUC.46.67.G01.1.454.CMB.1.raw
  modified_base (221)..(221): a, c, t, g, unknown or other
  misc_feature (221)..(221): n is a, c, g, or t
  modified_base (295)..(295): a, c, t, g, unknown or other
  misc_feature (295)..(295): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatccctccctgtctgcaaccggtgggagacagtgtccaccatcactggccgganaagtcggaacattgactacttattaattggatcaacatagaccgagggaccgaccctaagctacctaatctatnctgacacttcctagttttcgagtaaaggtcgggtcccagttcggtacggttcgagttggctagggtaggatcggtgggaactaggttacttctacgtctacaccgtatacgtaagttactctagacctaaggtagtaaagttatttacggaactttaaacgtttacttaaccgttagtaaccaaacgttaagtaactttaacgtagtttacggtttacccggaacgtaacggaactaaccgtaactaaacctaaaacgttaacgtacgttagtacgtaccacgtacctactattcgttacggtaccttccggttaactttacccgtaccctacccgttaactttccgtaacgttaacg

SEQ ID NO: 139208 - DNA, 729 bp, Homo sapiens
  misc_feature: GYAE6OF01BWTQC.46.67.G01.1.454.CMB.1.raw
  modified_base (193)..(193): a, c, t, g, unknown or other
  misc_feature (193)..(193): n is a, c, g, or t
  modified_base (218)..(218): a, c, t, g, unknown or other
  misc_feature (218)..(218): n is a, c, g, or t
  modified_base (228)..(228): a, c, t, g, unknown or other
  misc_feature (228)..(228): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgtcacatcacgttggccggnaagtcgaacnttgactactatttaaattggtatacaacatacgaccgagggaccgccctaagctacctaatctatgctcgctatcctagtttcgacgtaaggtcgggtaccccagtcgtaggttacgagtggacgtaggtggtacgtcgtgggtaactagttactttaccgacttccgtacctacctagttaccgtaagttacgttaccgtacgaaccgtaacgggtagtaaaggtttattttaccgaactttaaacgtttaacgtttacttacgtaacctaaagtaacgttaaactttaacgtaacgttttacggttaccggtaaccggtaacgggtaaccgtaaccgttaaaccttaaaacgtaaaacgtttaaacccgaacggttagggtaccggtacttacccgggtaacctaacccgttaacgttcccgtttccgtttaaaccctttccgttaaacccgtttccccgttaccccgtacccttaacgttcccgttaaggttaaaccc

SEQ ID NO: 139209 - DNA, 648 bp, Homo sapiens
  misc_feature: GYAE6OF01BNK84.46.67.G01.1.454.CMB.1.raw
  modified_base (291)..(291): a, c, t, g, unknown or other
  misc_feature (291)..(291): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctcatcagtagtggttctcgtgggctgggtccgcagctccgagggagggctaggaatacagttggaagtgtcctctacagttagtggtacggttcctattacagttccgtctctcaagngttcgagtcaccatatctctaggacacgtccagcaatctacgttttccctagaacgtatgagttctcggtcgaccgccgctcgacgtacgggtacttttagtaccttagtcgacgaggtacggacggtcttagttagttagttagttttgggagtttggtttagtttccgaactacccgtagacgtcgggacgggggtcctaccggaccccggtcggggaccggaagggtaacgtccgttaccgggtctacccggttaccgtccgttaacgcccttacccgaccgaacgggtcccctacgttcccggtccctttcccccgaggtccccacccttcccgtaccaacggcgtaccccgg

SEQ ID NO: 139210 - DNA, 588 bp, Homo sapiens
  misc_feature: GYAE6OF01E1C04.46.67.G01.1.454.CMB.1.raw
  modified_base (226)..(226): a, c, t, g, unknown or other
  misc_feature (226)..(226): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcactgccgggcaagtcgaacntgacacttattaaattggtatcaacatagaccagggacgccctaagctcctaatctatgctgcatcctagtttgactaaaggtcgggtcccagtcgaggttcagtggctagtggatcgtggacagtacttcactctcactatcagtatcgtgcaagtgaagtatttacgactaacttatactagtacaactagtaattactaagttcgtttacggaccgtaacgggactaacggtaactaaacgtaaacgttaaccgtaacgtacggtacggtacctacggtacctaacctaattccgttacgtttaccttacccgtacgtttaccccgtttaccccgacctacgtttccgtgttaaacccg

SEQ ID NO: 139211 - DNA, 856 bp, Homo sapiens
  misc_feature: GYAE6OF01BG4P9.46.67.G01.1.454.CMB.1.raw
  modified_base (216)..(216): a, c, t, g, unknown or other
  misc_feature (216)..(216): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcgcctcatctagtagttggtttcttcggtggggtcgtgggtccggntacgcctccgaaggggaggggtctaggaatacgtagttagggaagttcgtcctctacgtaggtaggtcgggtacggtttccttaacgttacgtacgttccgttacctactaacgaaggtacgtacgacgttaccaacctattacttccgtacgtacgggaacctaccgtacccgaagtacctaaacgttccgtttaaccgtttttacccgaaggaacgtagttacggttacgttacgttacgggtacccggtaccgtcccggtagttaccgggaaccggttacggggtttacgtttttaaacttccgttagggtaccggtaacggtaacgggtaccgggtacgttaaccgttttaagttaggttaggttttaggtttttaggggtacgtttttagggttttaccgtaaccggtaacccgtacgttaaccgggtacggttaccgggggtaaccgggttccccggtaacccgggtccccgggtacgggggtaacccggaagggttaaccgtaccggttccggtaaccgttccccgtacttaccggttaccaccccgtacggaacccgtacgggttccccacggttcccggttccccgttaccgtccgacccccttcccgtaaccctacgtacgcgttccccg

SEQ ID NO: 139212 - DNA, 696 bp, Homo sapiens
  misc_feature: GYAE6OF01DSJRB.46.67.G01.1.454.CMB.1.raw
  modified_base (292)..(292): a, c, t, g, unknown or other
  misc_feature (292)..(292): n is a, c, g, or t
  modified_base (632)..(632): a, c, t, g, unknown or other
  misc_feature (632)..(632): n is a, c, g, or t
tcagactagcagtacacgaccggtgctcgatttagagtatacatattgggtttgggggacctcctgtgcaagaacatgaagcacctgtggtttgtcctcctgctggtggcagcctcccagatgggtcctgtcccgtggtgcaactgcaggaggtccgggcccagacgtggtggacggtcccgttcggacgaccctcgtcccctcacctgcgctgtctcgtgtcgcctcatcgtagtgttgtttctcggtggggtcgtcgggtccgcgacgccgtaccggaaggggacgggtntaggaatactagttgggaagtgtctctactagttggtagggtacgtttaccttagttaccgtacgtcccgttctctaacgtaagtcgtacgtacgtaccaccgtatacgttccgtcgtacggacctacgtaccacgtaactaacttcgtttacgtttccgaggtacgtatggtactcgtcggtaccggtacccgtcgtcgtacgggtaccgtacggttagttttaaccgtcgtggtagacggaagtcggtacgtatttagtagttggtttagttggttagttaggttacgttcgtaccgtacgtaggtgtaccgggtaccggtcgtacccggtaccgggnggtaccgtaacgggtactacggtcgtacctccggttacccttaccgtccgtccctaaccccggg

SEQ ID NO: 139213 - DNA, 1171 bp, Homo sapiens
  misc_feature: GYAE6OF01ACO2M.46.67.G01.1.454.CMB.1.raw
tcagactagcagtacacgaccggtgctcgatttagagtatacatattgggtttggggagtctcggtcaggacacagcatggacatggagggtccccgctcagctcctggggctcctgctactctggctccgaggtgccagatgtgacatcgagctcgacccagtcctccactcctcctgtctcgaccaaccggtgggactacgtaggtcgtaccaaccgtataccgtaacgtttcgggacccggggtaactaaacgggttaccggaaaccttacgtttaccggaacccttaaccgttttaaagtttttaaaacggtttacggggttaaacttaaccaaaacgttaacggttaaccgggaaccccgggtaaacggggggtaacccccgggtacccccgttaaaagggtccccttttaaccccgtttaaaacttccgtttaacgttccggggttacctttaccgggaacccttaaccgtttacccccgggttttaaaggggtttttaccggaaacccggggtttaaaaacccggggggttttccccgggggtttaacccccgtaacggttttaccccgggttaaacgggggttttaccgaacggggtttcggggaaaccgttacggggttaacggtaacgttaccgggtaacgggggtaaacccttaggtttaccttttacccggaccttttacccgtaaccgtaacccgttaagttaaccgttaaaggtttaaccgttacccgttaaccggtaaccgttaaacgggttaacggttaaaccggtttttacgtttacccggtaaaccgttttaaaacggttttccgtttaaccgtaacgttaaaccccgtaaaaggttaaccgttttaaacggtttaaccgttttaaaccgggtttccggggttttaacccgggaaaacccgggttaacgggggtaaacccccttaaaccgggttaaaaccgttaaaaccgttttaaaaaacccggttaacccgggttaaacggtttccgggttaccggtaaccgttaaacccgttacccccggtaaaacccgttttacgggttttaacccgttccgttttaacccccgttaaccgggttaccccttttacccccccgttaaacccggtttacccgttaaccgtttcccggttaaaacccgggttttaaccccg

SEQ ID NO: 139214 - DNA, 628 bp, Homo sapiens
  misc_feature: GYAE6OF01C3OIG.46.67.G01.1.454.CMB.1.raw
  modified_base (195)..(195): a, c, t, g, unknown or other
  misc_feature (195)..(195): n is a, c, g, or t
  modified_base (224)..(224): a, c, t, g, unknown or other
  misc_feature (224)..(224): n is a, c, g, or t
  modified_base (236)..(236): a, c, t, g, unknown or other
  misc_feature (236)..(236): n is a, c, g, or t
  modified_base (261)..(261): a, c, t, g, unknown or other
  misc_feature (261)..(261): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatccctcctgtctgacaaccggtggganactagtgtccaccatctacttggccgganaagtcggaactnttgacaccttatttaatgtatcaanatagaccgagggaccgccctaagcctacctaatctatgctcgctatcctagtttcgactaaggttcgggtccagtcgtaggttcagtcggcgaggtcggtatcggtgggaacagtactttccgacttactaccaacctatactaagtaattcgtacgactagtagtaagttatttacgactacgtttactcgttacgtaacaacgtaagtaactttactaagtttcggtttaaccggaaccgtaacgggacctaccgtaacttaaacgtaaacgttaaccgtaacgttacggtagaccgttacgtaccaccgtattcgttcgttaccttacgtacttacccgttacccacttactccgtaagtaccg

SEQ ID NO: 139215 - DNA, 651 bp, Homo sapiens
  misc_feature: GYAE6OF01BFW3U.46.67.G01.1.454.CMB.1.raw
  modified_base (97)..(97): a, c, t, g, unknown or other
  misc_feature (97)..(97): n is a, c, g, or t
  modified_base (190)..(190): a, c, t, g, unknown or other
  misc_feature (190)..(190): n is a, c, g, or t
  modified_base (193)..(193): a, c, t, g, unknown or other
  misc_feature (193)..(193): n is a, c, g, or t
  modified_base (200)..(200): a, c, t, g, unknown or other
  misc_feature (200)..(200): n is a, c, g, or t
  modified_base (214)..(214): a, c, t, g, unknown or other
  misc_feature (214)..(214): n is a, c, g, or t
  modified_base (225)..(225): a, c, t, g, unknown or other
  misc_feature (225)..(225): n is a, c, g, or t
  modified_base (589)..(589): a, c, t, g, unknown or other
  misc_feature (589)..(589): n is a, c, g, or t
tcagactagcagtacacgaccggtgctcgatttagagtatacatattgggtttggggagtctcggtcaggacacagcatggacatgagggtccccgntcagctcctggggctcctgctactctggctcgaggtgccagatgtgacatcgagctgacccagtctccatcctcctgtctgcgaacgtggganacngtgcacntcacttggccgganaagtcgaactntgactactattaatgtatacaatatagaccgaggacgaccctaagctacgtaatctatgctgcacgtacctagtttcgacgtaaggtcgggtaccagttcggtaaggtttcgaggtggactaggtcgggtagtcggtgggtaactaagttacgtttaccaccgttctaaccaccgtaaataccgtaagttaactccggtacgtaacgtaacccggttagtaaacgtttatttacgaaccgtttaaacttaacttacgttacgtaactaaactaagtaaactttactaagtttacggtttacgaaccgtaacggtaccgtaacgtaactaaacgttaaagttaacgtaacgttggtactcggtanacgtacttaagtcttagtacctttacgacctttccctaccgttactaactcgttacggtaac

SEQ ID NO: 139216 - DNA, 597 bp, Homo sapiens
  misc_feature: GYAE6OF01CJYH9.46.67.G01.1.454.CMB.1.raw
  modified_base (447)..(447): a, c, t, g, unknown or other
  misc_feature (447)..(447): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtcgcctccatcagtagtggtttctcgtgggctgggtccgcagcctccgagggaagggctggaatacagttggaagtgtctctcagtaggtggtacggttcctattacagtccgtctctacgaagcgtcgagtccaccatatctcgtgacacgtcagcaatctacgtttcccagtaacgtatgtagttcgtgtcgaccgcgctcgacgtcggtctttattctgtcgcgagagtacggtntacgttagtgttagttttggtagttggtttacttacgtacctaccgtaggtaccgtcgggccggggtacttacccggaccccggttggggaccgtagggtaacttcggttacgtcccgtaccgttcctacccgttcgcccgtaaccccgg

SEQ ID NO: 139217 - DNA, 941 bp, Homo sapiens
  misc_feature: GYAE6OF01A79SQ.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtcgcctccatcagtaggttggtttcttcgtggggcttggggtccggcagccgtacccggaggggaacggggctagggaactacgtagttagggaaagttcggtacttcctactagttacggtggaggttttccctacgtttacgtacgttccggttactcttacgaaaggacgtacgacgtcgaacctaattactctacgtgaacctacgtaccagtacaacttcgtaacgtttttcccgagtaaagagttacgtacgtttcgtacgtacgtacccgtccgtacgttacggaaccgtacggggttaccttttaaggtttacccgtgggttacggtaacgggacggtaacgggtaaccgggtacgttttaaagttttaacggttagggttttaagggttttttttacggggaacggggtttttaggggtttttaaacccgttttttaccgggaaacccccggtttaaacccggtttacggttaaacccggggtttacccggggggaacccgggggggtttaaaccccccgtttacccccggggggtaacccccccggggttttaacgggggggggaaacccccggggttaaaacggggggtaaaaaccccgggttttacccggggtttaccccgggggttaaacccggtttaacccccccggggtttttacccccgttttaaaccccgggttttaaaccccgggtccccccccggttttaaaacccccccggg

SEQ ID NO: 139218 - DNA, 650 bp, Homo sapiens
  misc_feature: GYAE6OF01EVY7C.46.67.G01.1.454.CMB.1.raw
  modified_base (227)..(227): a, c, t, g, unknown or other
  misc_feature (227)..(227): n is a, c, g, or t
  modified_base (252)..(252): a, c, t, g, unknown or other
  misc_feature (252)..(252): n is a, c, g, or t
  modified_base (379)..(379): a, c, t, g, unknown or other
  misc_feature (379)..(379): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtgggagacagtgtcaccatcacttgccaggcaagtcggaacnttgactactatttaattgtatcaanatagaccgagggaccgcccctaagcctacctaatctatgctgcatcctagtttgactaaggtcgggtaccatcggaggttcaggtggcaggtggaatcgtaggacagtatttcaccttctctaaccnttacagtaacttctgacgtaaacggtagtaaagttacgttttacgaacttaactttatttacgtacgtacctaaacgtaacttaaatttaccgtaagttttacggttttaacccgggaaccgtaaacggggtaaacctaaccggttaaaccttaaacttaaaacgttaaaaccgagttacgttacggtaccttacgacctaaccgactttcgtaccggtttaccttacgttaaccctttacccgtaccccgttaaccctcgtcgttaaccg

SEQ ID NO: 139219 - DNA, 542 bp, Homo sapiens
  misc_feature: GYAE6OF01AYX2O.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgccctaagctctaatctatgctgcactccagtttgcaaaggtggggtcccagtcgagttcaggtgcagtggatcgtagggacagatttcacttctcaccatcagtaatcgtagactaacgtacgaagtacttttggactaactttattactgtacaaacagtaattactaattgtttacggactaagggacaacgtactaactaaacttaaacgactgtacggctagaccactattctgttaccttctacttccttcccgactattcgtagtac

SEQ ID NO: 139220 - DNA, 732 bp, Homo sapiens
  misc_feature: GYAE6OF01DKAVU.46.67.G01.1.454.CMB.1.raw
  modified_base (218)..(218): a, c, t, g, unknown or other
  misc_feature (218)..(218): n is a, c, g, or t
  modified_base (251)..(251): a, c, t, g, unknown or other
  misc_feature (251)..(251): n is a, c, g, or t
  modified_base (412)..(412): a, c, t, g, unknown or other
  misc_feature (412)..(412): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgacgtggtgaggccttcggacgacccctgtccctcacctgccgctgtctcgtggtcncctcatcagtgtgttctgtgggctgggtccgcngcctccggaggggagggctaggaatacgtagttaggaagtgtctctctagtaggtggtacgttcctattactacgtcccgtctctacaagtacgtcgagtccaacctattactctcgtacggactacgtcagctaaatcttacgttttcccaggtaacgtntacgttacgttctggtcgacccgtcgtacgtcgaaccgtacgggtacttttacgtacgtggtcgacggtacggacggtacggtactttaagtttagttacggttttaagtttttcgggtaggttttacggttttaactttaccggaacccgttacccggttaaggtacggttcccgggggacccgggggttacccgtacccccgggtaccccggggttacggggggaacccgtaacgggggtaaacgtttcccgggttaccgggttcccgtaaccccggtttacccgttacccgtttcccgaccccgttaaccccccggg

SEQ ID NO: 139221 - DNA, 640 bp, Homo sapiens
  misc_feature: GYAE6OF01BU4U1.46.67.G01.1.454.CMB.1.raw
  modified_base (333)..(333): a, c, t, g, unknown or other
  misc_feature (333)..(333): n is a, c, g, or t
  modified_base (391)..(391): a, c, t, g, unknown or other
  misc_feature (391)..(391): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccgcagctccgagggagggctggaatacattggaagtgtctctcatagtggaggttcctattacagtccgtctctcaagagtcgagtcaccatatctctggacacgtccagcaatctacgttttcccngaagatgagttctgtcgaccgccgctgactacgggctttattactgtgcgagagacgntattatgtattttggagttggtttatttcgacctacccgtagacgtcgggacgggggtcctccggaccccgtgggggacccgaggggtaactacgttcggtccgacccggttccttacccgttaacggtccccttacccgaaccccgaaacggggtccccctaacggttcccggttccccgtttcccccccgttcgggtcccctaaccccccgttacccccgtacccgaaaccggtccggtaacccccg

SEQ ID NO: 139222 - DNA, 638 bp, Homo sapiens
  misc_feature: GYAE6OF01DWV3V.46.67.G01.1.454.CMB.1.raw
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttgccgggacaagtcgaacattgacaccttatttaaattgtatcaacatagaccagggacgccctaagcctctaatctatgctgctatcctagtttgacgtaaaggtcgggtaccctagtcgtaggttcgaggtggcaggtggtatcggtaggacagtactttccgacttacctcaaccgtatactaagtaattcccagaccgtaagttagtaaagttagtttacgaccttaaacttttacttaacttcggtaaccaaataagttaaacttaactaagtttggttttacccggaacgtaaagggtaacccaacgttaaacctaaacgtaaaactttaacgaacgttcggtacggtacctagacccgtaacctagttcttacgttacctttaccgacttccccttacccgcctaacttcgttgtaaccg

SEQ ID NO: 139223 - DNA, 768 bp, Homo sapiens
  misc_feature: GYAE6OF01C6THI.46.67.G01.1.454.CMB.1.raw
  modified_base (177)..(177): a, c, t, g, unknown or other
  misc_feature (177)..(177): n is a, c, g, or t
  modified_base (196)..(196): a, c, t, g, unknown or other
  misc_feature (196)..(196): n is a, c, g, or t
  modified_base (286)..(286): a, c, t, g, unknown or other
  misc_feature (286)..(286): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccntcagtagtggtttcttcgngggctgggtccgcagcctccgaggggagggctaggaatacagttggaagtgtctctcatgtggacgttctatacagtccgtctctcaagngtcgagtcaccatatctctagacacgtcagctaatctacgtttcccagaatactgtagttctgtcgaccgcgtcgtcgaacgcgggttacgttttacttacgttggtacgcggaagtacggacgttactttattagttagtttaggtttttacggtaaggtttcggttttaacgtttaccggaacccttacccgttaaggtaccggttaccggggacccgggggtaccgttaccccgggtaaccccgggtccgggggtaacccgggttaacggggtaacgttaaccgggttcgggtaaccccgtaccccggtttaccgtttaccccgtttaccggacccccgttacccggaaaccccggtaaaccccgggtaccccgttaccggtttaccccgggttccccccgttttacccccggtacccgggtaccccccttaacccccggttacccctaaccccggaaagggtccccgtaacccccggg

SEQ ID NO: 139224 - DNA, 643 bp, Homo sapiens
  misc_feature: GYAE6OF01E4PAY.46.67.G01.1.454.CMB.1.raw
  modified_base (213)..(213): a, c, t, g, unknown or other
  misc_feature (213)..(213): n is a, c, g, or t
  modified_base (434)..(434): a, c, t, g, unknown or other
  misc_feature (434)..(434): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctcgtggtcncctccatcgagttagtggttttccttcgtggggtcgtcggggtccgcacgcctacccggagggggaaggggtctaggaactactagttggaagtgtcctctacataggtggtacggtttcctaattacgacgttccgtctctacaagtacgtcgacgtcacctatactctcgtggaccacgtccagacaattcttacgtttcccagtaagatgtagtttcnggtcgaccgccgtctacgaccgtacgggttcttttacgtcgtggtcgacggaggaggacgtctattagtgtttaaggtttggagttgtttaacttcgaacctaccgtaggaccgtccgggacggggtccctaccgggtcccggtggggacctagggtacttcggtcggtaccgtaccccgttccgtacccgttaccgccctaaccccgg

SEQ ID NO: 139225 - DNA, 721 bp, Homo sapiens
  misc_feature: GYAE6OF01DCSGL.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctccgtggggctcctgctactctggctccgaggtgccagatgtgacatcgagctgacccagtctccatcctcctgtctgcaaccggtgganacagtgtccacatcacgttggccgggacaagtcggaactattcgactacttatttaagtgtatcaacatagaccgaggaccggaccctaagcctactaatctatcgctgctactccgtagtttcgacgtaacgggtcgggtacctagtccggtaggttcgaggtcggtacgtaggtcggtaactcggtagggtaacgtacggtacttttaccgacctttaccaccgtaacctaactacgtaagttaacttcgtacgtacgtaaaggtacgtaaagtttacgtttacgaaaccttaacttttaaccgttaacgttacgtaaacctaaacggtaagtttaaacttaacgtttaacgtttacggttttaaccggaaccggtaaacgggtaacctaacggttaaaccttaaaacgttaaaacgttaaaccgtacgtacggttacggaccttacggaccctaaacgtatttacgttaccgttacttaccgtaccgtttcccttacccgtacgttaacttccgttaaggtaaccg

SEQ ID NO: 139226 - DNA, 636 bp, Homo sapiens
  misc_feature: GYAE6OF01EWC93.46.67.G01.1.454.CMB.1.raw
  modified_base (252)..(252): a, c, t, g, unknown or other
  misc_feature (252)..(252): n is a, c, g, or t
  modified_base (280)..(280): a, c, t, g, unknown or other
  misc_feature (280)..(280): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacatgacacctatttaaattgatcaanatagaccaggacgccctaagctcctaanctatgctgacatcctagtttgacaaaggtcgggtcccagttcgagttcgagtggcagtggatctgggacagtatttcactctacaccgtatagaagtaactctagaccaaggttagaagttatttacggactaaactttattacgtagttaacaacgtaagtaaactttaacgtaatttcggtttaaccggaccgtaaaagggtacctaaccggtaaacttaaacgttaaaaacttaaaacgaaccggtttagtacggggtaccttacggacctaacccgtaagtaccgttacggtttaccttaaccctaaacgttcccgttaccccccgtaccgtaacctttcgtcggttaaacc

SEQ ID NO: 139227 - DNA, 556 bp, Homo sapiens
  misc_feature: GYAE6OF01EA39W.46.67.G01.1.454.CMB.1.raw
  modified_base (211)..(211): a, c, t, g, unknown or other
  misc_feature (211)..(211): n is a, c, g, or t
  modified_base (440)..(440): a, c, t, g, unknown or other
  misc_feature (440)..(440): n is a, c, g, or t
  modified_base (445)..(445): a, c, t, g, unknown or other
  misc_feature (445)..(445): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttcttcgtggggctgggtccggcagcctcccgagggaaggggctggaatacagttggaagtgtctctcatagtggaggttcctattacagtccgtctctcaagagtcgagtcaccatatctctggacacgtccagcaatctacgttttccctgaagtatgagttctgtcgaccgccgtctcgacgacgggtcgttttattacgtgtgcgagngacgntattatgtagtttttggagttggtttatttcgactaccctagactcggacggggctccggtacccgtgggaccgagggaactacgcgtcaccgttctccttgccgtacccg

SEQ ID NO: 139228 - DNA, 677 bp, Homo sapiens
  misc_feature: GYAE6OF01BSN7W.46.67.G01.1.454.CMB.1.raw
  modified_base (219)..(219): a, c, t, g, unknown or other
  misc_feature (219)..(219): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttggccgggnaagtcgaacattgactacttaatttaagtgtatacaacatagaccgaggacggaccctaagctcctaatctatgctgacactctagtttcggacaaaggtccggggtaccctagttcggaaggtttcgaaggtcggacgtaggtaggtacgtcgttagggacagtactttcctactcgtaccaaccgatacgaattaactctagacgtaacgttataagttatttgactaactttatactacgtaactaaacagttaaacttacgtaagtttacgtttaccggaaaccggtaacgggtaaccaacggttaaaccttaaacgtaaaaaccgtttaaaccggaaacgtttcggtaacggtaccgttaacgtaccctaaaccgttagttacccggttatttaccccgttacttaacgtttcccccgttaccccgtaactacctttccgaacgtttaaaccg

SEQ ID NO: 139229 - DNA, 663 bp, Homo sapiens
  misc_feature: GYAE6OF01BIFU5.46.67.G01.1.454.CMB.1.raw
  modified_base (316)..(316): a, c, t, g, unknown or other
  misc_feature (316)..(316): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatccctccctgtctgcaaccggtgggagacagtgtccaccatccacttggccgggacaagtcggaacattcgactacctatttaaattggtatcaacatagaccgagggaccgccctaagctacctaatctatgctgcatcctagtttnctaaagtcgggtccatcgagttcagtggctaggtggatcgtagggacagtactttacgacctctaccaacatacagtaatctagaccgtaacggtgtaaacgttacttttaaccaaacttttactttaactacggttaccaaacgtaaggtaactttaacgtaagttttacgttttaccggaacctaaacggggtaactaccgtaaaccgtaacgttaaaacgtttaaacgaccgttaggttcggtactacgacctaacccgtacgtttaccgttcgttcctttcccgtaacctttccccgtttaccccgggtacccttacgtttacgttagtaacctttaacccgg

SEQ ID NO: 139230 - DNA, 683 bp, Homo sapiens
  misc_feature: GYAE6OF01A8LL5.46.67.G01.1.454.CMB.1.raw
tcagactagcagtacacgaccggtgctcgatttagagtatacatattgggtttggtcctcctgctggtggcagctcccagatgggtcctgtccctggtgcaacgtggcaggagtcgggcccacgactggtgaggccttcggagaccctgtccctcacctgcgctgtctctggtgcctccatcagtagtggtttctcgtggggctgggtccggcagctccagggagggctggaatacattggaagtgtctctcatagtggagttcctattacagtccgtctctcaagagtcgagtcacctatatctctggacacgtccagacaatcctacgtttttccccagaaacgtagtgtacgtttcctggttcgacccgtccgactcggaccgtacggggtcttttaattaccgtgtcgacgagaggacgtcttaattatgttagttttaggagtttggttactttacgactacccgtagtacgtacgggtaccggggtcctaccggaccccgttgggggacccgtaaggggtaacttaccggtcggttacccgtacccgttccgtacccgttacggtcccctacccgtaacccggtaacggggtacccctaacggttcccgggttaccccttccccccgtacgggtacccctacccccgttacccgtacccgaaacggtccgtaccccg

SEQ ID NO: 139231 - DNA, 546 bp, Homo sapiens
  misc_feature: GYAE6OF01A5RB8.46.67.G01.1.454.CMB.1.raw
  modified_base (192)..(192): a, c, t, g, unknown or other
  misc_feature (192)..(192): n is a, c, g, or t
  modified_base (217)..(217): a, c, t, g, unknown or other
  misc_feature (217)..(217): n is a, c, g, or t
  modified_base (347)..(347): a, c, t, g, unknown or other
  misc_feature (347)..(347): n is a, c, g, or t
  modified_base (430)..(430): a, c, t, g, unknown or other
  misc_feature (430)..(430): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggnaagtcggaacattgacacctatttaaatggtatcaacatagacagggacggccctaagctcctaatctatgctgcactccagtttgacaaaggtcgggtacccagtcgaggttcaggtggcagtgatcgngggacagtattcactctacacgtatacaagttaactctagactaagtagtaagttatttcgacttaacttattactgtacaanagtaatactaagttcgtttacgacgaagggtactaacgtaacttaaactaaacgttaacgaacgtgtagactagacgacctatactctcttcacttctacccgatactcgtagtac

SEQ ID NO: 139232 - DNA, 730 bp, Homo sapiens
  misc_feature: GYAE6OF01BWP3M.46.67.G01.1.454.CMB.1.raw
  modified_base (181)..(181): a, c, t, g, unknown or other
  misc_feature (181)..(181): n is a, c, g, or t
  modified_base (214)..(214): a, c, t, g, unknown or other
  misc_feature (214)..(214): n is a, c, g, or t
  modified_base (280)..(280): a, c, t, g, unknown or other
  misc_feature (280)..(280): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgactggtgaggccttcgganaccctgtccctcacctgccgctgtctctggtcncctccatcagtagttcgtttctggtgggctgggtccgcagcctccgaggggagggctaggaatacngtaggaagtcgtctctactagtaggtggtaggtttccttagttacgtacgttccgtcttcctacgaagtagtcgacgttcaaccgtatacgtctcgtacgacacgtccagctaatctacgtttcccagtaacgtgttgtacgtttacgtcgtaccgacccggccgtacgtcggaccggttacgggttcgttttaaccttacgtggtacggtacgtacgggacggtaccggttacttagttttaacgtgttttacggttttttagggtaacggttttgggttttaaccgtttaccgtaaccccttacccgttaaggtcggttaccgggggacccggggtcccttacccggggtacccccggtagggggacccggtaaagggtacccgtttaggtaccggttacccggttacccgttaccgtttcccgtaacccgttccccgtaaaccccgg

SEQ ID NO: 139233 - DNA, 575 bp, Homo sapiens
  misc_feature: GYAE6OF01A6AZ4.46.67.G01.1.454.CMB.1.raw
  modified_base (331)..(331): a, c, t, g, unknown or other
  misc_feature (331)..(331): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctgggctgggtccgcagctccagggaggggctggaatacattggaagtgtctctcagtagtggaggttcctattacagtccgtctctcaagagtcgagtcaccatatctctggacacgtccagcaatcacgttttcccngaagatgagttctggtcgaccgccgctgacacgggtctttagttactgtcgcgagagacggcttattatgtattttggagttggttatttcgactacctagacgtcggcggggcctcggcccgtgggccgagggtatacgtggtcaccgttctccttacgccctaccaccgaaccgggtccccacgttcccggtcccttcccccgtcggtacccctaccccttccctacccaaggcgtaccccg

SEQ ID NO: 139234 - DNA, 757 bp, Homo sapiens
  misc_feature: GYAE6OF01AQB6M.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtccctcacctgcgctgtctctggtcgcctccatcagtagttggttttctcgtggggctcggggtccggcagcctcccgaaggggacggggctggaactactagttggaagttgtctctcagttaggtggtacggttcctaagttaccgacggttcccgttactctacgaaggtcgtacgacgtccaaccgtagtacttcctacgtacgggaccctacggtaccaaggtacctaaagtccgtttaaccgtttttcccgaaggtaagtattcggtaacgtttcgtcgtacggaccccgtccggtctacggtacccgtacggggtttccttttagtaccgttgggagtcgaagggtacgaccgggtactttagttacgtaggtttaggttttaggaggttttaggtttacgttccggacctaccgttaggacgtaccggggtacggggtccttacccgggacccgggttacggggaccgtaagggtaacttacgggtccgtccgtaccgtccttaccgttccgacctacccgaccggtaaccggtccctacggttccccggttaccctccccggaggtaccccctaccccttaccggaccacggtcgtacccg

SEQ ID NO: 139235 - DNA, 1040 bp, Homo sapiens
  misc_feature: GYAE6OF01DITSD.46.67.G01.1.454.CMB.1.raw
  modified_base (176)..(176): a, c, t, g, unknown or other
  misc_feature (176)..(176): n is a, c, g, or t
tcagactagcagtacacgaccggtgctcgatttagagtatacatattgggtttgtcctcctgctggtggcagctcccagatgggtcctgtccctggtgcaactgcaggagtccgggccccacgactgggtgaggccttcggagacccctgtccctcacctgcgctgtctctggtcncctcatcagtagttggtttcttcgtggggtctcggggtccgcacgtcctacccggagggggaaggggtctaggaatactagttgggaagttcgtctctacgagtaggtggtacggtttaccttattaaccgtacgttcccgttcttctacgaagagtacgagtccgaaccctattacttcctcgtacggaacctaccgtacccgaagacctaaacttccgttaacgtttttacccctaggtaaacgtagttacggttaacgtttccgttaggttacccgaacccggtccccgttacggtaccggtaacccgggttaccggggttttaccgtttttaaacgtttaccgttacgggttacgggtaccgggtaagggtaaccgggtaacccgggttaaccttttaaggttttaaggttaggttttttaaggtttttttacggggttaaacgggttttacgggttttttaaaccgttttacccggtaaaccccgtttaaacccccggttaaagggtttaacccgggtttaaccccgggggtaacccgggggggtttaccccgttacccccgggggttaacccccgggttacggggggtaaccccgggtaaacgggggttaaaccgtttacccgggtttaccgggttaccccggtaccccggtttcccgtttaaccccgtttacccggtaccccccgttaacccccggaaacccccgggttaaacccgggtaccccccgtttaacccgggtttcccccgggttttaccccccccgtttacccccccgggttacccggttacccccccgttacccccccgtttaccccccggttaacccgtaaacccgggtcccggttaacccccccggg

SEQ ID NO: 139236 - DNA, 746 bp, Homo sapiens
  misc_feature: GYAE6OF01DR86O.46.67.G01.1.454.CMB.1.raw
  modified_base (199)..(199): a, c, t, g, unknown or other
  misc_feature (199)..(199): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctcgacccagtcctccactccctcctgtctgcctaaccggtggganacagtgtccacctatcacgttcggcccgggacaaacggtcggaaactagtttacgacctaaccttaattttaaattggttaactacaaacaataacgaaccgacggggaccggaccctaagacctacctaatctatgctagactagtccgtagtttcgacgtaacggttcgggtacctaagtcggtacggttcacggtggcgtaggtggatcgtgggactagtacttcactctacactactactaagtaactcgtacgtacgtaagttacgtaaattattttacgaacctttaacgtttaactttaacgttacggtaaccaaaacgttaacgttaaaacttttaacgtaacgttttcggttttaaaccgggaccgtaaaacgggtacgtaaaccgtaaccgttaaaactaaaacgttaaaacggtaacgttacgggtacgtaccgtaacggtacctaacccgttagttaccggtttcgtttaaccccttccttaacccgttttaccccttaccccgtacccgtttaacttcccgttaagtaaacccg

SEQ ID NO: 139237 - DNA, 704 bp, Homo sapiens
  misc_feature: GYAE6OF01CMBOB.46.67.G01.1.454.CMB.1.raw
  modified_base (175)..(175): a, c, t, g, unknown or other
  misc_feature (175)..(175): n is a, c, g, or t
  modified_base (251)..(251): a, c, t, g, unknown or other
  misc_feature (251)..(251): n is a, c, g, or t
  modified_base (290)..(290): a, c, t, g, unknown or other
  misc_feature (290)..(290): n is a, c, g, or t
  modified_base (323)..(323): a, c, t, g, unknown or other
  misc_feature (323)..(323): n is a, c, g, or t
  modified_base (345)..(345): a, c, t, g, unknown or other
  misc_feature (345)..(345): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgagggtccttcggacgaccctgtccctcacctgcgctgtctctggtncctccatcagtagtggttctcgtgggctgggtccgcagctacccgaggggaagggctagatacagttggatcgtcnctcataggtgagttcctatacacgtccgtctctacaagngtcgagtcacctatactcacgtgactactcganacatctacgtttaccagaagtntagtagttctaggtcgaccgcgcgtagaccgtacggttacgtttacttacgtggtgacgaagacgtaccggtatagttataggttagttttgggaagtttaggttacttacgtaccgtaaccgtagtcggtacgggtacgggtacccgtaccggtaaccccggttcgggacccgggtaagggtaaacgttacgttcggggtaacccttacccggtaccgttaccttaccggccccttaacccggaaacccgtaaccggggttacccctacggttaccccgggtttccccttaccccccgggttacggacccccttaaccccctacccgtaacccgtaaacgggtcccgtaaacccccgg

SEQ ID NO: 139238 - DNA, 784 bp, Homo sapiens
  misc_feature: GYAE6OF01DMPX8.46.67.G01.1.454.CMB.1.raw
  modified_base (257)..(257): a, c, t, g, unknown or other
  misc_feature (257)..(257): n is a, c, g, or t
  modified_base (718)..(718): a, c, t, g, unknown or other
  misc_feature (718)..(718): n is a, c, g, or t
tcagactagcagtacacgaccggtgctcgatttagagtatacatattggggtttggggagtctcggtcaggacacagcatggacatgagggtccccgctcagctcctggggctcctgctactctggactccggaggtgccagatgtgacatcgagctgacccagtctccatcctcctgtctgaccgaaccggtgggacacgaggtctccaacctatctaccgtttcggacccgggactaaacggttccggaaacctntttacgaacctaacctttaattttaaagttggttaactacaaactacgtaacgacccggaacgggacccggtaccctaaggtccttactaattcctagtcggtctgactacgttaccgtaaggtttcgaacggtaaacgggttccggggtacccaaggttccggtaaggttcgtaggtggtacgtaggttagggtaactcgggtaacgggtaactaaggttacttcctacgtcctacctaactacgtactaagtactctacgtaacgtaagtacggtaatttcgtttacgaactttaccgtttaactacgttacgtaactaaacgtaagttaaactttaacgttaacggttttacggtttaaccggaaccggttaaacgggtaaccctaacgttaaaccgttaaacgttaaaaccggttaacgtacggttaaggtccggtacgtaccgtacgtaaaccgtnttacccgttcgttacccttaccgtaccctttacccgtacccgtactttacgtcgttaacggtaacc

SEQ ID NO: 139239 - DNA, 844 bp, Homo sapiens
  misc_feature: GYAE6OF01DS6LK.46.67.G01.1.454.CMB.1.raw
tcagactagcagtacacgaccggtgctcgatttagagtatacatattgggtttggggagtctcggtcaggacacagcatggacatggacgggtccccgctcagctccgtggggctcctgctactctggctccgaggtgccagatgtgacatcgagctcgacccagtcctccactcctcccgtgtctcgacgaaccggtgggaagactaggtctccaacctataccgacgttcggcccgggactaaggtccggaactagttgaaccttaacctttaattttaaacgttggtactacgaactaacgtaacgaacccggaacgggacccggtacccgtaagtacccttaacctaacgttaccgtattacgcgtactactaccttacgttacggtttagaaccgggtaaacgggttccgggtacctacggttacgggtacgggttacgagggttacggacgttacgggtaggtacgttacggtagggtaacgtagttaccgtttacctacctccttaaccgaccttaacgtacttaacgtactccgtacgtaaccgttaacggttaaggttaagtttaacgtttacgtaaacctttaacgtttacttaacgtaccgtttaacgaaacgttaaattacgtttaaagttaacggtttttaaccgggtttaacggtaacccgggaacggtaaccgtaaacgttaaacccgttaaacttaaaaccggttaaccggttaacgtacggttcggtacccgttacggtaacccaacgtttacgtttacggttcccgtttaacttacccgttaaccgttcccgttaccctaacgttcttaaccggttactaaaccgg

SEQ ID NO: 139240 - DNA, 834 bp, Homo sapiens
  misc_feature: GYAE6OF01AKPBD.46.67.G01.1.454.CMB.1.raw
  modified_base (212)..(212): a, c, t, g, unknown or other
  misc_feature (212)..(212): n is a, c, g, or t
  modified_base (305)..(305): a, c, t, g, unknown or other
  misc_feature (305)..(305): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtcccctcacctgcgctgtctctggtgcctccatcagttagtggtttctcgtggggctgggtccggnagcctcccgaggggagggctaggaatacagttgggaagttgtctctacagttaggtggacggttcctattacaggttcccgtctctacgaagngtcgagtcaccatatctcgtggacctacggtccagctaactccttaacgttttcccaggaagtgtagtagttcgtggtacgacccgccgtctacgaaccgtacggggttacttttaacgttacgttggtacggacggtaggtaacggtaccggtactttaagttagttacggtttaggttttttacgggtaggttttacgggttttaactttacccgggtaaacccttaacccggtttaaggtaaccgggttacccgggggtacccggggggttacccgttacccccggggtaaccccccggggttggggggtacccccggttaaagggggtaaaccgtttaacccgggttacggttaaccccgtaccccgtttcccgtttacccgttaacccggtacccctaccccggtaacccggtaaccggggtacccccttaacggttcccccggtttacccccggtttcccccccgacgggttcccccctaacccccgttaccccgtaacccgaaacggtccccggtaacccgg

SEQ ID NO: 139241 - DNA, 851 bp, Homo sapiens
  misc_feature: GYAE6OF01AWR6V.46.67.G01.1.454.CMB.1.raw
  modified_base (193)..(193): a, c, t, g, unknown or other
  misc_feature (193)..(193): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgccaacggtggganacgagtcgtacaccatcacttcggaccgggacaaggtcggaactagttacgaacctaaccgttaatttaaaagttggtaataccaaactaagtaacggaccgaaggggacccggtacccctaaagccttaacctaaatccttaagtcgtacgtacgacctacttacccgttaaggtttacgaacgtaaacgggttcgggtaccccaagtaccggtaggttacgaaggtcggacgaggtacggtaacgttccggtaagggaacctaaggttactttaccaaccgtttactaacccgtaaacctaagttaccgtaaacgttaacgttccgtacgggtaaccgtaaacgggttaacggttaaacgtttaacgttttaacggaacctttaaaacgttttatttaaccggtaactaactaaaacgtaaacgtttaaactttaacgtaaagttttacgggtttaaccggaaacccggtaaagggtaacccttaaaccggtaaacttaaaaccgttaaaaaccgttaaaacggacctttaggggttaaccggtaccttacggtaaccccgtaaacgtttaccggttacgttaccgttaaccctttacccgtaacccgttttacccttacccccgttaccgttaacctttccggtaagttaaaccg

SEQ ID NO: 139242 - DNA, 844 bp, Homo sapiens
  misc_feature: GYAE6OF01AUUZZ.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcgaggggtcggcccgacgacgtcggtggacggccgtcggtacggaccctcgtccctccaccgtcgcgctcgtctcgtcggtcgcctccatctaggttaggttggtttcctttcgtgggggtcggtcgggttccggcgagccgtcccggtagggggaacggggtcgtagtaagtacgtagttagggaagtctctcgtctagtaaggttggtattccgttaccttagttacctacggttccgtccttactacgaagtaggcgtagtaccaccgtatacgtctcgtacggaccttaccgccacgactactacgtttccgtttaccgtaaggaaacgttagttacggttacggtttcgtacggtaccgacccggtccggtacgttaaccggtaacgggttccgggtttaaccgttttaagttacgttacggtacgggtacggaacggtacggtacggtttaaccgttaagttttacggtttaagggtttacggtttttagggttaacgggtttacggttttaccgttaaccgggtacctaaccggttacgggtacggtacccgggggtaccggggtacccccgttaccgggtaacccccggggtagggtaacccggggtaacggttaaccggtttacccgtaccggggttacccctacccgggtttaccccttacccggttaccccggtcccgtaaaccccggg

SEQ ID NO: 139243 - DNA, 664 bp, Homo sapiens
  misc_feature: GYAE6OF01AQ3EO.46.67.G01.1.454.CMB.1.raw
  modified_base (192)..(192): a, c, t, g, unknown or other
  misc_feature (192)..(192): n is a, c, g, or t
  modified_base (217)..(217): a, c, t, g, unknown or other
  misc_feature (217)..(217): n is a, c, g, or t
  modified_base (616)..(616): a, c, t, g, unknown or other
  misc_feature (616)..(616): n is a, c, g, or t
  modified_base (625)..(625): a, c, t, g, unknown or other
  misc_feature (625)..(625): n is a, c, g, or t
  modified_base (635)..(635): a, c, t, g, unknown or other
  misc_feature (635)..(635): n is a, c, g, or t
tcagactagcagtacacgaccggtgctcgatttagagtatacatattgggtttggggagtctcggtcaggacacagcatggacatgagggtccccgctcagctcctgggggctcctgctactctggctccgaggtgccagatgtgacatcgagctgacccagtctccatcctcctgtctgcaaccgtggganacagtgtcaccatcacttggccggnaagtcggaacattgacaccttattaaattggtatcaactatacgaccgaggggaccggtaccctaagcctaccgtaattcgtaatgctagctatcctagtttgacgtaaggtcgggtaccagtacgaggttcaaggtcggacgtaggtaggacgttcgtaggactagtacttaccgacctctaccgaactacgttaccgaagttaactaccggtactaccgtaaacggttcggtaaagtttaacttttggaaaccctttaaagtttaacttaacccgttaagtaacccgtaaaataacggtaaatttaacgtaagttacgggtttaaccgaaccggtaaaggtaccaacgtaactaaactaaaagttaaccaagttcgtacgtctacggcctaaacgtnttacggttnttccttaccncttaacccgttccacctactgtcgtaacg

SEQ ID NO: 139244 - DNA, 623 bp, Homo sapiens
  misc_feature: GYAE6OF01EXHHA.46.67.G01.1.454.CMB.1.raw
  modified_base (212)..(212): a, c, t, g, unknown or other
  misc_feature (212)..(212): n is a, c, g, or t
  modified_base (320)..(320): a, c, t, g, unknown or other
  misc_feature (320)..(320): n is a, c, g, or t
  modified_base (409)..(409): a, c, t, g, unknown or other
  misc_feature (409)..(409): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggccttcggagaccctgtccctcacctgcgctgtctctggtgcctccatcagtagtggtttcttcgtggggctgggtccggnagctccccgaggggaaggggctggaatacagttggaagtgtctctcatagtggaggttcctaattacagtccgtctctcaagagtcgagtcaccatatctcgtggacncgtcagcaatctacgttttcccagaacgtatgtagttctgtacgaccgccgctgactacgggtctttagtactgtcgcgagacgacggnttattagtgttagttttaggtagttggtttacttcgtaactacccgtagtacgtaccgggacggggtccgttccggaccccgtggggacccgtaaggggtaacttacgtggtcctaccgtctaccgttaccgccgtacccaaccgaccggccctacgttccggttccccttccccgtacggcccctccccgtacccttccaaacgcgtaccccg

SEQ ID NO: 139245 - DNA, 658 bp, Homo sapiens
  misc_feature: GYAE6OF01CVW18.46.67.G01.1.454.CMB.1.raw
  modified_base (257)..(257): a, c, t, g, unknown or other
  misc_feature (257)..(257): n is a, c, g, or t
  modified_base (304)..(304): a, c, t, g, unknown or other
  misc_feature (304)..(304): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtgggagacagtgtcaccatcacttggccgggacaagtcggaacattgacacttatttaaattgtatcaacanagaccagggacggccctaagctcctaatctatgctgcatccagtttnacaaggtcgggtacccagtcgaggttcagtggctaggtcggatcgtagggactagtactttcactctacactatactagtatctgactaacgtagtaagtattttaggacttaactttacttacttacggttaaccaaacgtaacgtaaactttactaaagtttacggtttttaccggaaccgtaaacgggtaaccgtaacgtaaccgttaaaactaaaacgtttaaaccggtaaaccttaggtacgggtacctaccggtaccgtaaccccgtaattaccggtttacgtttaccgtttaccttaaccgtttcccctttacccccgacccgttaacttccgttaagttaaacccg

SEQ ID NO: 139246 - DNA, 788 bp, Homo sapiens
  misc_feature: GYAE6OF01CTZWX.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccagactggtgacggtcccttcggacgaccccttggtccccctgacccttggccgcctgtcctcgtgggtcaccttccaatccaggttagttcggttttccttcgtcgggggccttgggggtccccgcgtacggcccttacccggaagggggaacgggggtactacggggtaaacttaaccgagttagggaaacggttcggttaccttacgtctagtaggttagggtacggtttccttaattaccgtacgtccgtcttctaccgaaagtcggtacgtacgtacctaccgaattactccgtcgtacggaccaccgtccaaggtacaaacttccgtacgtttttacccgaggtaaacgtgtacggttagttccgttaggtccggtaacccgtccgtacgtaggaccggtaacgggttaccgtttaattaccggttggtcggtacgtaggaacggtacggtcttaaattggtagtttacgttttgggtaacgtttgggtttactttaccggtaactaccgttaggtaccgtcccgggacggggtccctaccggtaccccgggtggggacccgtaacggggtacttaccgggtccggtacctaacccggttcctttcgtccgtccgtaaccccgg

SEQ ID NO: 139247 - DNA, 582 bp, Homo sapiens
  misc_feature: GYAE6OF01DO81X.46.67.G01.1.454.CMB.1.raw
  modified_base (191)..(191): a, c, t, g, unknown or other
  misc_feature (191)..(191): n is a, c, g, or t
  modified_base (226)..(226): a, c, t, g, unknown or other
  misc_feature (226)..(226): n is a, c, g, or t
  modified_base (346)..(346): a, c, t, g, unknown or other
  misc_feature (346)..(346): n is a, c, g, or t
  modified_base (350)..(350): a, c, t, g, unknown or other
  misc_feature (350)..(350): n is a, c, g, or t
  modified_base (355)..(355): a, c, t, g, unknown or other
  misc_feature (355)..(355): n is a, c, g, or t
  modified_base (410)..(410): a, c, t, g, unknown or other
  misc_feature (410)..(410): n is a, c, g, or t
  modified_base (570)..(570): a, c, t, g, unknown or other
  misc_feature (570)..(570): n is a, c, g, or t
  modified_base (578)..(578): a, c, t, g, unknown or other
  misc_feature (578)..(578): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtggganacagtgtcaccatcacttgccgggcaagtcgaacntgacacttatttaagtgtatcaacatagaccagggaccgaccctaagcctactaatctatgctgctactccgtagtttcgacgtaaaggtcgggtccagtcgtagttcagtggcagtggntcgnggacngtattcactcacactatactagttaactcgtacgaacgtaacgtagtaacgtttntttacgaacttaactttattactacgtacaagtaagtaactttactaagtttcggtttaccgacgtaaacggactaacgtaacttaaacttaaacgttaacgtacgttagtacggactacgactacctatttcgttcttccttctaccttccttacccgnttactgtntacg

SEQ ID NO: 139248 - DNA, 786 bp, Homo sapiens
  misc_feature: GYAE6OF01BP8IA.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtcgccagatgtgacatcgagctgacccagtcctccatccctccctgtctgccaaccggtgggacacagtcgtaccacctatccacgttcggaccgggtacaacggttacggaaacctagtttacgaacctaacctttaaagttttaaaagttggtaacttaccgaaacgtaataacggaacccggacggggtaacccggaccctaaaggtccttacctaattctaacgtgtcctgtacctcgttacgtagtttcgaacgtaaacgggtcgggtacccagttaccggtagttacgtaggtcgggacgtagggtacggacgttacgggtacggggaactaaggttacctttaccaccgttccttacccgaaccttacgtacgtaagttacgtaccgtacgaaccgttaaggttacgtaacggtttacttttacgaacctttaaacttttacgttaaccgtagtaaacctaacggtaaattaaacgttacgttaaagttttccggttaaccgggaacccggtaaacggtacgtaaccttaaacgttaaataaaacgttacgtacgttaggtaccgtctaacgtacctaccttacgttacgttccgttaccttaccttaccgttaccccgttacccaaggttcctacgtacgttacg

SEQ ID NO: 139249 - DNA, 785 bp, Homo sapiens
  misc_feature: GYAE6OF01A53H6.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagcctcccagatgggtcctgtccctggtgcactgcaggagtccgggcccacgacgtggtgacggtccttcggacgtaccctcgtcccctcaccgtgcgcttgtctctggtcgcctcatcgagttgttgtttctcgtcgggctcgggtccgcacgccgtccggaggggacgggtctaggtaactacgtagttaggagttcgtctctactagtaggtggtacggtttcctaagttacgacgttcccgtctacgtacgaacgtcgtacgacgtaccaacctagtactctacgtacgacgaccgtcacgtactacgttccgtttttacgttccgtaagtaacgtagttcggtacgttttcgtacggtacccggacccgtccgcgttaacggaccggttaccgggtttactttacgtttacgtggtacggacggtacggacggttacgttatttaagtttaggtttaggtttacggttttgggtacggttttacggttttaacctcccggtaacccgttaaccggttacggacccgggtttacccgggacccggggggttcctacccccgggggtacccgggttaggggaaccccggttaaaggggtaaaccttccggggttaccgttaccccgtaccccgttttcgttaaccccggttacccgtccccgtaaccccggg

SEQ ID NO: 139250 - DNA, 561 bp, Homo sapiens
  misc_feature: GYAE6OF01EHRNM.46.67.G01.1.454.CMB.1.raw
  modified_base (535)..(535): a, c, t, g, unknown or other
  misc_feature (535)..(535): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgagggagggctggaatacattggaagtgtctctcatagtgaggttcctattacagtccgtctctcaagagtcgagtcaccatatctctggacacgtccagcaatctagttttccctgaacgatgagttctgtcgaccgccgctgacgacgggtcgtttatacgtgtgcgagagacggctattatgtagttttggagttggttattcgactccgtagatcggacggggtctccgcccgtcgggcgacgggtactcgtacggctacgtctcctacgcctacaccgacggtcccacgttccgtcctccccgtcggacccnccctaccctaccgaacgtcgtacccg

SEQ ID NO: 139251 - DNA, 541 bp, Homo sapiens
  misc_feature: GYAE6OF01EE7XN.46.67.G01.1.454.CMB.1.raw
  modified_base (415)..(415): a, c, t, g, unknown or other
  misc_feature (415)..(415): n is a, c, g, or t
  modified_base (536)..(536): a, c, t, g, unknown or other
  misc_feature (536)..(536): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggagacagtgtcaccatcacttgccgggcaagtcggaacattgacacttattaaattgtatcaacatagaccagggacgccctaagctactaatctatgctgcatccagtttgacaaagtgggtaccagtcgaggttcagtgcgagtggatcgtgggacagtattcactctcacatacagtaatctagactaagtgaacgtatttgactaacttattactgtacaaanagtaattacaattgtttaccgactaagggactaacgtaacttaactaaacgttaaacgaacgtacgtgactagacctacgtattacgttactcgttacacttcccttaccgacctattccngtaac

SEQ ID NO: 139252 - DNA, 750 bp, Homo sapiens
  misc_feature: GYAE6OF01DULFI.46.67.G01.1.454.CMB.1.raw
  modified_base (734)..(734): a, c, t, g, unknown or other
  misc_feature (734)..(734): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccactccctccctgtctgccaaccggtgggagacagtcgtccaccatccacgttcggccggggacaacggtaccggaactattcgacctaacctttaattttaaacgttggtaactacaaacagtacgaccgacggggaccggaccctaagcctacgtaatctatgctgacacttcctaggtttcgaacgtaacgggttcgggtaccctagttaccgggtaggtttcgaggttcggacgtaggtacggacgttcggtacgggtactaaggtttacctttaccgtacttacctaacctaaccctaaacgtttacgtaaacggtttaacttccgttaacggtaccgtaaacggttagttaaacgtttaacgtttttcgaaaacttttaaccgtttaacttttaccgtaggtaccttaaaacgtaatttaaacttacgttaaaggttttcgtttaacggaccgtaaagggtacctaacgtaacttaaaacgtaaacttaacgaacgttcgtaacggtactcgaaccgtacttagttactcgtttacttccttacgttacccctaccccggtntttactcgtataaccg

SEQ ID NO: 139253 - DNA, 710 bp, Homo sapiens
  misc_feature: GYAE6OF01ENJNU.46.67.G01.1.454.CMB.1.raw
  modified_base (140)..(140): a, c, t, g, unknown or other
  misc_feature (140)..(140): n is a, c, g, or t
  modified_base (201)..(201): a, c, t, g, unknown or other
  misc_feature (201)..(201): n is a, c, g, or t
  modified_base (236)..(236): a, c, t, g, unknown or other
  misc_feature (236)..(236): n is a, c, g, or t
  modified_base (251)..(251): a, c, t, g, unknown or other
  misc_feature (251)..(251): n is a, c, g, or t
  modified_base (404)..(404): a, c, t, g, unknown or other
  misc_feature (404)..(404): n is a, c, g, or t
tcagactagcagtacacgaccggtgctcgatttagagtatacatattgggtttggggagtctcggtcaggacacagcagtggacagtggacgggtccccgctcagctccgtggggctcctgctactctggctccgaggtnccagatgtgacatcgagctgacccagtcctccatcctccctgtctgaccaaccggtggganactagtcgtaccactatccacgttcggcccggganaacggtcggaaactnttacgaacctaactttaattttaaatggtatacaaacagtacgaccgagggaccgaccctaagcctactaatcctagtgctgactactaccgtagtttacgacgtaaaggttccgggtaacctaggtacgtaggttacaggttcgacgtaggngtactacggtggaacttaggtactttcacgttacctacaaccgttataactaagtacgtactacgtactaaacggttatacggttaagtttcgaaacttaaacgtttacgttacgtaagtaacctaaagtagttaacgtttaacgttagtttaccggtttaaccggaaccggtaaacggactaaaccggtaacttaaaccgtaaacgtttaaccgacgttacggtaggtaccgtagacccgtaactacgttacgttacttacgtacctaccgtttcctacccgtactacgttccgtaagtaacccg

SEQ ID NO: 139254 - DNA, 740 bp, Homo sapiens
  misc_feature: GYAE6OF01CKTPU.46.67.G01.1.454.CMB.1.raw
  modified_base (227)..(227): a, c, t, g, unknown or other
  misc_feature (227)..(227): n is a, c, g, or t
tcagactagcagtacacgaccggtgctcgatttagagtatacatattgggtttggggagtctcggtcaggacacagcatggacatgagggtccccgctcagctcctggggctctgctactctggctccgaggtgccagatgtgacatcgagctgaccctagtcctccactcctccctgtctgacaaccggtggagacagtcgtacaccatcacgttggaccgggtanaaaggtcggaactattagaactaccttaatttaaagtgtaatacaacatagaaccgtagggaccggaccctaagctacctaatctatgctcgactactaccgtagtttgactaaaggtcgggtaccctagtcggtaaggttcgaggtcgactaggtagtagtcgtagggacaacgtattttcgactcgttaccaacacgtactaacgtaattcgtacgtaacgtaacgttaagtaagttaacgttttacgaaacttaactttaacgtttactaacggttaactaaacgtaacggtaaatttaaaccgtaaaggttttaccggttttaaccgggaaccgtaaacgggtaaccgtaaacccggtaaacgttaaacctaaaaaacggttaaaccgtaaaccggttaggttaccggtaccttacggaaccctaaccggtaatttccgttaacggttaccctttaaccgtacgtttcccctaaccccggtaccttaacggttccttaaggttaacccg

SEQ ID NO: 139255 - DNA, 613 bp, Homo sapiens
  misc_feature: GYAE6OF01ETNL3.46.67.G01.1.454.CMB.1.raw
  modified_base (211)..(211): a, c, t, g, unknown or other
  misc_feature (211)..(211): n is a, c, g, or t
  modified_base (256)..(256): a, c, t, g, unknown or other
  misc_feature (256)..(256): n is a, c, g, or t
  modified_base (320)..(320): a, c, t, g, unknown or other
  misc_feature (320)..(320): n is a, c, g, or t
  modified_base (345)..(345): a, c, t, g, unknown or other
  misc_feature (345)..(345): n is a, c, g, or t
  modified_base (432)..(432): a, c, t, g, unknown or other
  misc_feature (432)..(432): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagaccctgtccctcacctgcgctgtctctggtgcctccatcagtagtggtttcttcgtgggctgggtccggnagcctcccgaggggaaggggctaggaatacagttggaagtgtctntcatagtggaggttcctattacagtccgtctctcaagagtcgaagtcaccatatctctggaccncgtaccagtcaatctacgtttcccngaagattgacgttctagtcgaccgccgtctagacgtacgggtcgtttaattcgtggtgcgtagagtacgctattatgttagttttgngtggttattcgactacctgagtcggacggggtctccggacccgtggggccgtagggtaataccgttggtaccacccgttccgtccgttacgtcccctaccgaccgtaacgggccctacgttcccggttcccttccccccgtcgggacccctacccgtacccctaccgtaaacgcgtacccg

SEQ ID NO: 139256 - DNA, 758 bp, Homo sapiens
  misc_feature: GYAE6OF01C9XPY.46.67.G01.1.454.CMB.1.raw
  modified_base (223)..(223): a, c, t, g, unknown or other
  misc_feature (223)..(223): n is a, c, g, or t
  modified_base (247)..(247): a, c, t, g, unknown or other
  misc_feature (247)..(247): n is a, c, g, or t
tcagactagcagtacacgaccggtgctcgatttagagtatacatattgggtttgggggacctcctgtgcaagaacatgaagcacctgtggtttgtcctcctgctggtggcagctcccagagtgggtcctgtccctggtgcaactgcagggagtccgggcccacgacgtggtgacggtccttcggacgccctcgtcccctctacctgcgtctgtctcgtggtcncctcatcgagttgttgttctcggngggcgtcggtccgcagccgtaccggaggggaggctaggaatacgtagttaggagttcgtacttctactaaggttaggtaggtacgtttacctaagtttaccgtacgttcccggttacttactacgaagtacgtcgtaacgtcaacctattcgttactaccgtacggaacctaccgtaccagtacctaattccgtttacgttttccgaaggatagttacgttacgttcgtacgtacggtcccgtaccgtcgtacggtaaccgttacggggtttacctttacgttacggtggacggacggttacgaacgggttcgttaactttagtttagttgtttaacggtttgggttacggtttagttacctttacgaccgttaacgtagggacgttcgggggacccggttcgtaacccccgggtcgggtaaggggtacccggaaaggtttacccgtacggttacccggttacccgttacccgtttaccctccccggttaccggaccccgttaacccccgg

SEQ ID NO: 139257 - DNA, 802 bp, Homo sapiens
  misc_feature: GYAE6OF01EEX28.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggacgtccgggcccacgacgtggtgaggtccttcggacgaccctgtccctcactgcgtctgtctctggtcncctcatcgtagttagttggtttccttcggtgggggtccgttcggggtcccggcacggtccgtacccgggaagggggacggggtctagggtaaactacgtagttagggtaagttcgtctctactagttaggtgggtacggtttccttaagttaccgagttcccgtctacgtacgaaggtacgtcggacgttaccacctatacttccgtcgtaggaaccctcgtaccagtactagtctttaccggtttccgaagtagtgtacgttacgttcgtaggtcccggaccggtcgtacgtacggtaaccggttacggggtttcttttaacgttaccggtgggtaccggaacgggtaacggtaccggtacggtttaactttaagttacggtttaggttttagggtttttagggaggttttaccgggtttttacttacccggaaccttaacccggttagggtaccgggttaccggggtacccggggacccttacccggggtaccccgggtaggggaaccccggtaagggttaaaccttccgggtaccggttaccctacccggtttcccttaaccgttccgcccctaaacccggg

SEQ ID NO: 139258 - DNA, 788 bp, Homo sapiens
  misc_feature: GYAE6OF01CV4AA.46.67.G01.1.454.CMB.1.raw
  modified_base (172)..(172): a, c, t, g, unknown or other
  misc_feature (172)..(172): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggccttcggagaccctgtccctcacctgcgctgtctctggtncctcatcagtagtggtttctcgtggggctgggtccggcacgccgtacccgaggggaaggggctagggaaactacgattagggaagttcgtctacgtcagttaaggtagggtacggtttacctaagttacacggtcccgttactcctaccgaaagtaaggtcgaacgtacaccctaatatctcgtacggaactaccggtaccagcaaattctaagtttttaccccagaaactagtgtaagttcgtgcggtacccgcgtctacggacgacggggttacttttaattacgtagtggtacgaaggaacgacgggtacttaagttagtaggttagttttttagggaaggtttcggttttaacttacggtaacccttaacccgtaacggtacggttacgggaccgggggtaccgttcccggtaaccccccggttacgggggacccgtaaaggggtaacttacccggttcggttaaccggtacccgttaccgttacccgtttacggaccccgttacccaaacccgggtaaacggccccgttaacgttcccgggtttaccccttccccccgtaacgggtcccctaaaccccgttccctaaacccggtaaacgccggtaaccccg

SEQ ID NO: 139259 - DNA, 605 bp, Homo sapiens
  misc_feature: GYAE6OF01AWGT6.46.67.G01.1.454.CMB.1.raw
  modified_base (316)..(316): a, c, t, g, unknown or other
  misc_feature (316)..(316): n is a, c, g, or t
  modified_base (387)..(387): a, c, t, g, unknown or other
  misc_feature (387)..(387): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtccaccatcacgttcggccgggacaaggtcggaactattacgacctaccttaatttaaagttggtactacaactaatacgaccgacggggaccgaccctaacgtctacctaatctangctcgcactccgtagttacgacgtaaggtcgggtaccagtcgtaggtcagtgcgagtgatcgaggacagtnttacactctacacatctaagtactcgtacgactaacgtagtaagttacgttacgtacttaactttactacgtacgtaacctaagtaactaattaacgtagttcggtttacgaacgtaacggtactacgtaactaactaaagtaacgacgtcggtacgactacaccacttatacttcgttactctaccgttcccgtacccgtataccgtgttactaacg

SEQ ID NO: 139260 - DNA, 735 bp, Homo sapiens
  misc_feature: GYAE6OF01C226D.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactgggtgaggtccttcggagacccctgtcccctcacctgcgctgtctcgtggtcgcctccatcagtagtggtttcttcgtggggctgggtccgcagcctacccgaggggaaggggctaggaatacagttggaagttgtctctcgataggtggtaggttcctattacagtccgtctctcaaagcgtacggatcacatactctcgtgaccacgtccagcaactgtacgttttcccagtaagattagtagttcgtagtacgaccgtccgctagaccggtacgggttaccgtttagttaccgtgtcggacgacgtagtacggtcttaagttgtagttttagttttaggtaggtttacggtttagtttaccgaaccgttacccgtaagtacggtacccggggtacggggtcccttcccgggacccggtacggggtaccggaaggggttaaccttaccggttacggtacccgtacccggttacccttacccggtaccgtaccccgtacccaacccgggtaaccgggtaccccgtaaccggttccccggttaccccgtttccccccggtacgtcccccgtaaccccgttccctaaccccgtaacggcccgtaacccccgg

SEQ ID NO: 139261 - DNA, 656 bp, Homo sapiens
  misc_feature: GYAE6OF01CD4M6.46.67.G01.1.454.CMB.1.raw
  modified_base (221)..(221): a, c, t, g, unknown or other
  misc_feature (221)..(221): n is a, c, g, or t
  modified_base (232)..(232): a, c, t, g, unknown or other
  misc_feature (232)..(232): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgaccccagtctccatccctccctgtctgccaaccgtgggagacagtgtccaccatccacttgccggnaagtcggaacnttgactacctatttaaatgtatcaatatagaccgagggaccgccctaagctacctaatctatgctgctatccgtagtttcgacgtaaggttcgggtaccctagttccggtaggttccaggtggctaggtggtagtcgtagggactagtacctttcactcctacaacctactacaagttaacctctacggaacgtaaccggttagtaagtttagtttcaacgttaaactttagttaaccttgtacccaaagtacttaaacttacgtaagtttcggtttacggaacccgtaaaggaccctaacgtaaaccgttaaacgtaaaacgttaaccgtaacggttagttcggtaccaaccggtaccaaccgttactccgtttagtaccctttaccgacctttacccggcccctatccttacgtcgttaacg

SEQ ID NO: 139262 - DNA, 802 bp, Homo sapiens
  misc_feature: GYAE6OF01DD9HF.46.67.G01.1.454.CMB.1.raw
  modified_base (174)..(174): a, c, t, g, unknown or other
  misc_feature (174)..(174): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggccttcgggagaccctgtccctcacctgcgctgtctctggtcncctccatcagtagttggtttctcgtggggctgggtccgcagcctccgaggggagggctaggaatcagttggaagtcgtctctcagtaggtggtacggttcctaattacacgttcccgttctcctcgaagtagtcgacgtcaccatactctctaggacaccgtcagactaatctacgtttccagaacgtatggtacgttcgtggtccgtacccggtccgcgttacggaccggtacgggtttacgttttaacgtaccgttggtacggaccggaaggtacgtaccggtacttaagtttagttaggtttagtttttagggtacgtttaggtttacgtttacccggtaccgtaaccgtacggtaacggtacccggggtaacggggtcccgttacccgggtaccccgggttacgggggacccgtaaggggttaaccgtaccggttaccgggttacccgttcccggttacccgttacccggttaccgcccccgttaacccggaaaccccggtaaacccggggtcccccttaaccggtttcccccgggtttccccccgtttaccccccggacccggttacccccgttaacccccccgttcccgtaaaccccgtaaccggtaccccgtaccccccgg

SEQ ID NO: 139263 - DNA, 600 bp, Homo sapiens
  misc_feature: GYAE6OF01DT8WZ.46.67.G01.1.454.CMB.1.raw
  modified_base (193)..(193): a, c, t, g, unknown or other
  misc_feature (193)..(193): n is a, c, g, or t
  modified_base (230)..(230): a, c, t, g, unknown or other
  misc_feature (230)..(230): n is a, c, g, or t
  modified_base (319)..(319): a, c, t, g, unknown or other
  misc_feature (319)..(319): n is a, c, g, or t
  modified_base (368)..(368): a, c, t, g, unknown or other
  misc_feature (368)..(368): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccggtgganacagtgtcaccatcacttgccgggacaagtcggaacnttgactacctatttaatgtatacaacataacgaccgagggaccggaccctaagtcctacctaagtctatcgtctgctatccgtagtttnacaaggtcgggtccagtcgagtcagtcgagagtgatcgtagggacagtnttcacgtcacaccgatacgtatatcgtagacgtaacgtagtaagttatttacgaacttaactttacttacgtacgtactaaactagttaactttaactagtttacggtttaccgaccgtaaaggacgtaccgtaaacctaacttaaacgtaaacgtacgttagcggtactagtacctaccgtatccttcgttactttcctacgttcccttaccgtacctactcgtacgtaac

SEQ ID NO: 139264 - DNA, 938 bp, Homo sapiens
  misc_feature: GYAE6OF01EQ0NK.46.67.G01.1.454.CMB.1.raw
  modified_base (191)..(191): a, c, t, g, unknown or other
  misc_feature (191)..(191): n is a, c, g, or t
  modified_base (930)..(930): a, c, t, g, unknown or other
  misc_feature (930)..(930): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaacggtggganacagtcgtaccacctatccacgttcggacccggggactaacggtaccggaaactagttacgaaccttaccgtttaaaattttaaaacgttcgggttaacttaaccgaaaactaacgttaacgggaaacccggtaacggggggtaaaccccggtaccccctaaaggtacccctttaacccggttaaaacttaccgtttaacgtacgtaccgtacgtaaccgtaaccgttacccgttaaggttttaaccggaaccggttaaaaaacgggggttccggggggttaaccccctaacggtttaaccggggttaaccgggtttaaccgtaacgggttaccggggaccgttaagggttacgggtaacgttccgggtaagggggaaccttaacgggttaacttttacccgaacccttaccgttacccaaaccgtaagttaacgtaaacggtttaactccgtacggtaaccgtaaaggtttacggtaaacgttttaacgttttacggtaacctttaaaacgttttacgtttaaccgttacgtaaacaaaacgttaacggttaaatttaaccgttaagtttcggggtttaaccgaacggtaaacgggtaactaaaccggttaacctaaaacgttaaaacgttaaaccgttacgtacgggttacggtaccttaacgacctaaaccgttagttaccgttgtttaaccttacctaaccctttccccggttaccccgtagttacttaccggtnttaaaccg

SEQ ID NO: 139265 - DNA, 689 bp, Homo sapiens
  misc_feature: GYAE6OF01EW4GI.46.67.G01.1.454.CMB.1.raw
  modified_base (214)..(214): a, c, t, g, unknown or other
  misc_feature (214)..(214): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggtccttcggagaccctgtccctcgacctgcgctgtctctggtcncctccatcagtagtggtttctcgtggggctgggtccgcagtctcccgaggggacgggctaggaatacgagttaggaagtgtctctacagtaggtggtaggttcctaattacgagttcccgtctctacgaagtacgtcgagtcaacctagtactctacgtaggactaccgtacagtacaatacttagtttcccagaaagtactggtacgtttacgtcgtacgacccgcgtctacggaaccgtacggggtcgttttaacttacgtgggtacgtaccggtaaggtacggtaaccggttattaacgtttaagttgggtttaacgtttttaggggtaagtttacggtttaacgttttcgaacccttaaccgtagtacggtaccgggaccggggtcctacccgggtacccggtagggaccggtagggaaccttagtcggtaccctaccgttacccgggttaccttaacgcccctaacccgg

SEQ ID NO: 139266 - DNA, 579 bp, Homo sapiens
  misc_feature: GYAE6OF01AXCQQ.46.67.G01.1.454.CMB.1.raw
  modified_base (207)..(207): a, c, t, g, unknown or other
  misc_feature (207)..(207): n is a, c, g, or t
  modified_base (318)..(318): a, c, t, g, unknown or other
  misc_feature (318)..(318): n is a, c, g, or t
  modified_base (391)..(391): a, c, t, g, unknown or other
  misc_feature (391)..(391): n is a, c, g, or t
  modified_base (399)..(399): a, c, t, g, unknown or other
  misc_feature (399)..(399): n is a, c, g, or t
  modified_base (410)..(410): a, c, t, g, unknown or other
  misc_feature (410)..(410): n is a, c, g, or t
  modified_base (430)..(430): a, c, t, g, unknown or other
  misc_feature (430)..(430): n is a, c, g, or t
  modified_base (533)..(533): a, c, t, g, unknown or other
  misc_feature (533)..(533): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtgtttctctgggctgggtccgcngctccgagggagggctaggatacagttggaagttgtctctcagtagtggacggttcctattactagtccgtctctacagacgtcgtatcctactatactctcgtcgtaacncgtccagctaatctacttttcccagtaatctgtagttctgtcgaccgcgctggactacgggtactttatctgngcggaagngacgctaattngttgtttagtgttacggttnttaccgactaccgtagtacgtcgggtacgggctcccgcccggtacgggaccgaggtactacggtgtaccctacgtccctactcgccctacgaccgcgtacccngttccgcccttacccgcgaccctaccgtccacccaagtcctacccg

SEQ ID NO: 139267 - DNA, 908 bp, Homo sapiens
  misc_feature: GYAE6OF01C7IY4.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctcctgtctgccaaccggtgggagacagtcgtccaccagtcctacgttcggcccgggacaaggtaccggaactagttacgaacctaacctttaatttttaaacgttggttaacttaccaaacgtaagttaacggaacccgaacggggggtaacccggtacccccttaaaggcccttaacccttaaattacccgttaagttcggtccttaggacctaacgttacccgtaaggttttacggaaccggtaaaaggggttcccgggggttaacccctaagttacccgggtaagggttttacccgaagggttaccggggaccgtaaggggttagggtaacgtttccgggttacgggggtaaaccgttaagggttaacctttttacccgacccgtttccctaacccgtaaccttaacgttaccgttaacgttaactttaccgtacggtaaccgtaaaccgggttagtaaacggttttacttttacggtaaaccttaaacgttttacgttaaccgttacgttaacctaaacgtaagtttaaaccttaactttaagggttttccgggttttaaccgggaacccgtaaacggggtaaccctaaccgttaaaccttaaactaaaacggttaaccgtaaccgttaggttaccgggaccttacggaccctaaccctagtttcccgttacgttacccgtttacttacccgttccccgtttaccccgacttaacgttccgtaagttaacccg

SEQ ID NO: 139268 - DNA, 716 bp, Homo sapiens
  misc_feature: GYAE6OF01CRFI9.46.67.G01.1.454.CMB.1.raw
  modified_base (98)..(98): a, c, t, g, unknown or other
  misc_feature (98)..(98): n is a, c, g, or t
  modified_base (109)..(109): a, c, t, g, unknown or other
  misc_feature (109)..(109): n is a, c, g, or t
  modified_base (161)..(161): a, c, t, g, unknown or other
  misc_feature (161)..(161): n is a, c, g, or t
  modified_base (175)..(175): a, c, t, g, unknown or other
  misc_feature (175)..(175): n is a, c, g, or t
  modified_base (259)..(259): a, c, t, g, unknown or other
  misc_feature (259)..(259): n is a, c, g, or t
  modified_base (664)..(664): a, c, t, g, unknown or other
  misc_feature (664)..(664): n is a, c, g, or t
  modified_base (696)..(696): a, c, t, g, unknown or other
  misc_feature (696)..(696): n is a, c, g, or t
tcagactagcagtacacgaccggtgctcgatttagagtatacatattgggtttgtcctcctgctggtggcagctcccagatgggtcctgtccctggtncaactgcaggngtcgggcccagactgggtgaggccttcggacgaccctgtcccctcacctgcnctgtctcgtggtcncctcatcagtagtgtttctcgtgggctcgggtccgcagctaccgaggggagggctaggaatacagttaggagttcgtctcgtanagtacggtaggtacggtttccttaattaaccgacggttcccttacttacgtaccgtaaaaggacggtttccgaacgtttacccaaaccctaatttaacttccttacgtacgggaaaccctaccgttaccgaacgtacctaaaacttacttaccggtttttccccgaagaaacggtaattggttaacgttcgttagggtaccggacccgtccggtactaggtaaccgtacggggtttacgttttaactacgtggtacgaggaagtaacggtacggtacttaagttagttgtttaggttttaggagttagtttactttaccggaacctaccgtagacgtccgggacgggtcctacccggaccgtcgggaccgtaaggtactacggtcgaccgtcgtccttaccgtcncctacgaacgacgcctacgtccgcccttcccngtcccacctcacgagcgacc

SEQ ID NO: 139269 - DNA, 642 bp, Homo sapiens
  misc_feature: GYAE6OF01CF6JQ.46.67.G01.1.454.CMB.1.raw
  modified_base (289)..(289): a, c, t, g, unknown or other
  misc_feature (289)..(289): n is a, c, g, or t
  modified_base (462)..(462): a, c, t, g, unknown or other
  misc_feature (462)..(462): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtctccatcctcctgtctgcaaccgtgggagacagtgtcaccatcacttggccgggacaagtcggaacattgacactatttaaatgtatcaacatagacagggaccgacccaagctacctaatcttangctcgactataccctagtttgacgtaaaggtcgggtacccagtcgtaggttcaggtggactaggtaggatcgtagggactaacgtactttcacctctacaaccctataccgtaagttaacgtcttagaccgtaaagtagtaaagttaattttcgactaaactttattaacgtntaacaactaacgtaaattaacgtaaattcggtttaccgacgtaacgggaactaaccgaacttaaactaaaagttaaacgacgttagtacggtctaacgaccgtacctaatccgttacgtttaccttacctaaccgtttcccgttaaccccgtaccctaaacgttccgttaacgttaaacg

SEQ ID NO: 139270 - DNA, 633 bp, Homo sapiens
  misc_feature: GYAE6OF01EHV5W.46.67.G01.1.454.CMB.1.raw
  modified_base (432)..(432): a, c, t, g, unknown or other
  misc_feature (432)..(432): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaaattggtatcaacatagaccagggacgccctaagctcctaatctatgctgcatccagtttgacaaaggtggggtcccatcgaggttcaggtgcagtggatcgtaggacagtatttcactctcaccatcaagttaactcgtagacgaacgtacggtaaataagttttcgacttaaacgtttattaacgttntaacaaacgtaagtaaactttaactaagtttacggttttaccggaaccggtaaacgggtaccaaaccggtaaacttaaaaccgttaaaagttaaaaccggtaacgttggttacgggtacctaggaacccgtaaaccgtattacgttcgttacccttacttacttccccgttaccccgaccttacgttccgtaacgtaaccg

SEQ ID NO: 139271 - DNA, 900 bp, Homo sapiens
  misc_feature: GYAE6OF01AVA9C.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtccgggcccacgactggtgaggccttcgggacgacccctgtccctcacctgcgctgtctcgtggtcgccctcatctagttaggttcggttttctcggtggggtcgtcggggtcccggcacgccgtacccggaagggggaacgggtctaggaacttacgtagttggtaagtcgttcctactactaagttacggtggtacggtttaccttaagtttaaccgtacggttcccgttcttcgtacgtaaggtacggtaccggtaacgtacccacccttaattaccttccgtacgtacggtacccgtaccggtacctaagtacctaattacccgtttacgtttttaccccgagtaaacgtacttaggttacgttccgtaacggttcccggaacccggtcccgtaccggttaccggtaaccggtaccggggttttaaccgttttaacgttacggttccggtagggtaaccgggtacgggtaacggtacccggttaatttaggtttaacttagggttttaacgttttaggggacgtttttaggtttaacgtttacccgaacccgtaccgtttagggaaccgttcgggtacccggggtaccgttcccggtaacccgggtacggggtaccgtaagggtaaccgttcgtaccgggttaccctacccgttccgttacccgtaccgtccccgtaacccgaaacccgggtccgttacccgtacccggttcccggtacccccctttccccgggaccgttccccctaacccccgtccggtaaccccgtaaggtcccctaccccggg

SEQ ID NO: 139272 - DNA, 695 bp, Homo sapiens
  misc_feature: GYAE6OF01DNF66.46.67.G01.1.454.CMB.1.raw
tcagactagcagtacacgaccggtgctcgatttagagtatacatattggggtttggggagtctcggtcaggacacagcatggacatgagggtccccgctcagctccgtggggctcctgctactctggctcggaggtgccagatgtgacatcgagctcgacccagtcctcatccctcctgtctcgacaccggtggatacagtgtccacatcacgttcggccggataaggtcgaactattcgacctactttaattaaagttgtactacaacgtagtacgaccgaacggggaccgtaccctaagccttacctaactcttagcgtactcgctacttccgtaggtttacgaaccgtaaggtcccgggtacctaaggttccggtagttcgaggtcggagtaggtgacgtcggtaggaactgttaacttccgaacctccgtaacaccgtattacgaacgttatacccttaggaaccttaaacggtaagttaggttaaattttcgtaaacttaacgtttactacgtactaataacgtaaactagtttacgtaagtttccggtaacggtaaccaacgggtaacctaacgttaaaccgaaaacgtttaaaacgttaccgaacggttggaaccgtcgtaaccgtaacgacgtttcttaccggttctttacctacctcttacccttcgaacccttaggtctagtaac

SEQ ID NO: 139273 - DNA, 733 bp, Homo sapiens
  misc_feature: GYAE6OF01D831C.46.67.G01.1.454.CMB.1.raw
  modified_base (251)..(251): a, c, t, g, unknown or other
  misc_feature (251)..(251): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagttagttggtttctcgtggggctgggtccgnagctccgaggagggctggaatacagttggaagtgtctctcatagtggaggttctattacagtccgtctctacaagtagtcgagtccaaccgtatacttctcgttagggacctacggtaccaacgactaaacgttaccgttacgtttttacccctaggtaaacgtacgttacgtacgttttccgtagggttccggaaccccggcccggtccgttacggaacccggtaacggggtttaccgtttttaacgtttaccgtggttcggacggtaggtaacggtaccgggtactttaaggtttagttaggtttacgttttttagggtacggtttggttttaacgttttacccggaacctacccgttaaggtacgtaccggggtaccgggggtcgttaccccggtacccgggtggggtacccgtaaggggtaacttacgggtcgtacccgtaccggttcccttacccgttaccgcccgttaacccccgg

SEQ ID NO: 139274 - DNA, 630 bp, Homo sapiens
  misc_feature: GYAE6OF01EWPRP.46.67.G01.1.454.CMB.1.raw
  modified_base (201)..(201): a, c, t, g, unknown or other
  misc_feature (201)..(201): n is a, c, g, or t
tcagactagcagtacacgaccggtgctcgatttagagtatacatattgggtttggggaggtctcggtcaggacacagcatggacatgacgggtccccgctcagctcctggggctcctgctactctggctccgagtgccagatgtgacatcgagctcgacccagtcctccactccctccctgtctagaccgaaccggtgganacagtcgtaccaccatcacgttcggaccgggacaacggtacggaactagttcgactaacctttaagtttaaattcggtatacgaactagtaacgaccgagggtacccgaccctaagcctacctaatctatcgtactgacctactaccgttaggttacgacgtaaggtttcgggaccctagtcgtagtcgagtcgacgagtcgactcgtaggactacgtactttcacctacgtacacctatcgtaagtactcgtagactaacgtataagttattacgacttaacttacgttactacgtactaaagtaacttacttaacgtagtttacgttacgaacgtaacgactaacgtaataaacgtaacttaacgctaggtcgtactagacctagtatacctgttctactccgttccgtaccacgtatcgtcgtaac

SEQ ID NO: 139275 - DNA, 491 bp, Homo sapiens
  misc_feature: GYAE6OF01BJ64F.46.67.G01.1.454.CMB.1.raw
  modified_base (484)..(484): a, c, t, g, unknown or other
  misc_feature (484)..(484): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccaggacggccctaagctcctaatctatgctgcatccagttttgcaaagtggggtcccatcgaggttcagtggcagtggatctgggacagatttcactctcacatcagtatctgcaacgtgaagattttgcaacttatactgtcaacagaattacaatgttttcggacaagggacacgactacaaattaacgaactgtgctgcacatctgtcttcatctccgcntctgtac

SEQ ID NO: 139276 - DNA, 654 bp, Homo sapiens
  misc_feature: GYAE6OF01B3V6T.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgccaaccgtgggagacagtgtcaccatcacttgccgggcaagtcggaactattgacacctatttaaattggtatcaacatagacaggacgaccctaagctcctaatctatgctgcatccagtttgacgtaaaggttcggggtacccagtcggtaggtttcgaggtggcgaggttggagtcgtagggactagtatttcacttctcaccatacctaagtaatctagacctaagtgtaaattattttacgacttaaactttactttacgttgttaaccaaataagttaaacgttaactaggtttacgttttacccgggaactaaacgggtacctaaaccgtaaaccttaaacgtaaaacgtttaaaccgtaacgttacggtaacggtaccgttacggacctaacccgtaatttccgttacgttccgttacccgtaactttccccgttacccccgtactaccgttactttacggtaacc

SEQ ID NO: 139277 - DNA, 592 bp, Homo sapiens
  misc_feature: GYAE6OF01CXIA3.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactgggtgaggccttcggagaccctgtccctcacctgcgctgtctctggtgcctccatcagtagtggtttctcgtggggctgggtccgcagctccgaggggaagggctggaatacagttggaagttgtctctcagtagtggaggttcctattacagtccgtctctcaagagtcgagtcaccatatctctgacacgtcagcaatcagttttccctagaacgatgtagttctgtcgaccgcgctgacgtcgggtctttattaccgtgtgtcgaagacgacggtcttagttatgtagtttttggagttggttattcgactacctagatcggcggggtactccgacccgtgggaccgagggtatacgtcggtacctaccgtctccgttacgcctcccgaaccgacgggtcccctaagttcccggtcccgtttcccccgcggtcccctacccctccctacccaacgcgtaaccccg

SEQ ID NO: 139278 - DNA, 735 bp, Homo sapiens
  misc_feature: GYAE6OF01EZOF1.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatccctccctgtctgccaaccggtgggagacagtgtccaccatcctacgttcggccgggacaaggtccggaaactattacggaacctaacctttaagttttaaaagttggttaactacaaactaagtaacggaaccgacggggaccgacccgtaagtcctacctaatctagtgctgactactccgtagtttcgacgtaaaggttcggggtaccctagtcggtaggttcgaggtggcgtagtggatcgaggactagtacttcactctacacctataacgtaagttaactcgtacgaactaacgttaggtaaagtttactttacgacttaactttacttacgtagtaacaaacgtaagttaaattacgtaagtttcggtttaccggaaccgtaacggtaccgtaacggtaaaccttaaacgttaaaacgttaaaccggtacgttacggtacggttaccgtaacgtaacccgtaacctttacgttacggtttccgtttaacccgtttaccctaacccgttttaccccgttaccccccgggttaattaaccggttccgttaacggtaacccg

SEQ ID NO: 139279 - DNA, 960 bp, Homo sapiens
  misc_feature: GYAE6OF01DXTSR.46.67.G01.1.454.CMB.1.raw
  modified_base (174)..(174): a, c, t, g, unknown or other
  misc_feature (174)..(174): n is a, c, g, or t
tcagactagcagtacacgaccggtgctcgatttagagtatacatattgggtttgtcctcctgctggtggcagctcccagatgggtcctgtccctggtgcaactgcaggacgtcgggcccacgactggtgaggccttcggacgaccctgtccctcacctgcgctgtctctggtcncctcatcagttagttggtttcttcgtgggctcgggtccgcagccgtaccggaaggggaagggctaggaatacgagttggaagttcgtctcgtactagttaggtggtacggtttccttaagttaccgtacggttcccgttctaccgtacgaagtcggtaccggtactaccaacctattaacgttcctacgtacgggaccgtaaccggtccgaacgtacctaaacgttccgtttaccgtttttaccccgaaggtaacggtacttacggttacggtttacgttacggtacccggtaacccggtcccgggtacgttaaccggtaaccggggtttacccggggtttaacggttttttaaccgttaccggtttacggttaccgggaacgggtaacgggtaacgggtaccggttaaccgttttaaagttttacggtttaaggtttttaaggttttgggttaacgggttttacggttttaaccgttacccgtaaacccgtaccgtttaacggtaccggttcccgggggaaccggggttccccgtacccgggtaaccccgggttaccgggggtaaccggtaacgggtaaaccgtttaccgggtcggttaacccccgttcccggtttaacccggttccccgttaacccggcccccgtaaaccccggtaaccgggtaaaccccgggtacccccttacggggttttccccccgttacccccgtttcccccggtaacccggttacccccctaccccttaaccccggtaacccgtaaaccggtcccgttaacccccgggg

SEQ ID NO: 139280 - DNA, 1128 bp, Homo sapiens
  misc_feature: GYAE6OF01BWWRS.46.67.G01.1.454.CMB.1.raw
  modified_base (99)..(99): a, c, t, g, unknown or other
  misc_feature (99)..(99): n is a, c, g, or t
  modified_base (210)..(210): a, c, t, g, unknown or other
  misc_feature (210)..(210): n is a, c, g, or t
  modified_base (236)..(236): a, c, t, g, unknown or other
  misc_feature (236)..(236): n is a, c, g, or t
tcagactagcagtacacgaccggtgctcgatttagagtatacatagttgggtttgtcctcctgctggtggcagctcccagatgggtcctgtccctggtncaactgcaggagtcggcccacgactggtgaggccttcggagaccctgttccctcacctgcgtctgtctcgtggtgcctcatcagtagttgtttctcgtgggctgggtccgnagctccgagggacgggctggaatacnttggatgtctctcagttagtggacggtttcctaagttacacgttcccgtactcgtacgaaaggtcggttccggacgttacccaacccgtacgttaacgttccggttaccggttacgggaacccgtaaccggtttccccgaacggtacctttaaaaacgtttccgttttaaaccgggttttttttcccccgaaagggttaaaacggttaagtttacggttaaacggtttttcccggttacggggttacccggtaacccccgggtccccggttacccggtttacggggtaaaccccggtaaccgggggggtttttaccctttttttaaacgtttaaaccgggtttcgggttaccgggaaccgggtaaacgggtaaccggggttaaacccggggttaacctttttaaagttttaaccggtttaacggtttttaaccgggttttttttaaggggttaaccgggttttttacgggttttttaaacccgttttaaccgggtaaaccccgttaaaccccgtttacgggttaacccgggtttacccgggggttaacccgggggggttaccctttaacccccggggtaaccccccggggtttacgggggggaacccccggttaaaacgggggttaaaccgttttaaccggggttacccgggtttaacccgtttacccccgggtttaacccgtttcccccgggttaaaaccggttccccccggtaacccccggttaaaacccccgggaaaccccgggggtttaacccccttacccggggttttccccccggtttaccccccgtttaaccccccccgggtttcgggttacccccccgtacccccccggttttaccccccggaaaccccggttaaaaccgggtcccccggttaacccccccggg

SEQ ID NO: 139281 - DNA, 680 bp, Homo sapiens
  misc_feature: GYAE6OF01D0O1T.46.67.G01.1.454.CMB.1.raw
  modified_base (147)..(147): a, c, t, g, unknown or other
  misc_feature (147)..(147): n is a, c, g, or t
  modified_base (203)..(203): a, c, t, g, unknown or other
  misc_feature (203)..(203): n is a, c, g, or t
tcagactagcagtacacgaccggtgctcgatttagagtatacatattgggtttggggagtctcggtcaggacacagcatggacatggacgggtccccgctcagctccgtggggctcctgctactctggctccggaggtgccagatgngacatcgagctgacccagtcctccatcccgtccctgtcctgaccaaccggtggganactagtcgtaccacctatccacgttggacccgggactaaaggtccggtaaatgttacgacctaacctttaaattttaaacgttggtaactacgaactataacgaccgacgggaccggccctaagcctaccgtaatctaagtgactgactactcctagtttcgacgtaaacggtcgggtcccagtccggtaggttacaggtcggctaggtgacttcgggtacggaactacgtactttacgactaccgttacacccgtatactaagttacgtctacgacgtaagtagttaaatacgttttcgaacttaagttacttaaccggttaaacctaagtaataactttaactagtttcgttaacggaccgaaggacctaacgaaccttaacgtaaacgtaacgtaacgtggtacctacgtacgacttaaccgattccgttcgttaccttaactccttacccgtcccaacttagtcctactacgg

SEQ ID NO: 139282 - DNA, 720 bp, Homo sapiens
  misc_feature: GYAE6OF01COI9Y.46.67.G01.1.454.CMB.1.raw
  modified_base (214)..(214): a, c, t, g, unknown or other
  misc_feature (214)..(214): n is a, c, g, or t
  modified_base (255)..(255): a, c, t, g, unknown or other
  misc_feature (255)..(255): n is a, c, g, or t
  modified_base (653)..(653): a, c, t, g, unknown or other
  misc_feature (653)..(653): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgactggtgaggccttcggagaccctgtcccctcacctgcgctgtctgtggtcncctccatcagttagtggtttctcgtggggcctagggtccgnagtcctccgagggagggctaggaactacagttagggaagtgtaccgtctacgataggtgggtaacggttcctattacgacgtcccgtctctacgaagagtcgacgtacaacctattatcctacgtacggaaccaccgtaccaaggactaaacttccgttaacgtttttcccgaagtaaacgtatacggtaagtttcctaggtccgaacccggtccgtaaccgtacggtaccgggtacggggtttaccttttaagtttaccgtagggttaccggaggagtaacggtacggtaccttaagtttacgttaggtttagtttttagggagtttggtttaactttcgtaaccgtacccgttagggtacgtccggggtaccgggtccgtacccggtaacccgggnggggtaacccgagggtaaactacgtacggtcccgttaacccgtcgtttcccgccgtccctaaccccg

SEQ ID NO: 139283 - DNA, 729 bp, Homo sapiens
  misc_feature: GYAE6OF01D5Z6A.46.67.G01.1.454.CMB.1.raw
  modified_base (171)..(171): a, c, t, g, unknown or other
  misc_feature (171)..(171): n is a, c, g, or t
  modified_base (207)..(207): a, c, t, g, unknown or other
  misc_feature (207)..(207): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtncctcatcagtagtggtttctcgtgggctgggtccgnagctccgagggagggctggaatacagttggaagtgtctctcagtagtggaggttcctattacagtccgtctctcaagagtcgagtcaccatatctcgtggacacgtccagacaatctacgttttcccagtaagagtgtagtttctggtacgaccggccgtctacggacgtacggggtcgttttaagttaccgtggttggaccggtaaggtacgacgggtacttaatttagttagttagtttttggagtttaggtttactttacgacctaccctagagttccgggaccggggtcctaccggaccccggttaggggacccgtaaggggtaaccttacggttcggtacccgtacccggttccttacccgttacggtaccccttacccggtaaaccccggtaaaccggggtaccccccgttaacggtttccccggttccccccgtttacccccccggtacgggtaccccccttaaccccccgttacccccgttaccccgtaaaacgggtcccgtaaaccccccggg

SEQ ID NO: 139284 - DNA, 731 bp, Homo sapiens
  misc_feature: GYAE6OF01DBUWB.46.67.G01.1.454.CMB.1.raw
tcagactagcagtacacgaccggtgctcgatttagagtatacatattgggtttggggagtctcggtcaggacacagcatggacatgagggtccccgctcagctccgtggggctcctgctactctggctccgaggtcgccagatgtgacatcgagctcgacccagtcctccactccctccctgtctcgaccgaaccggtggacacgtagtcgtccacctatcgacgttcgggccggactaaggtaccggaactacgttacgaacctacctttaattttaaagttcggtactacgtaaactacgtaacggaacccggtaacggggacccgtacccgtaagtacccttaccgttaataccgttacgtacgtcctacggtaccttaacgttccgttaggttttacggaaccggtaaaacggggttcccgggtaccctacggttacgggtaacggtttcgaacgggttcggtaccgtaggtacggtacgtcggtagggactagttacttacaccgtctactacctagtacgtaagtactccgtagaaccggttagtagttacgttatttacgaactttatttacgtacgtactaaccgtaataacgttaacttaaggtacgtttacgtacggaacgacgtactaacgtaactaactaaacgtacgacgttggctaccagtactccgtattcttccgtccttcgttaccgtccccgtactactacgttgtaacggtc

SEQ ID NO: 139285 - DNA, 629 bp, Homo sapiens
  misc_feature: GYAE6OF01EMYSG.46.67.G01.1.454.CMB.1.raw
  modified_base (208)..(208): a, c, t, g, unknown or other
  misc_feature (208)..(208): n is a, c, g, or t
  modified_base (285)..(285): a, c, t, g, unknown or other
  misc_feature (285)..(285): n is a, c, g, or t
  modified_base (338)..(338): a, c, t, g, unknown or other
  misc_feature (338)..(338): n is a, c, g, or t
tcagactagcagtacacgaccggtgctcgatttagagtatacatattgggtttgtcctcctgctggtggcagctcccagatgggtcctgtccctagtgcaactgcaggagtcgggcccacgactggtgaggccttcggagaccctgtccctcacctgcgctgtctctggtgcctccatcagtagtgtttcttcgtgggctgggtccgnagctccgagggagggctggaatacattggaagtgtctctcagtagtggaggttcctattacagtccgtctctcaagngtcgagtcaccatatctctggacacgtccagcaatctacgttttccagaacgntgacgttctgtcgaccgccgctcggacgtcgggtctttatacgtggtacgacgtagtacgacggtcttagtttagttggttagttttgggaggtttaggtttagtttaccgacctaccgtagtactcgggaccggggtcctaccggaccccggttaggggacccgtagggtaacttacgttcggtaccgtaccggtccttaccgttaccgtcctacccgaacccgtacggccctacgttccggttcccttccccggcgtaccctaccccttcccacctaacggcgtacccg

SEQ ID NO: 139286 - DNA, 918 bp, Homo sapiens
  misc_feature: GYAE6OF01C0D9M.46.67.G01.1.454.CMB.1.raw
  modified_base (174)..(174): a, c, t, g, unknown or other
  misc_feature (174)..(174): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggacgaccctgtccctcacctgcgctgtctcgtggtcncctcatcagtagttgtttctcgtgggctcgggtccgcacgccgtaccgaggggaacgggctaggaaactacgtagttgggaagttcgttcctactcgtaaggttaaggttcgggttaacggttttacccttaagtttaaccgtaacggtttccccggttactaccgtttaaccgaaaacggtacggtttacccggaacggttaccaaaccccgtaatttaacgttcccgttaccgttacggggaacccttaacccgggttacccaacggtaaccctaaaactttacccgttaaccggttttttaaccccccgaaggtaaaaggtaaacgtttcgggttaaacggttttcccttagggttaccggaaccccggtacccggtcgtacggtaacccggtaacccgggggtttacgtttttaaactttaaccgttcgggtacggtacccgggtaaggtaaccgggtaccgggtttaacctttaagtttaacgtttaggttttaagggtttttagggtaaggtttacggttttaacgtttaccgtaacccgttacccgtaagtacggttaccggggtaccgggtacgttacccggtaccccggtacggggtaccgtaagggtactacgttcggtaccgtaccgttcctaccgttaccgaccgttacccgaaccgtaaccgggccctacggttcccggttccccttccccgtcgtcccctacccctaccgtaccgaacgtccgtacccgg

SEQ ID NO: 139287 - DNA, 606 bp, Homo sapiens
  misc_feature: GYAE6OF01A8TGY.46.67.G01.1.454.CMB.1.raw
  modified_base (194)..(194): a, c, t, g, unknown or other
  misc_feature (194)..(194): n is a, c, g, or t
  modified_base (226)..(226): a, c, t, g, unknown or other
  misc_feature (226)..(226): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtctccatcctccctgtctgcaaccggtggganacagtgtcacatcacttgcggcaagtcgaacnttgacactattaaatggtatacaacatagaccgagggaccgccctaagctacctaatctatgctgactactcctagtttcgacgtaaaggtcgggtacccagtacggtaggtttcaggtcggtacgacggtaggtactcgtagggacagtacttcgactcgtcaactatacaagttatctacgactaacgtagtaagttatttacgaacttaacgttattacgtagtaactaaacgtagtaaattactaagttcgtttaaccggacgtaacggactaacgtaaactaacgtaaacgttaacgacgtggtaccgtatacggaacctacgtactcgttctacttactacgttacccttacccgacttacttcgtcgtaaccg

SEQ ID NO: 139288 - DNA, 992 bp, Homo sapiens
  misc_feature: GYAE6OF01CURN0.46.67.G01.1.454.CMB.1.raw
  modified_base (225)..(225): a, c, t, g, unknown or other
  misc_feature (225)..(225): n is a, c, g, or t
  modified_base (262)..(262): a, c, t, g, unknown or other
  misc_feature (262)..(262): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgactgggtgacggccttacggacgacccctgtcccctcacccgtgccgtcttgtctcgtggtcnccctcatctagtgttgtttcttgtgggctgggccggntaggcctccgagggacgggtctggaactacgtagttaggaagttcgtactctactagtaggtgggtacgtttacctagttacgtacgttcccgttctcgtaccgaaagtcgttacgacgtccaacctaagttactccgttagtccggaactacccgttaccgaagtacctaaacgttccgtttaaccggtttttcccgtaaggtaacgttacgttacggttacggtttacccgtttagggtaccccgtaccccgggtaccgttcccgggtaacgggtaaccccggtttaaccggggttttacccgttttttaaacgttaccggtttagggtaacggtacccgggtaaagggtaaacccgggttacccgggttaacttttaaacgggtttttacggtttaacggtttttaaaggggtttttttaccggggggtaacggtttttttaaccgggttttaaccgggtttttaaccccggtaaaccccggttacccggttttaaacgggtacccggggtttaccccggggggggttaaccccggggggtaccccgttttaaccccccgggggttaacccccgggggttacccggggggaaaccccgggttaaaacggggtttaccccgttttaacccgggggttacccgggttttacccccgttaaccccccggggttttccccgttttaacccccggtaaccccgggtttaccccccggttaaaaccccccggg

SEQ ID NO: 139289 - DNA, 790 bp, Homo sapiens
  misc_feature: GYAE6OF01AQH1R.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgactcatcagtagtggtttctcgtggggctcgggtccggcacgctccgaggggaaggggctggaatacgagttggaagtgtctctcataggtagggtacgttcctagttacgagttccgtctactacaagtagtcgagtcgacatactcgtactcggactacgtccagacaatctacgttttcccgtaggaagtacttcggtacgtttcgttacggtacggacccggtccgtctacgggtaaccgtaccggggtttacgtttttaacgttacggttggtcggacggaacgggacgtaccggttcgttttaaagttacgttttaggtttaacggtttttttggggtaacgtttttacggggttttattttaacccggtaaacccgttacccggttaaggttacccgggttacggggggtaacccggggggttcccgtaaccccccggggttaacccggggtacccggggggtaaacgtaaccggggggttaaactttacccggggttaacgggttccccgggttaaccccggttttccccgttaaccgggtttccccgggtacccccgttaaacccccggg

SEQ ID NO: 139290 - DNA, 756 bp, Homo sapiens
  misc_feature: GYAE6OF01DCOK2.46.67.G01.1.454.CMB.1.raw
  modified_base (170)..(170): a, c, t, g, unknown or other
  misc_feature (170)..(170): n is a, c, g, or t
tcagactagcagtacacgaccggtgctcgatttagagtatacatattgggtttgtcctcctgctggtggcagctcccagatgggtcctgtccctggtgcaactgcaggagtcgggcccagactggtgaggccttcggagaccctgtccctcacctgcgctgtctctggtncctccatcagtagtggtttcttcgtggggctgggtccgcagcctccgaggggagggctaggaatcagttggaatgtctacgtctagtaggtggtacggttaccttattaccgtacgttcccgtctactacgaagtagtcgtagtcacctatactctcgtcggaccacgtccagtacctaacttcgtacgttttcccagtaagtacgtgtacgttctggtacggacccggtccgtcgtacggtaccggtacgggtttacgtttaacgtttacgttcggtacggtacgagggtaacggtacggtactttaagtttacgttaggtttacgtttttagggtaaggtttaggttttacttaccgtacctaacccgtagtaccggtcgggtaccgggtccgtaccggtacccgggtacgggaccggtaagggtaacgtaccggttcggttaccgtacccgttaccgttacccgttacccggacccgttacccgaacccggtaaccgggtaccccttacggttcccccggtttaccccttcccccggtcggtaccccctaccccgttacctacccgtaacgaccgtaccccgg

SEQ ID NO: 139291 - DNA, 581 bp, Homo sapiens
  misc_feature: GYAE6OF01BZR9F.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttggccggcaagtcggaacattgacacctatttaaatggtatcaacatagaccagggaccgccctaagctacctaatctatgctgcactcctagtttcgactaaaggttcggggtaccccagtcgaggttcgaggtcggcagtggagtcgtgggactagtatttccactctacacctatacgtagtaatctagactaagtagaatattttcgaacttaactttagttacttgtacaatactaattactaattcggtttacgaacgtaacggaactacgtaactaacttaaactaaacgtaacttggtacggtactacggtacacctaagttctcgtacttacgtacttccctacccgtactacttcgtagtac

SEQ ID NO: 139292 - DNA, 656 bp, Homo sapiens
  misc_feature: GYAE6OF01B7DJB.46.67.G01.1.454.CMB.1.raw
  modified_base (216)..(216): a, c, t, g, unknown or other
  misc_feature (216)..(216): n is a, c, g, or t
tcagactagcagtacacgaccggtgctcgatttagagtatacatattgggtttgggggacctcctgtgcaagaacatgaagcgcctgtggtttgtcctcctgctggtggcagctcccagatgggtcctgtccctggtgcaactgcaggagtccgggcccacgactggtgaggccttcggacgaccctgtccctcacctgcgctcgtctcgtggtcncctcatcaggtagttgtttcttcgtggggctggggtccgcacgccgtaccggaggggacgggctaggaatactagttggaagtcgtctctcataggtggtacgttcctagttacgtacgttccgtctctacgaagtgtcgacgtaccacctatactctcgtaggaccacgtcacgactaatcctacgttttccagtacgatgtacgttgtcgtccgccgccgtcgtacgacggtacgggttacgtttacgttcgtggtacggacgacgtcggtacggtactttaattagttgttttaggtttaggtaggttttcggtttacttaccggacctacctagggtcgtaccggggtccgggtacctacccgggacccgtggggaaccggtacgggtactcgttaccgggtcctaccgttaccgtttcccgtccgccctacccgg

SEQ ID NO: 139293 - DNA, 770 bp, Homo sapiens
  misc_feature: GYAE6OF01BM00C.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtccgggcccacgactggtgaggccttcggacgacccctgtcccctcacctgcgctgtctctggtcgcctccatcagttgttcgtttcttcgtggggcgtcgggtccgcgacgccgtaccggaggggaacgggtcgtaggtaatacgtagttaggaagttcgttctcgtacgtagttaggtggtacgttacctaagttacctacgttcccgtctacgtacgaaggacgtccgtagtaccactatacgtctcgtcgactacgtccaagactaactcttacgtttaccagtacgtatgtacgttcgtagtcgaccgccgtacgtacggtacgtacggttacgtttacgttacgtggtcgacggtagacggtacgtagttagttacgttagtttaggtttaggtaaggtttacgtttacgttaccgtaaccggtacgtaacggtacggtccgggtaccggggtcctacccggggacccggtcggggtaaccggtacgggttaaccgttaccgggttaccggttacccgtacccgttcccgttacccggttaaccgtccccgtaacccgaacccgggtacgtaccccggtacggtttccccggttacccccgttccccgacccggtaccctacccccgttaccgaccgtaaccgaccgtacccgg

SEQ ID NO: 139294 - DNA, 651 bp, Homo sapiens
  misc_feature: GYAE6OF01DTDZX.46.67.G01.1.454.CMB.1.raw
  modified_base (192)..(192): a, c, t, g, unknown or other
  misc_feature (192)..(192): n is a, c, g, or t
  modified_base (492)..(492): a, c, t, g, unknown or other
  misc_feature (492)..(492): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgactaccttatttaatggtatcaacatagaccagggaccgccctaagctactaatctatgctcgctactcctagtttcgacgtaaaggttcggggtaccctagttccgtagggttaccgaggttggcgtaggtcgggtactccggtggggaactagtacttttaccgacttcctaccaacctatacgtaaggttaacttcgtcgaacgtaacgttaagtaaagttattttacgaacttaactttatacgttcgtacctaaanaacgttaaattactaagtttcggtttaaccgaccgtaaagggacctaacgtaacttaaactaaagttaaccgaattacggacgtcacggtacctaacccgtattcgttcgtacctttacaccgtttcccttaccccgtacccttaatccgtagtaaccc

SEQ ID NO: 139295 - DNA, 1023 bp, Homo sapiens
  misc_feature: GYAE6OF01DGSD9.46.67.G01.1.454.CMB.1.raw
  modified_base (180)..(180): a, c, t, g, unknown or other
  misc_feature (180)..(180): n is a, c, g, or t
tcagactagcagtacacgaccggtgctcgatttagagtatacatattgggtttgtcctcctgctggtggcagctcccagatgggtcctgtccctggtgcaactgcgaggagtccgggcccacgactgggtgaggtccttcggacgaccctgtccctcacctgccgtctgtctcgtggtcncctccatcgtagttgttggttttctcggtggggtcgttcggggtccggcacgtccgtacccggaagggggaacggggtctagggaatacgtagttgggaagttcgttcctactctagtaggtggtacgttacctagttacgacgttccgtctactacgaagtcgtcgagtaccaccgtattactccgtacgacggacctaccgtaccagtacctaagttcgtttaccgttttacccgaaggtaaagtacgttcggttaactttccggttacgggacccggtaccccggtacccggtacgttaccgggtaacccgggttacccggggtttttacttttttaaacgtacggttcgggttacgggacggtaacggtaaccgggtacggtaaccgtttaaggtttacgtttagggttttaaggttttttaaggggtacggtttttaacgggttttaacccttttcccgggaaaaccccgtttaaccccgggttaagggttaacccgggtttaccccggggggtaacccgggggttccccgtttaacccccgggggtaacccccggggttacgggggggtaacccggttaaaccgggggttaaccgtttacccgggtttaccgggtaacccccgtttacccgtttacccgtttaccccggtttaaccggtacccccccgttaaacccggaaacccccggggttaaacccggggttacccccgtttaaccggggtttcccccccgggtttacccccctttaccccccgggaacccgggttacccccccttaaccccccggttaccccggtaaccccggtaaacccggtcccgggttaaacccccccggg

SEQ ID NO: 139296 - DNA, 702 bp, Homo sapiens
  misc_feature: GYAE6OF01CETNN.46.67.G01.1.454.CMB.1.raw
  modified_base (295)..(295): a, c, t, g, unknown or other
  misc_feature (295)..(295): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagttggtttcttcgtggggctgggtccggcagcctcccgaggggaggggctggaatacagttggaagttgtctctctagtaggtggtaggttcctattacagtccgtctctanaagagtcgagtcaaccatactctcgtaggaccaccgtccagactaactccgtacgttttcccaggtaacgtagttggtaacgtttcgtgtacggaccccgcggtctaggaacccgtaccggggttactttttaacttacgtgggtcgtacggaggtacggaccggttacgttaatttagttacggttagttttttagggaggttttaggtttactttccgaacctacccgttaagtacgtacggggaccggggtccttacccgggtacccggtcgggggaccgaagggtactacgttcggtaccgtccgttactacccgttcgcccctaccgaacccgtaaccgggtccctacggttcccggttcccttccccgtcgccctaccctacctaccgaacgccgtacccg

SEQ ID NO: 139297 - DNA, 667 bp, Homo sapiens
  misc_feature: GYAE6OF01B8GZU.46.67.G01.1.454.CMB.1.raw
  modified_base (192)..(192): a, c, t, g, unknown or other
  misc_feature (192)..(192): n is a, c, g, or t
  modified_base (632)..(632): a, c, t, g, unknown or other
  misc_feature (632)..(632): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccggtggganacagtgtccaccatcacgttcggccgggacaaggtcggaactagttacgaacctaaccttaattttaaaagttggtaactacaactaagtaacgaccgaagggaccgaccctaagcctacctaatctatcgctgctatccgtagtttcgacgtaacggtcgggtaccagtcgtaggttacaggtcgcgaggtcggtatcggtagggactaggtactttaccacttccgtacaacctattaccgtaagttaactctacgactaacggtagtaagttactttacgaactttaaactttacttaacgtctaacgaaacttaagttaaactttaacgttaagtttcggtttaacggaaccgtaagggacctaacgtaaacttaaactaaaacgttacgaacgttcggtacgctacggacctactagttcgttcttaccttaacnccgtttaccctccccgacgttacttcgtaacgtac

SEQ ID NO: 139298 - DNA, 750 bp, Homo sapiens
  misc_feature: GYAE6OF01BUOPK.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactgggtgaggccttcggagaccctgtccctcacctgcgctgtctctggtgcctccatcagtagtggtttctcgtgggctgggtccgcagctccgagggagggctggaatacagttggaagtgtctctcatagtggaggttcctattacagtccgtctctcaagtgtcgagtcaccatatctcgtggacacgtccagcaatcgtagttttcccagaagtatgtagttctgtacgaccgtccgctacgaccgtacggggtacttttaacgttacgtggtacgacggtagtaacggacgggtactttaagtttaagttaggttaagttttttacgggtaaggtttcgggttttaactttaccggaaccttaccccgttaaggtaccggttacccgggtaacggggggtcccttacccgggtacccccggttacgggggaccccgtaacggggtaaccgttacggttaccggtaccgtaaccccggttcccgttacccgtttaccgccccgttaccccgtaacccggtaaacccgggtccccttaacggtccccgggtttccccgtttacccccccgttcgggtacccccttacccccgttacccgtaaccccgtaaacgcccggtaccccg

SEQ ID NO: 139299 - DNA, 704 bp, Homo sapiens
  misc_feature: GYAE6OF01CKHDQ.46.67.G01.1.454.CMB.1.raw
  modified_base (194)..(194): a, c, t, g, unknown or other
  misc_feature (194)..(194): n is a, c, g, or t
  modified_base (357)..(357): a, c, t, g, unknown or other
  misc_feature (357)..(357): n is a, c, g, or t
  modified_base (446)..(446): a, c, t, g, unknown or other
  misc_feature (446)..(446): n is a, c, g, or t
  modified_base (467)..(467): a, c, t, g, unknown or other
  misc_feature (467)..(467): n is a, c, g, or t
tcagactagcagtacacgaccggtgctcgatttagagtatacatattggggtttggggagtctcggtcaggacacagcatggacatgagggtccccgctcagctcctggggctcctgctactctggctccggaggtgccagatgtgacatcgagctgacccagtctccatccctcctgtctgcaacggtggganacagtgtcacatctacgttggccgggacaaggtacggaactattgacctaacttatttaaatggtatacaacatagaccgagggaccgaccctaagctacctaatctatcgctgctacgtcctagtttcgacgtaaaggtcgggtcccagtcggtagttaccngtcggctaggtggactcgtacgggatagttactttcgacttctacacctatactaagtacttcctagtaccgtaacgtagtaaacgttnttttacgaacgttaaactttnttaaccgtacgtaacctaaactaaacgttaattaaacgttaagtttaccggtttaccgggaaaccgtaaaccggggtaacctaaccggttaaaacctttaaaaccgttaaaacgttaaaacccggttacgttaggggttaccgttaccgacgttacccaaaccgttacttaccggttacgtttacccttagttacccctttcccgttacccctacgtacctttcgaggtttaaaccc

SEQ ID NO: 139300 - DNA, 852 bp, Homo sapiens
  misc_feature: GYAE6OF01DGGI5.46.67.G01.1.454.CMB.1.raw
  modified_base (821)..(821): a, c, t, g, unknown or other
  misc_feature (821)..(821): n is a, c, g, or t
  modified_base (831)..(831): a, c, t, g, unknown or other
  misc_feature (831)..(831): n is a, c, g, or t
tcagactagcagtacacgaccggtgctcgatttagagtatacatattgggtttgggggagtctcggtcaggacacagcatggacatgagggtccccgctcagctcctggggctcctgctactcgtggctcggaggtcgaccaggatggtcgacagtcgacgctacgacccacgtcctacctacctcccttcccgttcgtcgtcggaaccgtaaccggggtagggaacgtacgtaggtacgtaccaacctacgtaccgtaccgttcggggaccggacgtaacggtaccggtaactacgttacgacctaactttaaattttaacggttagtaactaacaaacgtacgaaccggaacccggggtaaccgggtaccccgtaacccttaaggttaccccttaaccttaactcttaacgtccgtcgtacgtaccttacgttaaccggtttaggttacggtaaacggtaaacggggtttcccgggtaaccttacggtaccgggtttaacgggtactaggggtccgaaacggttgggtacgttaacggtcggtaacggtacgttaactttccttacccgacttaccgtaccgaactttacgtacgttaagtaccttcgacgtaacggttaacggttaattacgtttacgtacgttaacttacgtttacgtacttaacgaacgtaaactaacgtttaaacttaacgttaccggtttaacgggttacccgaacgggtaacggtaacctaacgtaaacgtttaaacgtaaaccggttaaggtacccgtaggttaccgacgtacaccgttacttcgtacgttactccgttacnccgttacccncctatcgtacgtagtaacccg

SEQ ID NO: 139301 - DNA, 820 bp, Homo sapiens
  misc_feature: GYAE6OF01A7C7R.46.67.G01.1.454.CMB.1.raw
  modified_base (217)..(217): a, c, t, g, unknown or other
  misc_feature (217)..(217): n is a, c, g, or t
  modified_base (244)..(244): a, c, t, g, unknown or other
  misc_feature (244)..(244): n is a, c, g, or t
  modified_base (253)..(253): a, c, t, g, unknown or other
  misc_feature (253)..(253): n is a, c, g, or t
  modified_base (259)..(259): a, c, t, g, unknown or other
  misc_feature (259)..(259): n is a, c, g, or t
  modified_base (282)..(282): a, c, t, g, unknown or other
  misc_feature (282)..(282): n is a, c, g, or t
  modified_base (325)..(325): a, c, t, g, unknown or other
  misc_feature (325)..(325): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactgggtgaggccttcgggagacccctgtccctcacctgcgctgtctctggtcgcctccatcaggttagttggtttctcgtggggctgggtccgnagcctccgagggagggctaggaatacngttggagtntctctnatagtggtacgttcctagttacncgtccgtctctcgaagtgtcgagtccactatatctcgtcgacncgtcagcaatcgtacgttttccagtaacgtattacgtacgttcgtggtccgtacccgtccgtacgtacggaaccggttaccggggttacgttttaacgtaccggtggttaccggtacgggtaacggtacggtacccggttacgtttaagtttacgttaggttttaacggttttttagggtacggttttagggtttaccgttttaacccggaaccgttaacccgttacggtaccgggttacccggggtaaccggggtcccggttacccgggacccgggttacgggggtaccgtaaacggggttaccgttaacgttccgggtacccgttacccggttacccgttacccgtttaccggaccccttaacccggaacccgggttaaccgggtacccgtacccggtttccccggtttaccccccgttaccccccgggtaccggtacccccgttacccccgtacccccgttaacccgtaacccgggtccgttaacccccggg

SEQ ID NO: 139302 - DNA, 759 bp, Homo sapiens
  misc_feature: GYAE6OF01CDAQD.46.67.G01.1.454.CMB.1.raw
  modified_base (175)..(175): a, c, t, g, unknown or other
  misc_feature (175)..(175): n is a, c, g, or t
tcagactagcagtacacgaccggtgctcgatttagagtatacatattgggtttgtcctcctgctggtggcagctccagatgggtcctgtccctggtgcaactgcaggagtcgggcccacgactggtgaggcctttcgggacgaccctgtccctcacctgcgctgtctcgtggtcncctccatcagttagttggtttcttcgtggggctggggtccgcacgctccgaggggagggctaggaatacgagttaggaagttcgtctactctaagttaggtcggtacggttcctaattacgacgttccgtctctacaagtacgtcgtagtccaaccgtatactctcgtacggacctaccgtccagactaactcttacgttttccagaagtatagtacgtttactcggcgacccgcgtctacggacgtacgggtacgtttaacttacgtggtcgacggacgtacggtacggtactttaagttagttggtttaaggtttttaggtaggtttaggttttactttaccggaaccgttacccgttaaggtaaccggtccgggtaaccggggtcccttacccgggaccccggttacggggacccggtaacgggtaacgttaccggttcggttacccgtaccggttacccttccgttaccggtacccctacccgaaccggtaccgggtacccctacggttccccggtttaccccgtcccccgttacggaccccttaccccgtacccgtaacccaaacggcccgtaacccgg

SEQ ID NO: 139303 - DNA, 708 bp, Homo sapiens
  misc_feature: GYAE6OF01CLUGI.46.67.G01.1.454.CMB.1.raw
  modified_base (194)..(194): a, c, t, g, unknown or other
  misc_feature (194)..(194): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgccaaccggtggganacagtgtccaccatcacttggccgggcaagtcggaacattgacacctatttaaattgtattcaacatacgaccagggaccgccctaagctacctaatctatgctgcatccagtttgacgtaagtgggtacccagtcgaggttcagtggctaggtggtatcgtgggactaggtatttcactactaccgacctacgtacctaagttaactctagaccgtaacgttagtaaacggttattttaccgtacttaaaccttttagttaacctttggtaacctaaacgtaaacggttaaactttaactaaaggttttacggtttttaccggaaccggtaaacgggtaccgtaaacccgtaacgttaaaaccgtaaaacgtttaaaaccgaaccgttaacggttacgggaccctttaagggaacccctaccctaacgtttacccgttcggtttacctttacccgttacctttaaccccctttacccccgggtaacccttacgtttcccttacgggttaaacc

SEQ ID NO: 139304 - DNA, 598 bp, Homo sapiens
  misc_feature: GYAE6OF01AXLAY.46.67.G01.1.454.CMB.1.raw
  modified_base (299)..(299): a, c, t, g, unknown or other
  misc_feature (299)..(299): n is a, c, g, or t
  modified_base (405)..(405): a, c, t, g, unknown or other
  misc_feature (405)..(405): n is a, c, g, or t
  modified_base (558)..(558): a, c, t, g, unknown or other
  misc_feature (558)..(558): n is a, c, g, or t
  modified_base (575)..(575): a, c, t, g, unknown or other
  misc_feature (575)..(575): n is a, c, g, or t
  modified_base (581)..(581): a, c, t, g, unknown or other
  misc_feature (581)..(581): n is a, c, g, or t
  modified_base (588)..(588): a, c, t, g, unknown or other
  misc_feature (588)..(588): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtccctcacctgcgctgtctctgtcgcctccatcagtagtggtttctcgtgggctgggtccgcagcctcccgaggggaagggctaggaatacagttagggaagtgtcctctctagtagtggacggtttcctattacagttccgtctctcaagngtcgagtccaccattatctcgtggactacgtccagcatctacgtttccagaacgtatgtacgttctgtacgaccgcgtctacggacgacgggttactttattacgngttacgcggtagacgtacggtacttaattacgttggttacgttttggagtttcggtttattacgacctaccgtagaccgtcggacgggtcctccgacccggtcgggcgaaggtacgtcgtcgtccaccgttctctctcctccaccggcgtccncgttccgtccctcccgngtcccnccctccncagcgtaccg

SEQ ID NO: 139305 - DNA, 741 bp, Homo sapiens
  misc_feature: GYAE6OF01DS9Y5.46.67.G01.1.454.CMB.1.raw
  modified_base (214)..(214): a, c, t, g, unknown or other
  misc_feature (214)..(214): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgactggtgaggccttcggacgaccctgtccctcacctgcgctgtctcgtggtnccctccatcagttagttcggtttcttcggtggggtccgtggggtccggcacgccgtaccggaggggaaggggctaggaatactagttagggaagttcgtctctctagtaggtggtacggttcctatttacacgttcccgtctcgtacagtacgtcgacgtccaacctattacttctcgttacggaaccaccgttaccaacggactaaacttcgtaccgtttttaccccgtaggtaaacggtacttggttacgtttcgttgtacggaccccgccgtcgtacggtaacgtacgggttccgttttaagttacgttggtcggacgtaggtacgtacgggtactttacgtttagttagtttagttttttacgggtaaggttttcggtttacgttttcgtaaccttaccgtaggttaccggtacggggacccggggtccgttacccggtaccccgggtacggggaccggtaacgggtaacttacggttccggtccgtaacccgttccgttcccttacggtccccgtaacccgg

SEQ ID NO: 139306 - DNA, 792 bp, Homo sapiens
  misc_feature: GYAE6OF01CN7E1.46.67.G01.1.454.CMB.1.raw
  modified_base (215)..(215): a, c, t, g, unknown or other
  misc_feature (215)..(215): n is a, c, g, or t
  modified_base (267)..(267): a, c, t, g, unknown or other
  misc_feature (267)..(267): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggccttcgggacgcccctgtccctcacctgcgctgtctcgtggtcgcctcatcagttagttggtttctcgtggggctgggtccgnacgcctccgaggggaacgggctaggaactacgagttgggaagtgtctcgtanagtaggtggtacggttcctattacgacgtccgttctcctacaagtacgtcgagtcacctatactctcgtggacctacgtccagactaatctacgttttcccagaagtatgtagttcgtgtcgaccgccgcgtcggaacgtacgggttctttagttccgtgtcgacgagacggacggtacttaagttacgttagtttaggttttacggtaggtttaggtttaccgtttaccggtaaccgtaacccgttaaggtaccggttaccgggtaccgggggtcccgttacccgggtacccccggtacgggggtacccgaacggggttaacttaccggttaccggttacccgtaccccgttcccgttaccccgttaccggtacccccgtaccccggtaaaccccgggtaacccgggtacccccgttaaccggtttcccccggttacccccgtttaccccccggttcccgggtaacccccccttacccccgttacccccgtaaacccgtaaccgggtaccccggtaacccccgg

SEQ ID NO: 139307 - DNA, 721 bp, Homo sapiens
  misc_feature: GYAE6OF01C65G4.46.67.G01.1.454.CMB.1.raw
  modified_base (174)..(174): a, c, t, g, unknown or other
  misc_feature (174)..(174): n is a, c, g, or t
  modified_base (626)..(626): a, c, t, g, unknown or other
  misc_feature (626)..(626): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggacgaccctgtccctcacctgcgctgtctcgtggtcncctcatcagtagttgtttctcgtgggctgggtccgcagcctccgaggggagggctaggaatacagttggaagttcgtctctactagtaggtggtacggttccttaatacacgtcccgtctctagaagtagtcgaagtcaacctagtactcctacgtcggaacctacgtcagtactaactcgtacgttttccagaagtagttggtaacgttcgtacggtccggacccgtccgtacgtacggtaaccggtacgggtttactttaagttaccgtggtacggtacgaaggtacggtaccggttatttaagttagttacggttttagttttacgggtagtttacggtttaacgttaccgtaaccgtaccgtaggtacgtccgggacgggtccctaccgggtacccggtggggaccgtaagggtactcggtacgtacctaccgttacctacgttaccncccgttaccgaaccggtaccggtaccttacggttcccgttaccccttccccggaccgtacccctaccccgtactaacccgaggtcccgtaacccg

SEQ ID NO: 139308 - DNA, 618 bp, Homo sapiens
  misc_feature: GYAE6OF01A9OYK.46.67.G01.1.454.CMB.1.raw
  modified_base (228)..(228): a, c, t, g, unknown or other
  misc_feature (228)..(228): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacgttgccgggcaagtcgaacnttgacacttattaaatgtatcaacatagaccagggacggccctaagctacctaatctatgctgcactcctagtttgacaaaggtcggggtacccagtcgaggttcagtggcagtggatcgtggacagtatttcactctcaccatcaagttaatctagacaacgttagaaagttatttacggacttaaacgtttattacgtagtactaaacagttaaacttaactaattcggtttaccggaccgtaagggtaacctaacggtaaacttaaactaaacgttaaacgtaacgtaggtacgggtaccttacggaccctaaccttattccgtttattacccgtttactaccgtttccccgtttaccccgaccttaacttcccgttaggttaaacc

SEQ ID NO: 139309 - DNA, 908 bp, Homo sapiens
  misc_feature: GYAE6OF01ASP6W.46.67.G01.1.454.CMB.1.raw
  modified_base (215)..(215): a, c, t, g, unknown or other
  misc_feature (215)..(215): n is a, c, g, or t
  modified_base (229)..(229): a, c, t, g, unknown or other
  misc_feature (229)..(229): n is a, c, g, or t
tcagactagcagtacacgaccggtgctcgatttagagtatacatattgggtttggggagtctcggtcaggacacagcatggacatgagggtcccgctcagctcctgggctcctgctactctggctccgaggtgccagatcgtgacatcgagctgacccagtctccatcctccctgtctacgcaacccgtgggacacaggtcgtacaccgattacncgttcggcccgggnaaacggttcggaacctagtttcggacctaaccgttagttttaaaagttggtaactactaaacgtaactacggacctaaggggaccggtaccgtaacgtccgtaccttaacgtactaaccgttagaccttcggacctaacgttaccgttaacgtttacggtaacgtaaaaccggttcgggggttacccctaaacggttccggtaaccggtttaccgtaggttaccggggtaaacgtccggttagggtaactcccggttaggggaacgtacggtaactttacgtaccttacctactaccggtaactaccgtaagttaaccttcgtaacggtacctaacgggttacggttaaacgttacgttttaacggaccgtttaaaacctttactttaaaccgttaccgttaaaccgtaaacgttaacgttaaaccggtttaattaaccgggtttaacggtttttaccccggaaccggttaaacggggtaccttaaaccggttaaccgtttaaaacgtaaacccgtttaaacggtaaccggtttaacggttccggtaaacgtttacccggtaaccgttaaaccggttacttttaaacccggtcccggttttaactttaaacccgttaccggttaccccgttttaaaacccccgggtcccttaaacgtttcccgtaaagggttaaacccg

SEQ ID NO: 139310 - DNA, 605 bp, Homo sapiens
  misc_feature: GYAE6OF01D2H6T.46.67.G01.1.454.CMB.1.raw
  modified_base (194)..(194): a, c, t, g, unknown or other
  misc_feature (194)..(194): n is a, c, g, or t
  modified_base (220)..(220): a, c, t, g, unknown or other
  misc_feature (220)..(220): n is a, c, g, or t
  modified_base (230)..(230): a, c, t, g, unknown or other
  misc_feature (230)..(230): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctcctgtctgcgaaccggtggganactagtgtcaccatcacgttgccggnagtcgaactnttgactaccttatttaagtgtatcaacatacgaccgagggaccgccctaagcctacctaatctatgctgcctatcctagttgacgtaaggtcgggtccagtcgtaggttcagtggcgtagtgactcgtgggactagtattcactctacaccagtactagtactctcgatacgtagtaattacgtttacgaacttaacttatttaactcgtaactaagtacttaacgttaactaagtttcggtttacgaaccggtaggaacctacgtaactaaactaaagttaacgtaacgtggtagcctacgacgtacctattaccgttcgttaccttacctaacccgtttccccgttaaccccgatacttaccgtgttaacccg

SEQ ID NO: 139311 - DNA, 757 bp, Homo sapiens
  misc_feature: GYAE6OF01A2CGF.46.67.G01.1.454.CMB.1.raw
  modified_base (296)..(296): a, c, t, g, unknown or other
  misc_feature (296)..(296): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctcatcagtagtggtttctcgtggggctgggtccgcagcctcccgaggggaacgggctaggaatacagttggaagtcgtctctcattagtggaggtttcctagttacagttccgtctctcaagngtcgagtcacatatctctggaccacgtccagcaaatcgtacgtttttcccagtaagagtgtagttcgtgtcgacccgccgtcgtacggaaccgtacggggttaccgttttaacgttacggttcggtacggtaccggaagggtaacggtaccgggtactttaacgtttaagttacggtttaagtttttagggtacgtttaggtttacgttttaccgaaccttacccgtaagtacggtaccgggtacggggtccgtacccggtacccggtacggggtaccggaacggggtaacgttaccggttacggtaccgtacccggttacccgttccgtacccggtacccgttaccccgaaacccgggtaacccgggtacccctaaccggttcccggttacccccgtttcccccggtccggtacccccttacccccgtacccctacccgtaaacggtcccgtaaccccgg

SEQ ID NO: 139312 - DNA, 772 bp, Homo sapiens
  misc_feature: GYAE6OF01BV5A4.46.67.G01.1.454.CMB.1.raw
tcagactagcagtacacgaccggtgctcgatttagagtatacatattgggtttggggagtctcggtcaggacacagcatggacatgagggtccccgctcagctccgtggggctcctgctactctggctccgaggtgccagatgtgacatcgagctcgacccagtctccactccctccctgtctcgaccgaaaccggtgggaacaccaggttcgtccaacctataccaacgttcggacccggggactaaacggtaccggaaactagtttacggaacctaaccttttaattttaaaagtcggttaactacaaacgtagtaacggaccgaacggggacccgtacccgttaaagcccttaccgtaaatccttaatcgtctcgtacacttacctagttgaacgtaacggtcggtaccagtacggtagttacgaggttggacgaggtcggacgtcggtaggaactagtactttcacttctaccgactagtctaagtatcgtacgacgtaacgtagttaagttattacgaacttaaagtttcttaaccgtagtaaccgtaaacgtaagttaacttaacgttaacgtttacggtttaaccggaaccggtaacgggaacctaaccggtaaaccttaaacgttaaaaacgtaaccgtaacgttacggtacggtaaccgttacgtaaccctacgttaacgtttacggttaccgtttaaccgttaccttaacccgttaccccgggttaccctacgttaccgtttaccggtaacggttaaacccg

SEQ ID NO: 139313 - DNA, 821 bp, Homo sapiens
  misc_feature: GYAE6OF01DKNAB.46.67.G01.1.454.CMB.1.raw
  modified_base (181)..(181): a, c, t, g, unknown or other
  misc_feature (181)..(181): n is a, c, g, or t
tcagactagcagtacacgaccggtgctcgatttagagtatacatattgggtttgtcctcctgctggtggcagctcccagatgggtcctgtccctggtgcaactgcaggagtccggcccacgactggtgaggcccttcggacgtacccctcgtcccctcacctgccgctcgtctcgtggtcnccctcatcgtaagttggttgtttcttcggtgggcgttgggccgcacgccgtacccggaaggggaagggctaggaactacgtagttaggaagttcgtctctacgtaagttaggttgggtacgtttaccttaagttaccgtacgttcccgtctacgtacgaaggtacgtcgaacgtaccaacctatacgtctcgtacggacctaacgtccaagactaaacttcgttaacgtttccaggtaaatagttatagttcgtggtaccgcccgtcgctacggtaccgtacggtttaccgtttattacgtggtcgtaggacggtacgtacggtacttagttacgtttaggtttagtttaagggttaacgttttacggtttaacgtttaccgtaaccgttacccgttaaggtaccgggttacccggggaacgggtcccgtacccgggtaaccccgggtacgggtaaccggtaaaccgggttacgttaccggtacggttacccgtacccggttccgttaccccgttaccggtacccttaccccggaaacccgttaccgggtcccctacccgggttccccgttacccccgttaccccggtacccgtacccccgttaccccgtacccgtaacccgaagtcccgtaacccccgg

SEQ ID NO: 139314 - DNA, 656 bp, Homo sapiens
  misc_feature: GYAE6OF01BV7R4.46.67.G01.1.454.CMB.1.raw
  modified_base (171)..(171): a, c, t, g, unknown or other
  misc_feature (171)..(171): n is a, c, g, or t
  modified_base (206)..(206): a, c, t, g, unknown or other
  misc_feature (206)..(206): n is a, c, g, or t
  modified_base (245)..(245): a, c, t, g, unknown or other
  misc_feature (245)..(245): n is a, c, g, or t
  modified_base (330)..(330): a, c, t, g, unknown or other
  misc_feature (330)..(330): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtncctcatcagtagtgtttctcgtgggctgggtccgnagctccgagggaagggctggaatacattggagtgtctcncagtaggtggtaggttcctattacacgtccgtctctcaagagtgagtcaccatatctctggacacgtcagcatctagttttcccngaagatgagttctgtcgacgccgctgacgtacgggtcgtttacttacgttgtcgacggagtaggacggtctaagtttattggttagttttgggtagtttggtttaatttcgtaaccctaccgttagtacgtcgggtaccggggcgtacccggccccggtaggggacccggaacggggttaaacgttaccgttcgggtccgtacccggttccttacccggttacgtccccgtaccccgaaccgtaacccgggtacccctaggttacccggttcccttcccccggttcggtaccctaccccctacccgtacccgaagaccgtaccccg

SEQ ID NO: 139315 - DNA, 794 bp, Homo sapiens
  misc_feature: GYAE6OF01ENDN2.46.67.G01.1.454.CMB.1.raw
  modified_base (98)..(98): a, c, t, g, unknown or other
  misc_feature (98)..(98): n is a, c, g, or t
  modified_base (173)..(173): a, c, t, g, unknown or other
  misc_feature (173)..(173): n is a, c, g, or t
tcagactagcagtacacgaccggtgctcgatttagagtatacatattgggtttgtcctcctgctggtggcagctcccagatgggtcctgtccctggtncaactgcaggagtccggcccacgactggtgaggccttcggacgaccctgtccctcacctgcgctgtctctggtcncctcatcagtgttcgtttctcgtgggcgtgggtccgcacgtcctaccggaggggacgggctaggaactacgtagttaggaagtgtcctctacagttaggtggtacgttctagttacgtacgtccgtctctacgaagcgtacgtagtccactattactctcgtacggtaccaccgtaccagtactaacttcgttaccgttttccgaagtaacgtataggtacgtttcgtacggtaccgacccggtccgtacgtacggtaaccgggtaccgggttacttttacgtaccggtggttacggtacggtaaggtacggtaccggttactttaacgtttagttacggtttaggttttagggtaacggtttacggtttaactttaccggtaacccgtaacccgttaggtaccgggttaccgggtaccggggttccctaacccgggtaccccgggtacggggtaaccgtaacggggttaaccgttccggttacggttaccccgtaccgttacccttacccgttaccgtacccgtacccgaacggttacccgggtcccttaccgggttcccgttacccccgttccccgacccgtaccctaccccgttaccaacccgtacgccgttaccccg

SEQ ID NO: 139316 - DNA, 719 bp, Homo sapiens
  misc_feature: GYAE6OF01EL28N.46.67.G01.1.454.CMB.1.raw
  modified_base (191)..(191): a, c, t, g, unknown or other
  misc_feature (191)..(191): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtggganacagtgtcaccatcacttcggccgggcaagtcggaactattcgactaccttaatttaaagttggtatcaacatacgaccagggaccgaccctaagcctacctaatctatgctgctactcctagtttacgacgtaaggttcgggtccctagtacggtaggttcacggtggacgaggtggtacgtcggtagggtaactaggttactttacgaccttaccgtaccaacctactacgtaagttaactcgttacgacgtaacggttagtaaacgttattttacggaactttaaaccgtttactttaaccgtacgttaacgtaaacgtaacgttaaactttaacgtaaggttttaccggttttaccggaacccggtaaagggtacctaaaccgttaaaccttaaacgtaaaacctttaaacgaaccgttaggttacggtaccttaacgacccgtaaccgttagtttaccgttccgtttacccgttacttaccctttacccgttaccccgaccgtactttaccgtaagttaaccg

SEQ ID NO: 139317 - DNA, 652 bp, Homo sapiens
  misc_feature: GYAE6OF01BOLHP.46.67.G01.1.454.CMB.1.raw
  modified_base (199)..(199): a, c, t, g, unknown or other
  misc_feature (199)..(199): n is a, c, g, or t
  modified_base (279)..(279): a, c, t, g, unknown or other
  misc_feature (279)..(279): n is a, c, g, or t
  modified_base (615)..(615): a, c, t, g, unknown or other
  misc_feature (615)..(615): n is a, c, g, or t
  modified_base (642)..(642): a, c, t, g, unknown or other
  misc_feature (642)..(642): n is a, c, g, or t
tcagactagcagtacacgaccggtgctcgatttagagtatacatattgggtttggggagtctcggtcaggacacagcatggacatgagggtccccgctcagctccgtggggctcctgctactctggcctccggaggtcgccagatgtgacatcgagctgacccagtcctccactccctccctgtctcgcaacggtgganacagtgcaccatcacgttggaccgggtacaaggtaccggaactattacgaacctaaccttaatttaaatggttatacaanatacggaccgtagggaccgaccctagacctcctaatctatcgtactgacctactcgtagtttacgacgtaaagggttcgggccctagtccggtaggttacgaggtacggacgtaggtacggtacgtacggtagggacctagttacttacgtactaccgtaccactatacgtaacgtacttcgtacggtaacgtaacgttaggtaaagtttacgttacgtaactttaacgtttacttacgtagttaaccaagtaacgtattaacgtagtttcgttaacgacgtaacgtacgaacgttaactaacgtaaactaacggagttacagtccagactacgtntacgtgtactcgtacttccgactactnttcgagtacc

SEQ ID NO: 139318 - DNA, 669 bp, Homo sapiens
  misc_feature: GYAE6OF01CSIK9.46.67.G01.1.454.CMB.1.raw
  modified_base (193)..(193): a, c, t, g, unknown or other
  misc_feature (193)..(193): n is a, c, g, or t
  modified_base (400)..(400): a, c, t, g, unknown or other
  misc_feature (400)..(400): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgctaaccggtggganacagtgtcaccatcacgttcggccggtacaagtacggaactattacgacctaccttaattttaaatgtactacaacagtacgaccgagggaccgaccctaagcctactaatctatcgctgactactcctagtttcgaacgtaacgggtccgggtacccagtcggtaggttcgaggtcggacgtaggtgacgtacgtgggaactagtntttaccacttaccacacctatactaagtacctcgtacgtacgtaaagttagtaagtttagtttacgaactttaacctttattaaccgttacgtaacctaaacgtaagttaactttaacgtaggttttacggtttaccggaaccggtaacggtaaccgtaacgtaacttaaaacgtaaacttaacgaacgttcggtacgtacgtaccgaacctccgttacttcgtctttaccttaccgtaccttccctaccgtacctattccgtgtaacc

SEQ ID NO: 139319 - DNA, 892 bp, Homo sapiens
  misc_feature: GYAE6OF01BW4XT.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactgggtgaggccttcggagaccctgtccctcacctgcgctgtctctggtcgcctcatcagtagttgtttcttcgtgggctcgggtccgcacgccgtaccgagggaagggctaggaatacgagttcggaagtgtctctctagtaggtggtagttcctattacgacgtccgttctctacgaagtacgtcgagtccaacctattaacttcctcgtacggaaccgtaccgtcgaacgtctaaattccgttaacgttttcccaaggtaaagtagttcgtaagtttccgtagtaccggacccgtcccgtacgtcggtaaacccggtaccggggtttacgtttttaaacgttccgtagggtttacggaaccggtaagggtaaccggtaaccgggtttactttaaaggtttagttttaggtttttaaacgggttttttggggaaacgtttttacgggttttacgtttaaaccccggtaacccgtaaccccgtttaagggaaccggtttacccgggggaacccgggggttcccttaacccccggggttaaccccggggttacgggggtaacccgtaacggggttaaacttcccgggttacggtaccccgtacccggtttccttaccccggtttaccgaccccgtaaacccggaacccggttaaacccggggacccctaaccgggtttccccggttaccccccgtttcccccccgggtacggtaccccccttacccccgtttaccccgaaaccggtaaacccggtcccgtaaccccccgg

SEQ ID NO: 139320 - DNA, 884 bp, Homo sapiens
  misc_feature: GYAE6OF01B50X4.46.67.G01.1.454.CMB.1.raw
tcagactagcagtacacgaccggtgctcgatttagagtatacatattgggtttgggggacctaccggtgtggcaagaacgagtgaagcacctgtgttgtcctcctgctggtggcaggcctcccagatcgggtccctcgtcccctggtgcaactggcaggaggtccgggcccgaccgacgtggtgacggtccttcggacgaccctcgtcccctcgaccgttcggccgtctggtcctacgtcggtcgccctcctattccgtagttaggttggtttccttccgggtacggggtacttcggggtcccggcgtaggtccgtaacccggaaggggtaacggggtcttacggtaacttacgtaagttaaggtaaacgttccggtacgtaccgtacctaacgtaacggttcgggtaacggtttaccgttaagttaccgtaacggttcccgtacgttacgtaccgaacggtacggttccgggtactaccgaaccctagttaccttacgtccgtacggaacccgttaacccgtacgtaacgtaactaaccgtacccgttaaccgttttcccgtaacggtaaacgttacgtttacggttaacgttttcgtccggttaccggacccggtaccgtacggttaggaaccggttaccgggttacgtttttaccttaccggttagtacggtaccggtaacgtacggtacccgttacttaagtttaggttgttaaccgggtttttaggaacgttttagggtttaaccgttacgttaaccgttaccggtaggtacgggtaccggggaacccggttacccgcccggtacccgggtcgggaaccggtacggtacttaccgggtccgttacgtcccgttacgttccctaccggtccgtaaccccg

SEQ ID NO: 139321 - DNA, 574 bp, Homo sapiens
  misc_feature: GYAE6OF01A5R3U.46.67.G01.1.454.CMB.1.raw
  modified_base (336)..(336): a, c, t, g, unknown or other
  misc_feature (336)..(336): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgaggggaaggggctggaatacattggaagtgtctctcatagtggaggttcctattacagtccgtctctcaagagtcgagtcaccatatctctggacacgtccagcaatcagttttcccngaagatgagttctgtgaccgccgctgacgcgggtcgtttattactgtgcgagagacggctattatgtattttggagttggttattttcgactacccctagacgtcggacggggcctcggaccccgtggggccgagggtaactacgtggtccaccgtctccgttacgccctccaaccgacgggcccagttccggtcccttcccccgtcgggtcccacccctccctccaacgcgtacccg

SEQ ID NO: 139322 - DNA, 861 bp, Homo sapiens
  misc_feature: GYAE6OF01C1EBD.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtctacaccatcacgttcggccgggacaaggtcggaacattcgaccaaccttaatttaaagttggtatacaaacatacgaccgacgggaccggaccctaagcctacctaatctatgctgctactcctagtttacgacgtaaggtcgggtacccagtcggtaggttacaggtcggcgtaggttcgggtactcggtaggggtactaaggttactttcccgacctttaccgtaccctaacccgtaactttaccgtaacggtttaacttaccgttacggtaacccgttaaacgggtttaacggttaaacggttttaacgttttttacggaaacccttttaaaccgtttttaaccgtttaaccgtttaaccggttaaacccgtaaaacgttaaacgtttaaaacgttttaaccgttaaacgggtttttaccgggtttttaacccggggaaacccggttaaacggggtaaacccgttaaacccggtaaacctttaaaaacccgttaaaaaccggtttaaaacccggtaaacggtttaaccgggtaccgggtaacccgttaccgtaaacccgttaaacccgttacgttttacccgtttacggttaccccttttaccgtacccgttttaaccccgttccccgttaacccgttacgttccgttaccgttaaaccg

SEQ ID NO: 139323 - DNA, 661 bp, Homo sapiens
  misc_feature: GYAE6OF01CDD6C.46.67.G01.1.454.CMB.1.raw
  modified_base (208)..(208): a, c, t, g, unknown or other
  misc_feature (208)..(208): n is a, c, g, or t
  modified_base (297)..(297): a, c, t, g, unknown or other
  misc_feature (297)..(297): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtgggctgggtccgnagctcccgaggggaaggggctaggaatacgtagttggaacgtgtactctcaagtagtggaggttcctattacagtccgtctctacaagngtcgagtcaccatatctctggacacgtccagcaatctacgttttcccagaagtatgtagtttctggtcgacccgtccgcgtacgaacgtacgggttacttttaattacgtggtacgacggagacgacggtacttaagtttagtgttagtttttgggagtttaggtttatttaccgaactaccccgtagtacgtccgggaacggggtccctaccggaccccggtggggacccgaaggggtaacttacgtcggttaccacccgttcctccgttacgccctaccgaaccggaccggtccctacgttcccggtacccttccccccgtaggtacccctaccccgtaccctaccgaacgtccgtaccccg

SEQ ID NO: 139324 - DNA, 668 bp, Homo sapiens
  misc_feature: GYAE6OF01B2F6R.46.67.G01.1.454.CMB.1.raw
  modified_base (191)..(191): a, c, t, g, unknown or other
  misc_feature (191)..(191): n is a, c, g, or t
  modified_base (216)..(216): a, c, t, g, unknown or other
  misc_feature (216)..(216): n is a, c, g, or t
  modified_base (229)..(229): a, c, t, g, unknown or other
  misc_feature (229)..(229): n is a, c, g, or t
tcagactagcagtacacgaccggtgctcgatttagagtatacatattgggtttggggagtctcggtcaggacacagcatggacatgaggtccccgctcagctcctggggctcctgctactctggctccgaggtgccagatgtgacatcgagctgacccagtctccatccctcctgtctgcaaccgtggganacagtgccaccatcacttggccggnaaggtcggaactnttgactaccttaatttaaagtggtactacaactatacgaccgagggacccgtaccctaaagcctaccgtaactctatcgctgctactcctagtttgacgtaaaggtcgggtcccagtcgtagttacgagcggcagtggactcgtggactagtacttcactcacacgtatccgaagtaactcgtacgacgtaacgtagtaaagttagttttacgaacttaaacgttttacttaaccgtttaggtaaccctaaaacgtaacgttaaacgtttaactaacgggttttacggttttcccgggaaccgtaaacgggaacccgtaaacgttaaccttaaacgtaaacgttaaacgaacgttggtacggtactacgaccgtacgtacgttcgtccttaccttacctacgttaccccttcccgacccgttattccgtaacgttaccg

SEQ ID NO: 139325 - DNA, 641 bp, Homo sapiens
  misc_feature: GYAE6OF01DQM78.46.67.G01.1.454.CMB.1.raw
  modified_base (217)..(217): a, c, t, g, unknown or other
  misc_feature (217)..(217): n is a, c, g, or t
  modified_base (227)..(227): a, c, t, g, unknown or other
  misc_feature (227)..(227): n is a, c, g, or t
  modified_base (253)..(253): a, c, t, g, unknown or other
  misc_feature (253)..(253): n is a, c, g, or t
  modified_base (299)..(299): a, c, t, g, unknown or other
  misc_feature (299)..(299): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgcacatcacttgccggganaagtcgaacnttgactacttatttaatggtatcaanatacgaccgagggaccggccctaagcctcctaagtcctatgctgcntcctagttcgagtaaggttcgggtaccagtcgaggttcaggtggcaggtgtatgtggactagtcttcacgtctacactatcaatactctagaccgtaagtagtaagttagtttacgaactttaacttattactacgttaacgtaaactaagttaaaccttaacgtaacgttttacggtttaaccggaaccgtaaacgggttaccaacggtaacttaaaacgttaaaacttaaccgtaaacgttgggtaacgtaccgtacgaccgtaaccgtaagtttcgttacgtttacccttacttaccgtttaccctttacccccgattaacgttccgtaagttacccgg

SEQ ID NO: 139326 - DNA, 561 bp, Homo sapiens
  misc_feature: GYAE6OF01D4X85.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttcggccgggcaagtcggaactattgactaccttatttaaattggtatcaacatagaccgagggacgccctaagctactaatctatgctgctatcctagtttgacgaaagtcgggtacccagttcgaggttcaggtggctagtggatcgtgggacagtattcactctacactatcaatatctagcaagtgaaattatttacgactaactttattactactacaataagtaattactaagttgtttacggaccgtaaggacctaacgtaacttaacgtaaattaacgaactaggtcgactgaacctactagttcttcgtcttactacgtcccttacccgacctgtccttgtaac

SEQ ID NO: 139327 - DNA, 626 bp, Homo sapiens
  misc_feature: GYAE6OF01DS0RO.46.67.G01.1.454.CMB.1.raw
  modified_base (255)..(255): a, c, t, g, unknown or other
  misc_feature (255)..(255): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttgccgggcaagtcgaacattgacacctatttaaatggtatacaanatagaccgaagggaccggaccctaagcctctaatctatgctgcactctagtttgactaaaggttcgggtacccagtcgtaggttcaggtggctaggtggatcgtgggacagtacttcactctcacctatacagtaatcctgtactaagtgaagttatttacgacttaactttattaactgtaacaaacgtaagtaaattaacgttaagttacgtttacggaccgtaaacggtaactaaccgtaacttaaacaaaacgtttaaacgtaacgtcggttaggaccgttagaccctaaaccgttattaccgttacgtttacttccccttaaacttcccgtttacccccgaccttaaacgttcctaaggttaaccg

SEQ ID NO: 139328 - DNA, 814 bp, Homo sapiens
  misc_feature: GYAE6OF01CAY4X.46.67.G01.1.454.CMB.1.raw
  modified_base (198)..(198): a, c, t, g, unknown or other
  misc_feature (198)..(198): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccacttccctccctgtctgacaaccggtggganacagtcgtcaccatcacgttcggccgggactaaggtcggaactagttcgaacctaaccttaattttaaaagttggttaatacctaaaccaagttaacgaaccgacggggaccggacccctaagcctacctaatacctatcgtctgactatcctagtttcgactaagggtcgggtaccctagtcgtaggttacgaggtcggcgtaggtacggagttcggtaggggtaacctaaggttacctttcgaaaccgttcctacccgtaacctaacgttaccgtaacggtttaacttaccgtaggtaaccgtaaacggttagtaaagtttacgttttacgtaacctttaaaccgtttaacgtttaaccgttacgttaaccgtaaacgtaacggttaaactttaaccgtttaagttacgggttttacccggaaccggtaaacgggtaaccctaaccggttaaacttaaaccgtaaaacgtttaaaccggtaacggttacgggtttaacggacccgttacgggtaaaccctaaaccgttacgttacccgttacggtttaccctttacccgttaaccgtttccccgtttacccccgaaccgtttacgttcccgttaaggttaaccc

SEQ ID NO: 139329 - DNA, 716 bp, Homo sapiens
  misc_feature: GYAE6OF01E3MMN.46.67.G01.1.454.CMB.1.raw
  modified_base (297)..(297): a, c, t, g, unknown or other
  misc_feature (297)..(297): n is a, c, g, or t
  modified_base (347)..(347): a, c, t, g, unknown or other
  misc_feature (347)..(347): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtgggctgggtccgcagcctccgaggggaaggggctaggaatacgagttggaagtcgtctctcagtagtggtacggttcctattacacgtccgtctctacaagngtcgagtcaccatactctctgacacgtccagcaatctacgtttccagaanatcgagttctgtcgaccgcgctagacgtacgggtacgtttattaccgtgtgacgagacgtacggtacttattagtgtttaagttttggtaggtttacggttttactttaccgtaacctaccgttaacgtacgttacccggggtaccgggggtcccgttacccgggtaccccggttaccgggggacccggtaacgggggtaaacttaccggtaccgggttaccgtacccggttacccgttacccgttaccggtcccctaaccccgaaacccggtaacccgggtacccctaacggttcccggttccccgttacccccgtccggtaccccttacccccgttacccctacccgtaaacggcccgtaaccccgg

SEQ ID NO: 139330 - DNA, 642 bp, Homo sapiens
  misc_feature: GYAE6OF01ER0OX.46.67.G01.1.454.CMB.1.raw
  modified_base (349)..(349): a, c, t, g, unknown or other
  misc_feature (349)..(349): n is a, c, g, or t
  modified_base (437)..(437): a, c, t, g, unknown or other
  misc_feature (437)..(437): n is a, c, g, or t
  modified_base (523)..(523): a, c, t, g, unknown or other
  misc_feature (523)..(523): n is a, c, g, or t
tcagactagcagtacacgaccggtgctcgatttagagtatacatattgggtttggggagtctcggtcaggacacagcatggacatgagggtccccgctcagctccgtggggctcctgctactctggctcggaggtgccagatgtgacatcgagctcgacccagtctccactcctcctgtctgaccgaaccggtgggacacgagtcgtccacctatcgtacgttcgggccgggacaacggttacggaaactgttacgaaccttaacttaagttttaaacgttggtaactaccaaacagtaacgaaccggacggggaacccgtccctaagtccttacctaatctaactgcngtacacgtcgttagttcgaacgtaaggtccggtacctagtcggtaggttcaggtggtactggtgtactcggtgggaacttacgtcttnaacctcactaactctacgtatactcgtacgtacgtagtaggtattgttaacgcttaaacttatactagtaacaataataactttanagtttcgtacggaacgtaacgtaactaactaactaactaaagtaacgagtcgtacggtacacgactacctagttcttactcttacgtaccttcccgtacgtaccttacgtgtactaacg

SEQ ID NO: 139331 - DNA, 705 bp, Homo sapiens
  misc_feature: GYAE6OF01CS3FB.46.67.G01.1.454.CMB.1.raw
  modified_base (194)..(194): a, c, t, g, unknown or other
  misc_feature (194)..(194): n is a, c, g, or t
  modified_base (268)..(268): a, c, t, g, unknown or other
  misc_feature (268)..(268): n is a, c, g, or t
  modified_base (310)..(310): a, c, t, g, unknown or other
  misc_feature (310)..(310): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtctccatcctcctgtctgccaaccggtggganacagtgtccacatcacgttggaccgggacaaggtcgaactattcgaacctacttaatttaagtggtactacaanagtacgaccgacgggaccgtaccctaagcctacctaatctangctgactactccgtagtttacggaacgtaacgggttcgggtaccctaagttccggtaggttcgaggtacggtacgtaggtgtacgttcgtaggggaacctaggttacttccaaccttcgtaccaaccgtatacgttaagtaacttccgtaagtaccgtaaacggttagtaaacgtttacgtttaacgtaaaccttaacgttttaacgttacttacggttaaacaaacgtaagtttaaactttaacgttaacgtttacgggttaacccgaacggtaacgggaacctaacgtaaccttaaaacgttaaaacgtacgtaacgtcggtacggtactacgaaccgtactacgttacgttcttaccttacgtaccttccgtaccctatacttgtacgtacg

SEQ ID NO: 139332 - DNA, 695 bp, Homo sapiens
  misc_feature: GYAE6OF01EUNO9.46.67.G01.1.454.CMB.1.raw
  modified_base (197)..(197): a, c, t, g, unknown or other
  misc_feature (197)..(197): n is a, c, g, or t
  modified_base (330)..(330): a, c, t, g, unknown or other
  misc_feature (330)..(330): n is a, c, g, or t
  modified_base (389)..(389): a, c, t, g, unknown or other
  misc_feature (389)..(389): n is a, c, g, or t
  modified_base (393)..(393): a, c, t, g, unknown or other
  misc_feature (393)..(393): n is a, c, g, or t
tcagactagcagtacacgaccggtgctcgatttagagtatacatattgggtttggggagtctcggtcaggacacagcatggacatgagggtccccgctcagctccgtggggctcctgctactctggctccgaggtgccagatgtgacatcgagctcgacccagtcctccatccctccctgtctgcaaccggtggganacagtcgtaccacctatctacgttcggccgggacaacggtacggaaactattcgaacctaacctttaatttaaagttggtatacaaacataacgaccgacgggaccgaccctaagctacctaatctatcgctnacactcgtaggtttacgacgtaaggtcgggtccagtacgtaggtcgagtgcgtagtggntcgnggactagtcttacactctacacctataccgtaattactctacgactaacgtagtaattaagtttacgaccttaacttagttcgtcgttactaactaacgtaattaaacttaacgttaagtttcgggtttaaccggaaccgtaacgggtaacctaaacggttaaaccctaaaagtttaaaaccgtaaaaccgttaacggttacggtacggtaccgtaccgtaaacctacccttacgttccgttaacccgtttaccgttaccttaaccgttaccccttaccccgtaccgttattccgttaacgg

SEQ ID NO: 139333 - DNA, 804 bp, Homo sapiens
  misc_feature: GYAE6OF01CWNKO.46.67.G01.1.454.CMB.1.raw
  modified_base (198)..(198): a, c, t, g, unknown or other
  misc_feature (198)..(198): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagcctgacccagtctccactcctcctgtctgccgtaaccggtggganacagtcgtccaccatccacgttcggcccggggactaacggtaccggaaactagttacgaacctaacctttaattttaaacgttggttaattaccaaactaagtacgaaccgacggggaaccgtaccctaagccttacctaattctatcggtcctgactacttaccgtaggttttcggaacgtaaacgggttcggggtaccctaagttcgggtacgggtttacgaggttcggtacgtaagggttacgggtacttccgggtacggggtaaaccgttaagtaaccgttttaccacgtttacccaccgtaaccgttaactacgtaacgttaacgttacgtacgaacgtaacgtaggtaaacgtttatttacgaaccttaactttacgttacgttacgtaacctaaagtaacgtaaactttaacgtaagtttcggtttaccggaacggtaaccgggaacctaacggtaaaccttaaacgtaaaacgttaaccgtaaacggttacggtacggtaccgtacggtaacccgtaaccgtacgtttacgtctttaccgttaaccttaccgtttaccccgttacccgtacccttaacgttcccgtaaggttaacccg

SEQ ID NO: 139334 - DNA, 836 bp, Homo sapiens
  misc_feature: GYAE6OF01DMSPI.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttgggggacctcctgtgcaagaacatgaagcacctgtggtttgtcctcctgctggtggcagcctcccagatgggtcctgtccctggtcgcaactgcaggagtccgggcccacgactggtgaggccttcggacgccctgtcccctcacctgcgctgtctcgtggtcnccctaccatcgtaggttacggttggttttccttcggtgggggtccgttgggggttcccggtagcccgtaccccgggaagggggaacggggtcgtaggtaactaacgtagttagggaagttgttcctctagtagttaggtgggttacggtttcccgtaattaccgtacgttcccgttcctacgtacaacggtacgtcgtacgtaccacctattacgtctcgtaggacctaccgtccacgtactaacgttcttaccgttttccgagtaagtattgtacgtttcgtgtccggacccgtcggtcgtaccggacggttaccgggtttacgttttacttaccgttggtaccggtacggacggtaggtaccggttatttactttagtttaggtttaagtttttgggtacggttttagggtttaacctttccggaacccgttacccttagggtaccggttacccggggtccgggggtacccctaccccggggttaccccggggtacgggggtaccccggtaaagggggttaaaccgttacccgggttacggggtttacccccgttacccgggtttacccttccccggtttacccccggtcccccttaacccccgggtaaaccccggg

SEQ ID NO: 139335 - DNA, 969 bp, Homo sapiens
  misc_feature: GYAE6OF01CEEK9.46.67.G01.1.454.CMB.1.raw
tcagactagcagtacacgaccggtgctcgatttagagtatacatattgggtttggggagtctcggtcaggacacagcatggacatggagggtccccgctcagctccgtggggctcctgctactctggctccggaggtgccagatgtgacatcgagctcgacccagtcctccactcccctccctgtctcggacctaaccgggtgggacgacaggtctccaaccatcacgttcgggacccgggactaacggtccggaaactacgtttacgaaccttaaccttttaagtttttaaaagttcggtaactaaccgaaactaagtaacggaaccggaacgggggaaccccgggaccccttaaacggtaccttaacccttaaacttacttaacgtcgtaccgttccgacttaaccgttaccttaacggttttacggaaaccggtaaaacgggttcccgggggttacccctaagggtttacggtaacgggttttaccgaagggttcgggaacgttagggtacgggtagttaccgggtagggggaaacccttaggttaacgtttccctaacccgtttaccctacctaaccgtacttaaccggtaaatttaaccggtcgttaacggaaccggtaaacgggtttaagtaaaacggtttacgtttttaacgaaaccttttaaacctttaacgtttaaccggttacgttaaaccctaaaagggttaactttaaaacccgtttaagttaaccgtttttacggggtttaacccgggaaacccggtaaaaggggtaacccgtaaaacccgttaaaaccgttaaaaaacggttaaaaaccgtttaaaccggtaaacgggtacgggttaaccgggaaccccttaagggtaccccgtaaaccttacgttttccggtaacttttaccgtaacccggttaccctttaccccggttaccctaacccgtactttaccggtaagttaacccgg

SEQ ID NO: 139336 - DNA, 644 bp, Homo sapiens
  misc_feature: GYAE6OF01AWWIY.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtccctcacctgcgctgtctctggtgcctccatcagtagtggtttctcgtgggctgggtccgcagctcccgagggagggctaggaatacagttggaagtgtctctcatagtggagttcctattacagtccgtctcctcaagtgtcgagtccacctatatctcgtggactacgtccagcaatcctacgttttcccagaagtagtgtagttctgttcgaccgtccgctagaccgtacgggttcttttaagttcgtggttcggacgtaggacggtaccgtagttaagttagttagttagtttttggagtttggtttactttacgtaaccgtacccgtagtacgtcgggaccggggtcctccggtaccccggtggggaccgtaaggggtaacttcgtacggtccgtaccgttccgtcccgttacgtccctacccgaccgtaccggcccgtacgtcccggttccctccccgtcgtaccctccctccctacaccgcgtaccccg

SEQ ID NO: 139337 - DNA, 699 bp, Homo sapiens
  misc_feature: GYAE6OF01DQJX0.46.67.G01.1.454.CMB.1.raw
  modified_base (222)..(222): a, c, t, g, unknown or other
  misc_feature (222)..(222): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccggtgggagacagtgtcaccatccacttggccggganaagtcggaacattcgactaccttatttaaagtggtatacaacagtacgaccgacgggacccggccctaagcctacctaatctagtcgctgctactccgtagttcgaacgtaacggtcgggtacccagtcggaggttcaggtggcgaggtggtatcggtagggaactagtactttcacgtctaccacgtatacctaagtactcgtacgaacctaaggtagtaaagttgtttacgtaacttaactttattacgttagtaacctaaacgtaacgttaaactttaacgttaacgtttacgggttttaacccggaaccgtaaacgggtaacctaaccgtaaacgttaaacgtaaaacgttaacgaacggttcggtaacggtaccttacggaaccttaaccgtacgtttacgttaccggttacctttacgttaacccgtttccccgttaccccgaacttaccgttccgttaacgttaacccgg

SEQ ID NO: 139338 - DNA, 659 bp, Homo sapiens
  misc_feature: GYAE6OF01BRZE1.46.67.G01.1.454.CMB.1.raw
  modified_base (606)..(606): a, c, t, g, unknown or other
  misc_feature (606)..(606): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtcgtcacatcacttggccggcaagtcgaacattgacactattaaatggtatacaacatagacgagggcgaccctaagctacctaatctatgctcgcactccgtagtttacgacgtaaaagggtcgggtaccccaagttcggaaggttcaagggtcggacgaaggttcggaacgttccggaggggtaactaggtaacttttaccaaccttccttaccaacctaacgttacgaagttaacttaccgttacggacgtaaacggttagtaaagttaagttttacgaacttaaacctttagtttaacgtaacgttacaaacaaggttaaacttaactaagttttcgggtttaacccgaacgtaaagggaacctaacgtaacttaaactaaaacgttaaacgaactaggtacggtntacgactaccgtattcttcgttacttcgtactttcccacgtatcagtcttacg

SEQ ID NO: 139339 - DNA, 694 bp, Homo sapiens
  misc_feature: GYAE6OF01C4PWS.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccgatccctcctgtacgtgccgaaccggtgggaagactaggtgtacaccatctaacttggccggggacaacggtcgggaaactagtttcgacctaccttaattttaaagttggtaactacgaaactaagtaacgaccgaaggggaaccggtccctaaagcctactaatcctaagtcgctgctactcctagtttcgacgtaaggtcgggtacccagtccggtaggttcgaaggtggacgtaggtggagtcgtcggggactaggtactttccacgttcctacgacctagtactagtaactcgtacgactaacgtagtaagttagtttacgaaccttaaactttagttacgtagttaacccaaataaggttaaactttacgtaagttttcgggtttaccggaacgtaaacgggtacctaacgtaaccttaaacctaaagttaaccgaacgttaggtacgacgtcgacccaacttacttcgttcgttaccttacaaccgtttcccttacccggaccttaacgtccttagtaacg

SEQ ID NO: 139340 - DNA, 784 bp, Homo sapiens
  misc_feature: GYAE6OF01EWRCF.46.67.G01.1.454.CMB.1.raw
  modified_base (165)..(165): a, c, t, g, unknown or other
  misc_feature (165)..(165): n is a, c, g, or t
  modified_base (236)..(236): a, c, t, g, unknown or other
  misc_feature (236)..(236): n is a, c, g, or t
  modified_base (341)..(341): a, c, t, g, unknown or other
  misc_feature (341)..(341): n is a, c, g, or t
tcagactagcagtacacgaccggtgctcgatttagagtatacataagttggggtttggggagtctcggtcaggacacagcatggacatgagggtccccgctcagctcctggggctcctgctactctggctcgagtgccagatgtgacatcgagctgacccagtcnccatcctacctgtctgccgaaccggtgggactacgagtcgtaccaccgtattccgacgttcggacccgggntaaacggtccgaaactacgttggaacctaacctttaagttttaaaagttggttaactacaacatagaccgagggtaccgcctaaagcctaccgtaatcctagtcncctgacctatccgttagtttacgaacggttcggggtcctacgtcggtacggttaccaggtcggactacggtacggtagttcgtacgggtaacacgttaacgttttaccgaactttacccgtacgtaaacccgtacgtaccgtaacggtttaaacgttcccgttaagggaaacccgttaaggttaacggtaaacgtttagtttttaaaccgaacttaaacggttttaacttaacgttaacggttaactaaacccgtaaaggtttaaaccgttaacgtttaaacgtttccgggttttaaccgaaccgggtaacgtaaacccggtaactaaaccgttaaacgttaaaacttaaacggtaccgttagtacggtacgtacgtaacctacgtacctttaggtaccttaccttcgtaacttcccgtaccgacttactctatacgttaccg

SEQ ID NO: 139341 - DNA, 740 bp, Homo sapiens
  misc_feature: GYAE6OF01ET1PT.46.67.G01.1.454.CMB.1.raw
  modified_base (207)..(207): a, c, t, g, unknown or other
  misc_feature (207)..(207): n is a, c, g, or t
  modified_base (330)..(330): a, c, t, g, unknown or other
  misc_feature (330)..(330): n is a, c, g, or t
  modified_base (361)..(361): a, c, t, g, unknown or other
  misc_feature (361)..(361): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggccttcggagaccctgtccctcacctgcgctgtctctggtgcctcatcagtgtggtttctcgtgggctgggtccgnagcctccgagggagggctaggaatacagtggaagtgtctctcgagttggtggtacggttcctattacgtacgtccgttctcgtacaaggtacgtcgtacgtccaccattactctcgtcggacncgtaccagactatctacgttttccagtaagntagtagttcgtggtcgaccgccgtcgtacggacgtacgggttacttttagttcgtgtcgacgtaggacggtacgtactttaagttacgttggtttaagttttagggtaggttttacggttttaactttaccgtaacccgtacccgttaaggtacgggtacccgggtaccgggggtacccttaccccggggtacccggttaccgggggacccggtaaggggtaaccttaccgggttcggtacccgtaaccggttccttacccgttaccgtccccgtaacccgaacccgggtaaccggtccccacggtttccccggttccccgtttaccccggccgtacccccttacccgtaccccgtaaccggtacggtccctacccggg

SEQ ID NO: 139342 - DNA, 633 bp, Homo sapiens
  misc_feature: GYAE6OF01A5YWS.46.67.G01.1.454.CMB.1.raw
  modified_base (360)..(360): a, c, t, g, unknown or other
  misc_feature (360)..(360): n is a, c, g, or t
  modified_base (375)..(375): a, c, t, g, unknown or other
  misc_feature (375)..(375): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctcctgtctgcaaccgtgggagacagtgtcaccatcacttggccgggcaaggtcgaacattgacaccttatttaattggtatacaacatacgaccgagggaccgccctaagctactaatctatgctgcatccgtagtttcgacgtaaggtcgggtcccagtcgacggttcaggtggctaggtggattcgngggacagtactttcnctctacaccatactaagtactctagactaacgtgtaagttactttacgaactttaacgttaacttaccgtagtaaccaaagtacgttaaacttacgtaagtttcggtttaccggaacgtaacgggtaacctaacggtaacccttaaacgtaaacgtttaaaccgaacgttggtacggtacgtacgtacctaacctacttcgtacgtttacccttactaccgtttacccgttccccgaaccttattcccgttaggtacc

SEQ ID NO: 139343 - DNA, 575 bp, Homo sapiens
  misc_feature: GYAE6OF01BNRYH.46.67.G01.1.454.CMB.1.raw
  modified_base (289)..(289): a, c, t, g, unknown or other
  misc_feature (289)..(289): n is a, c, g, or t
  modified_base (560)..(560): a, c, t, g, unknown or other
  misc_feature (560)..(560): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccgcagcctccgaggggaagggctggaatacattggaagtgtctctcagtagtggaggttcctattacagtccgtctctcaagngtcgagtcacatatctctggacacgtccagcaaatctacgttttcccagaagatgagttctgtacgaccgccgctgacgcggtcgtttatactgtgcgagagcggtactagttatgtagttttggagttagtttactttacgacctacctagtagtcgggacggggtcctccggacccgttcggggaccgaagggtaactacgtggtcctaccgtcttcctacgcctacccgacgaccggccagtcccgtccttccccgtgtccctacccnccaccagcgtacccg

SEQ ID NO: 139344 - DNA, 822 bp, Homo sapiens
  misc_feature: GYAE6OF01C49PY.46.67.G01.1.454.CMB.1.raw
  modified_base (229)..(229): a, c, t, g, unknown or other
  misc_feature (229)..(229): n is a, c, g, or t
tcagactagcagtacacgaccggtgctcgatttagagtatacatattgggtttgggggacctcctgtgcaagaacatgaagcacctgtggtttgtcctcctgctggtggcagcctcccagagtgggtcctgtcctggtgcaactgcgaggacggtccgggcccacgacgtgggtgacggtccttcggacgacccgtcgtccctcaccgtgcgtcttcgtctcgtggtcncctcatcgagttgttcgtttctcggtgggtcgtcgggtccgcgacggccgtaccggaaggggacggctaggaactacgtaggttaggaagttcgtcctcgtacgtaaggttacggtacgggttaaccgtttaccttaagttaccgtaccggttcccgtacttaccgtaacgaaggtacgttacgacgtaccaactattcgtcctacggtacgaacctacgacgacgaccttaacgttccgtttaaccgttccgaaggtaagttacgttaggttaccgttcgtacgggttacccgcccggacgtcgtaacggtaaccggttacggtttactttacgtacgggttgtacggaaccggtagtaccgggttacgtttacgtttaagttacgtttaggtttaaggttttcggtaacgggtttttacgtttaaccgttaccggaacccgttaggtaacgggtacccggtaccggggtaccggggtcccttaacccggggtccccggggtaggaacccgggttaaggtaccgttacccgggtacccggttcccgtttaacccggtcctttaacccggttcccgcccccggtaaacccggg

SEQ ID NO: 139345 - DNA, 735 bp, Homo sapiens
  misc_feature: GYAE6OF01CE67X.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctcgacccagtcctccactccctcctgtctcgaccgaacggtgggacgacagtcgtcacctatcctacgttcggccggacgtaacggtacggaactagttacgaacttaaccgttaattttaaagtcggttactactaactaacgtacgaaccggaacgggaccggtacccgtaaccgtacctaccttaacttacttacgtcgtacgtcgtactacgaccgtttttttttttttacggacgtaacggtaacggtacgggtacccgtacggttacggtacgggttaccggtacgggttacgggtacggtagggtacgggtacggtacggttacgggtaacgtacgttacttacttcgtacctacctacgtactacgtacgtactacgtacgtacgtacgtagttaagttacgtacgttaacttacttactacgtactacgtaactaagtaacgttagttacgttacggtaacggacgtaacgacgtaacgtaaacttaaacgtaacgtacgtacgtacgtcgtacgtctaccgtactacttactcgttacctactaccgtccgtacctactctacgtcgtacg

SEQ ID NO: 139346 - DNA, 896 bp, Homo sapiens
  misc_feature: GYAE6OF01EB8RJ.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtcgcctccatcagtagtggtttcttcgtggggctgggtccgcagcctccgaggggaagggctaggaatacgagttggaagtcgtctctcagttaggtggtacggtttaccttaagtttaaccgacggttcccgtcttccgtacgaaagtacggttacgacgttaccaaccgtattaacttccgtcgttacggggaacctaccgttcccgaaggtacctaaacttccgtttaaaccggttttttccccgtaaggtaaacgtagtttacggttaacggttttccgttcgggttaccggaaccccgggtaccccggtacgttacggtaacccggtaaccgggggtttacggtttttaacgtttaacccggttcgggtttacgggaccggtaaacgggtaaccgggtaaccggttaacgtttaacgttttaagttacggttttaacggttttttttaggggaagggtttttacgggtttttaacgttttaccggtaaacccttacccggttaagggttacggttacccggggtaaccgggggttacccgtttacccccgggtaaccccccggggttacgggggtaaccccgggtaaagggggtaaacccgttacgggttaccggggttaccccgttaaccccggtttcccgtttaaccccggtttacccggtcccccgttaaacccccggg

SEQ ID NO: 139347 - DNA, 881 bp, Homo sapiens
  misc_feature: GYAE6OF01AWKLH.46.67.G01.1.454.CMB.1.raw
  modified_base (171)..(171): a, c, t, g, unknown or other
  misc_feature (171)..(171): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtncctcatcagtagtgtttctcgtggggctgggtccgcagcctcccgaggggacgggctaggaatacagttggaagttgtctctacagttagtggacgttcctaagttaccaggttccctctctacgaaaggacgtccgaagtccaacccgtatacttccgtcgtaggaaccctaccggtaccaaggtacctaaaacgttccgttttaaccggtttttaccctaagggtaaaacggtactttacgggtaacgttttcccgttaggtacccggaacccccgggtcccgtacggtacggaaccccgggttaaccggggtttactttttaaacgttccggttacggttacgggaccggtaacgggtaacggtaaccgggttacctttaagtttaggttaggtttaacggttttttaggggtaacggttttacgggttttactttaaccgggtaacccttaaccccgttaagggttaaccgttacggggtacccgggggttacccgttccccgggtaccccggtaccgggggtaaccgtaacggggtaacttaaccggttcgggttaacccgtacccggttccttacccgtaccgtccccgtacccgaacccggtaacccggtcccctaccgggttcccggttaccccttacccccccggttacgggtacccccttaccccccgttacccgaacccgaacggtcccgtaaccccgg

SEQ ID NO: 139348 - DNA, 665 bp, Homo sapiens
  misc_feature: GYAE6OF01A5CZP.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccggtgggagacagtgtcaccatcacttgccgggcaacgtcggaacattgactaccttatttaaattggtatacaacatacgaccagggaccggccctaagctcctaatctatcgctgcatcctagtttgacgtaaaggtcggggtcccagtcggtaggtttcagtggcgtagtcggatcgtgggactagtatttcactctaccaccgtactcgtaagttaacttcgtacgacgtaacgtaggtaaagttactttttacgacctttaaacttttactttaaccgttacgttacctaaacgtaacggttaaacttaacgttaagtttacgggtttttaacccgggaacccgttaaacggggacctaaaccggtaacttaaacgtaaaactttaaccggaaacttggtacgtcgtacgtacctacgtacgttcttcttaccgttccttacttaccccgtttacccgacttacttacgtgttaacg

SEQ ID NO: 139349 - DNA, 892 bp, Homo sapiens
  misc_feature: GYAE6OF01ALNQL.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgagggaggggctggaatacagttggaagtgtctctcatagtggacggttcctattacagtccgtctctacaagtgtcgagtcaccatactctctaggaccacgttccagtccaaagttcctacgtttttccccagtaacgtattacggtagtttccgtaggtcggtaacccggcccgtaccgttacggtaacccggtaaccgggggtttaccggtttttaaagttaacccggttagggtttccggacgggtaaggtaaccgggaacgggttaccgtttaagtttaggtttacggtttaaaggtttttttaggggtaacgggttttacgggttttaacgttttaccggtaaacccgttacccccggtttaaggtaacccggttacgggggtaacccggggggttcccttaacccggggttaaccccccgggtccgggggtaaccccgggtaacgggggtaaaccgtttaacccggttacggggttacccgttaacccggttacccggttaacccgtttaccggtaccccttaacccccggaaaccccgggtaaacccggggtccccccgtaacggtttacccccgggtttaccccccgtttcccccccggttacgggtaaccccccttacccccgttacccccgttaaccccgtaacgggtaaccgtccccccgg

SEQ ID NO: 139350 - DNA, 661 bp, Homo sapiens
  misc_feature: GYAE6OF01DF1N5.46.67.G01.1.454.CMB.1.raw
  modified_base (193)..(193): a, c, t, g, unknown or other
  misc_feature (193)..(193): n is a, c, g, or t
  modified_base (413)..(413): a, c, t, g, unknown or other
  misc_feature (413)..(413): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctcgacccagtcctccactcctcctgtctgcaccgtggganacagtgtccaccatcacgttcggccgggacaacgtcggaactagttacgaccaaccttattttaagttaggtaactacaaacataacgaccgacggggacccgaccctaagcctacctaatctatcgctgctatcctagttacgacgtaacgggtcgggtacccagtacggtaggttcaggtggtacgtaggtggtactcggtagggactagtacttacnctctacactatctaagtactcgtacgacgtaacgtataattgtttacaacttaacttatttacgattaacgaacgtagttaacttaactagtttcggtttaccggaccgtaaacgggacctaacgtaaccttaaacgtaaaactttaaccgggtaagtcggttacggacctacgaccgtaaacccgtgtttacccttacgttaccttacctacccgttcccttacccgactttacttcgtacgtaacg

SEQ ID NO: 139351 - DNA, 640 bp, Homo sapiens
  misc_feature: GYAE6OF01BRY29.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatccctccctgtctgacaaccggtgggacacagtgtccaccatcacttcggccgggacaagtccggaactattcgacctaccttaatttaaagttggtatacaacatacgaccgagggaccggccctaagcctacctaatctatgctgctactcctagtttcgacgtaagggtcgggtacccagtcgtagttcaggtggcgagtggactcgtagggtacagtacttcactcctacacctataccgtaagttaactcgtacgtacgaacggttagtaaagttacttttacgaacttaacttttaacgttacttacgtaacctaaactaagttaaactttaacgtagttttaccggtttaccggaaccggtaacggtactaaccgtaactaaacgtaaattaaccgtagtgtacgtactacgacctaactatcgttcttacctcttaccttccctacccgtatacgtctagtaac

SEQ ID NO: 139352 - DNA, 757 bp, Homo sapiens
  misc_feature: GYAE6OF01ACDI0.46.67.G01.1.454.CMB.1.raw
  modified_base (243)..(243): a, c, t, g, unknown or other
  misc_feature (243)..(243): n is a, c, g, or t
tcagactagcagtacacgaccggtgctcgatttagagtatacatattgggtttgggggacctcctgtgcaagaacatgaagcacctgtggtttgtcctcctgctggtggcagcctcccagagtcgggtcctcgtccctggtgaccaacgtgcgaggacgtccgggcccacgacgtggcgacggtcccgttacggacgtaccctcgtcccctcaccgtgccgtcttcgtccttcgtcgggtccncccttacaacgttcgtaacggttggtttcggttttactccgggtggggtccgtacggggtccgacgtacgtcccgtacccggaaggggtaacggtctaaggtaactacgtagttacggtaagttctctacgtacgtagtacggttacggtaccgttactaacgttaccgacggttcctactacgtaccgaaggtccgtacgtactaccacctattactcgttacgacggaaccttacgacccgagtactacttccgttacgtttccgaagtagtactacgtacttcgcgacccgaccgtcgaaccgttagaccgggttacgttactttacacgtggaccggagtagacgtacgtactttagtagttgttatttacggaacgtttcgtaactcgaacccgtcggtacgtaccggccgggtcccggtacccgtcccggtaccggagggtaacgaccggttaccttaaccggttcgtacccgttaccttccctaccgttaccgcccgttaaccccgg

SEQ ID NO: 139353 - DNA, 716 bp, Homo sapiens
  misc_feature: GYAE6OF01DD4FO.46.67.G01.1.454.CMB.1.raw
  modified_base (225)..(225): a, c, t, g, unknown or other
  misc_feature (225)..(225): n is a, c, g, or t
  modified_base (375)..(375): a, c, t, g, unknown or other
  misc_feature (375)..(375): n is a, c, g, or t
  modified_base (693)..(693): a, c, t, g, unknown or other
  misc_feature (693)..(693): n is a, c, g, or t
  modified_base (702)..(702): a, c, t, g, unknown or other
  misc_feature (702)..(702): n is a, c, g, or t
tcagactagcagtacacgaccggtgctcgatttagagtatacatattgggtttgtcctcctgctggtggcagctcccagatgggtcctgtccctggtgcaactgcagggagtccgggccccacgactgggtgacgggtcccttcgggacgcccctgtccccctcacctgccgtctggtctcgtggtcgcctccatcagtgttgtttctcgtgggctgggtccganacgcctccggaggggagggctaggaatacattgggatgtctcacagtagtggtagttacctagttacacgtccgtctctacgaagtagtcgagtcaacctatattctcgtacgaaccacgtccagactaactactacgttttaccagaanacttcggtaacttcgacgtcgccgccgtactacggtaccgtacgggttacgtttacgttaaccgttcggtaagaccgaaggtaacgtaccgggtactttaagtttaagttagttttacggttttagggaagttttacggtttaactttacgaacccgttaccgtaagtacgttacgggacggggtccttacccgggaacccggtcggggtaacgacgggtaactacgttacggcctaaccgtcgttcctaacgtccctacgaacccgtcggtaaccctgttcccggtaccccgttccccgaggtacccctaccccgtntaaacccgngtaacccgtacccg

SEQ ID NO: 139354 - DNA, 632 bp, Homo sapiens
  misc_feature: GYAE6OF01AOKRH.46.67.G01.1.454.CMB.1.raw
  modified_base (208)..(208): a, c, t, g, unknown or other
  misc_feature (208)..(208): n is a, c, g, or t
  modified_base (393)..(393): a, c, t, g, unknown or other
  misc_feature (393)..(393): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccgnacgctcccgaggggagggctggaatacattggagtgtctctcagtagtggagttcctattacagtccgtctctacgaagagtcgagtcacctatatctctggacacgtcagctaatctacgtttccagaacgtatgtagttctgtcgacccgcgctcgacgtcgggtacttttatacgtgtacgngagagacggtcttatatgttagttttggagtttaggttactttaccgactaccgtagtacgtcgggacgggcctccggtaccccggtggggacccgaagggtaacgtacgttcggtacccgtaccgtccttacccgtacgccccgtacccgaacccggtaaccgggtcccctacgttcccggttcccctttcccccgtccggacccctaccccctacccgtacccaacgccggtacccc

SEQ ID NO: 139355 - DNA, 596 bp, Homo sapiens
  misc_feature: GYAE6OF01DNTV0.46.67.G01.1.454.CMB.1.raw
  modified_base (190)..(190): a, c, t, g, unknown or other
  misc_feature (190)..(190): n is a, c, g, or t
  modified_base (214)..(214): a, c, t, g, unknown or other
  misc_feature (214)..(214): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtgganacagtgtcaccatcacttgccggnaagtcgaacatgacactatttaatgtatcaacatagaccgagggacgccctagcctactatctatgctgcatcctagtttgactaaaggtcgggtcccagtcgagttcagtggcagtggtatcgtaggactagtattcgactctcacctatactaagttaactcctagacctaaagtagtaaattagttttacgaactaacgtttaacttacgtacgtaactaaaccgtagttaaactttaacgtaagtttcggtttaccggaccgtaaagggtaccaaaccgttaactaaactaaaacgttaacgaagttcggtagcctagacctaactattaccgttgtcccttataccgttccttacccgaccttatccgtattaaccg

SEQ ID NO: 139356 - DNA, 649 bp, Homo sapiens
  misc_feature: GYAE6OF01C6GQX.46.67.G01.1.454.CMB.1.raw
  modified_base (193)..(193): a, c, t, g, unknown or other
  misc_feature (193)..(193): n is a, c, g, or t
  modified_base (346)..(346): a, c, t, g, unknown or other
  misc_feature (346)..(346): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgccaaccgtggganacagtgtccaccatcaccgttggcccgggacaaggtcggaacattgactactatttaatgtatcaacatagaccgagggaccgaccctaagctacctatctatgctgcatcctagtttgacgtaaggtcgggtcccagtcgagttcaggtcgnaggtgatcgtgggactagtactttccgacttctaccacctatacgtaagttaactcgtacgactaacggtagtaaagttacttttacgaccttaaacttttactttaaccgtacgttaaccaaacgtaacgttaaactttaactaaagttttcgggttttaccgaaccgtaaacgggtaacctaacgtaaaccgttaaactaaaacgttaacgtaaccgtaggttacggaccttacgaccctactagttcccttacttccgttacctaccgttcccttaccccgaccttacgtccttagtaac

SEQ ID NO: 139357 - DNA, 747 bp, Homo sapiens
  misc_feature: GYAE6OF01DJ6YY.46.67.G01.1.454.CMB.1.raw
  modified_base (203)..(203): a, c, t, g, unknown or other
  misc_feature (203)..(203): n is a, c, g, or t
  modified_base (206)..(206): a, c, t, g, unknown or other
  misc_feature (206)..(206): n is a, c, g, or t
  modified_base (232)..(232): a, c, t, g, unknown or other
  misc_feature (232)..(232): n is a, c, g, or t
  modified_base (246)..(246): a, c, t, g, unknown or other
  misc_feature (246)..(246): n is a, c, g, or t
tcagactagcagtacacgaccggtgctcgatttagagtatacatattgggtttgggggagtctcggtcaggacacagcatggacatgagggtccccgctcagctccgtggggctcctgctactctggctccggaggtgccagatgtgacagtcgagctcgacccagtcctccactccctccctgtctgaccgaacggtggganacnggtctcacatctacgtcggaccgganaaggtacggaactnttacgacctaacttaattttaaagtgtaatacgaaactataacggaccgacggggaaccggaccctaagcctaccttaaacgtcttaacgtcgctacggtacctacgttaccgtaggttttacggaacgttaaaacgggttcccggggacccttaaggtaccggtacgggttcgaaggttcgggaactaggtaacggtatccgggtaggaaccgtaggttacttttaccgaccttacgtaacccacctaaatcttaagtacttcgtagaaccgtaacggtagtaacgtttagtttacgtacctttaaacttagtttacctacgtaacaaacgtaaagtaacttaacgttacgttacgggtttaccgaaccggtaacggtaacgtaaaccgtaaactaaacgtaaacttaacggaacgttcggtagtaccgataccgtacgtattaccgttcttaccgttactacccttcccgttacccgtacctaacttgggtaaccttac

SEQ ID NO: 139358 - DNA, 1044 bp, Homo sapiens
  misc_feature: GYAE6OF01CMP1K.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactgggtgaggccttcgggagaccctgtccctcacctgcgctgtctctggtcgccctccatcagtaggtggttttctcgtggggctcggggtccgcacgtccgtcccggaaggggaaggggctaggaatactagttcggaagtgtctctacgtagttaggtgggtacggttcccttaattacgacggttcccgttacctcgtaccgtaaggtacggttcgaacgttaccaaccgaattacctcctacgtacgggaacctaccgtaccaacgtaccgtaactttaccgttaccgtttttcccgaaggtaaagttactacggttacgtttaccgttcggtaccggaacccgtcccggacgtaacggtaacccggttaaccggggtttacgttttaacgttacggtacgggttacgggtaacggaacgggtaacgggtaacccggttacgttttaacttttagggttaaggtttttaacgggtttttaggggttaaggttttacgggttttaaccgtttacccggaaacccgttaacccggttaagggtaccccggttaaccgggggacccggggggttaaccccgttacccggggaccccccggggttttaaccgggggaacccggttaacgggggttaaacccgttaccgggttacccgggttaccccggttaacccggtttaaccccgtttacccggttttaacccccggtaacccccggtttaaacccccggaaaaacccccggggttaacccccgggggttacccccgttaaaccccgggtttttcccccggggtttaaacccccccccgttttccccccccggggttaacccggggtttaccccccccttaaaccccccccggttttaccccggaaaccccggtaaaacccggggttccccccggttaaaacccccgggg

SEQ ID NO: 139359 - DNA, 628 bp, Homo sapiens
  misc_feature: GYAE6OF01A4DGQ.46.67.G01.1.454.CMB.1.raw
  modified_base (214)..(214): a, c, t, g, unknown or other
  misc_feature (214)..(214): n is a, c, g, or t
  modified_base (342)..(342): a, c, t, g, unknown or other
  misc_feature (342)..(342): n is a, c, g, or t
  modified_base (397)..(397): a, c, t, g, unknown or other
  misc_feature (397)..(397): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagacccctgtcccctcacctgcgctgtctctggtcncctccatcagtagtgtttcttcgtggggctgggtccggcagcctcccgaggggaagggctggaatacagttagggaagtgtactctcgagtagtggtacggttcctattacagtccgtctctacaagngtcgatcaccatatctctcggacacgtcagctaatctacgttttccctagaagtntagtacgttcgtgtcgacccgtcgctacgacgtacgggttacgtttacttacgtgtgacgagacggtacggtcttaagtttagtagttagttttggtagtttggtttatttacgaccttacccgtaggtaccgtcgggaccggggtccgttacccggacccggtcggggaccgtaacgggtaactacggttcggtaccgtaccggttacctcccgttacgcccgtaccccg

SEQ ID NO: 139360 - DNA, 704 bp, Homo sapiens
  misc_feature: GYAE6OF01C1AJF.46.67.G01.1.454.CMB.1.raw
  modified_base (226)..(226): a, c, t, g, unknown or other
  misc_feature (226)..(226): n is a, c, g, or t
  modified_base (267)..(267): a, c, t, g, unknown or other
  misc_feature (267)..(267): n is a, c, g, or t
  modified_base (407)..(407): a, c, t, g, unknown or other
  misc_feature (407)..(407): n is a, c, g, or t
tcagactagcagtacacgaccggtgctcgatttagagtatacatattgggtttgggggacctcctgtgcaagaacatgaagcacctgtggtttgtcctcctgctggtggcagcctcccagatgggtcctgtccctggtgcaactgcaggagtccgggcccacgacgtgggtagacggtccttcgggacgacccctgtcccctcaccgtgccgctgtctcgtggtcncctcatcagttagttgtttctcggcggggctcggggtccgncgtccgtccggaggggtcgggctacggtaataccgtagttaggaagttcgtctactcgtagttaggtcggtacgttccttattacgacgtccctctctacaagtcgtacgacgtaccacctatactcgtcgtacggaccncgtcagctaacttcgttaccgttttaccgaggtaagtagttacgtagtttacgtcggtaccgaccggccgtacgtacgaccgggttaccggtttacgtttacgtacgtcggtacggacgaggtacggtacgtactttagttaggttcgtttaggttttacgggtagttttcgttaaccgtttaccgaaccgttaccgtaggaccggttaccggggacggggtccctacccgggtacccgggtggggaccgtaaggtactcggtcgtaccgtaccttgtaccctcgcccctaacccgg

SEQ ID NO: 139361 - DNA, 963 bp, Homo sapiens
  misc_feature: GYAE6OF01BJNU4.46.67.G01.1.454.CMB.1.raw
  modified_base (212)..(212): a, c, t, g, unknown or other
  misc_feature (212)..(212): n is a, c, g, or t
  modified_base (251)..(251): a, c, t, g, unknown or other
  misc_feature (251)..(251): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcggcccacgactggtgaggccttcggagaccctgtcccctcacctgcgctgtctctggtcncctccatcagtagttgtttctcgtggggctgggtccgcngcctccggaggggagggctggaatactagttgggaagttcgttctctcataggtggtacgttcctattaccagttcccgtctacgtacgaagtcgtacgagtccaacctattacttccgtcgtacggacccaccggttccaacggtacctaaacttcgttaccgtttttaccccgaggaaagtacttacggttaacgttttcgtaggtacccggtacccggtcccggtaccgtacggtaacccggtaaccggggtttaccgttttaacgtttacggttagggttaccggtaacccgggtaacgggtacgggtaacccgggtttaacgttttaaccgttttaaggtttaccgggtttttaagggtttttttttaccggggtaaaggggttttttaccggggttttttaaaccgtttaacccggtttaaaccccccgtttaacccgggtttaaagggtaaaccccggggtttacccgggggggtaaccccggggggtttaccccccgttaacccccgggggggttaaacccccccccgggggtttacgggggggaaaccccggggttaaaaccggggggttaaaacccgttttaaaccccggggtttacccccggggggtttaaacccctttaccccccccgggtttttaaaccccggtttacccccccgggttttaaaccgggtaccccccccggtttaaaccccccccgggg

SEQ ID NO: 139362 - DNA, 707 bp, Homo sapiens
  misc_feature: GYAE6OF01BCVYB.46.67.G01.1.454.CMB.1.raw
  modified_base (212)..(212): a, c, t, g, unknown or other
  misc_feature (212)..(212): n is a, c, g, or t
  modified_base (300)..(300): a, c, t, g, unknown or other
  misc_feature (300)..(300): n is a, c, g, or t
  modified_base (364)..(364): a, c, t, g, unknown or other
  misc_feature (364)..(364): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgacggccttcggacgaccctgtccctcacctgcgctgtctctggtgcctccatcagtagtggtttcttcgtgggctgggtccgnacgcctccggaggggaggggctaggaatacagttggaagtgtctctcagttggtggtacgttcctattacacgtccgtctctcgaagngtcgagtccactatctctcgtggaccaccgtccaacgcaacttcgtacgttttccgagtaagtntagttacgttcgtggtacgcccggccgtcgtacgaccggtacgggttcttttaatcgtggtcgacgagacggtacgtattagtttagtgtttagttttggtaggtttagtttcgttaccgacctacccgtagtccgtacggggtacgggtcctcccggtacccggtggggaccgtagggtaaccgttcgttaccggtacccgtacccgttccgttacccgttaccggtcccctacccgaacccggtaccggtaccccgtacccggttcccggttccccccgttacccccgtacccggtaccccctacccccgttcccgtaacccggtacgtacccggtacccg

SEQ ID NO: 139363 - DNA, 848 bp, Homo sapiens
  misc_feature: GYAE6OF01B3EF5.46.67.G01.1.454.CMB.1.raw
  modified_base (258)..(258): a, c, t, g, unknown or other
  misc_feature (258)..(258): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgactggtgaggccttcggacgaccctgtcccctcacctgcgctcgtctcgtggtcgcctccatcagtagttggtttcttcgtggggctcgggtccgnagccgtccgaggggacgggctaggaactacgtagttaggaagttcgtctctacgtagtaggtggtacggtttacctattaccgtacgttcccgttccttaccgtacgaaaggtacgtccggtacgtaccaaccctaattaccgtcgttacgtacggaacccgtaccgttaccaacgtacctaacgttaccgtttaccgtttttacccgaggtaaacgtagttacggttacgtttacgtcggtaccggaccccgtccggtcgtacggtaccggtaccgggtttacgttttaacttacggtgtaccggacggtaagggacggttaaccgggttctttaagtttagtttacggttttaagggttttttagggtagggtttttacggttttaacgtttacccgtaacccgtttaaccccgttaaggttacccgggttaccggggtaacccgggggttacccgttaccccgggtaaaccccgggttcgggggaacccggttaacggggttaaacccggttaccggtttacgggtaaccccgttaccccggtttacccgtttaccccggttaccggtccccccgttaaaccccggg

SEQ ID NO: 139364 - DNA, 593 bp, Homo sapiens
  misc_feature: GYAE6OF01DUIWS.46.67.G01.1.454.CMB.1.raw
  modified_base (174)..(174): a, c, t, g, unknown or other
  misc_feature (174)..(174): n is a, c, g, or t
  modified_base (355)..(355): a, c, t, g, unknown or other
  misc_feature (355)..(355): n is a, c, g, or t
  modified_base (364)..(364): a, c, t, g, unknown or other
  misc_feature (364)..(364): n is a, c, g, or t
  modified_base (568)..(568): a, c, t, g, unknown or other
  misc_feature (568)..(568): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggccttcggacgaccctgtccctcacctgcgctgtctctggtcncctccatcagtagtggtttctcgtgggctgggtccggcagctcccgaggggaaggggctagggaactacagttgggaacgtgtctctcagtagtggaggttcctagttacagttccgtctctacaagagtcgagtcactatatctcgtggacacgtcagcaaatctacgttttccagaagntgtagttcngtgacccgtcgctgaccgtgggtctttatactgtacgcgagagacggtactattagtgttagttttaggagttcggttaattcgacctacccgtagtacgtcggacgggctaccggacccgtggggacctagggtaactcgtcggtaccacgttctacccgtagccctacccacgtacggccctacgtcggtacccttccccgngtcccaccctccaccacgctacccg

SEQ ID NO: 139365 - DNA, 968 bp, Homo sapiens
  misc_feature: GYAE6OF01CNCKV.46.67.G01.1.454.CMB.1.raw
  modified_base (98)..(98): a, c, t, g, unknown or other
  misc_feature (98)..(98): n is a, c, g, or t
  modified_base (177)..(177): a, c, t, g, unknown or other
  misc_feature (177)..(177): n is a, c, g, or t
tcagactagcagtacacgaccggtgctcgatttagagtatacatattgggtttgtcctcctgctggtggcagctcccagatgggtcctgtccctggtncaactgcaggacgtcgggcccacgactgggtgacggcccttcgggagaccctgtccctcacctgcgctgtctctggtcncctcatcagtgttggtttctcgtgggctcgggtccgcacgccgtaccggagggggaacgggtctagggaaatacgtagttagggaagttcgtcctctcgtaagttaggtcgggtacggtttaccttaattaaccgcgttcccgttacttcctaccgaaggtacgttccggtaacgttccaaaccgtattacgttcctacgtacgggaccctaccgggttaccaggtacctaacgttccgttaacggtttttaccccgaaggtaaaacgtcgtttacggtacgtttcgtggtacccggtacccgtccgtacgtacggtaaccggtacgggtttacgttttaacgttacggtggtacggacggtaaggtacggtaacggttctttaacgtttagtacggttttagttttacggggagttttacggttttaccttaacccggtaaccgtaacccgttagggtaccggttacccgggggtaccgggggtaccccgttaccccggggtaccccgggtacggggggtacccgtaaacgggggttaaccttacccggggttaccggttaaccccggttaccccggtttaaccccgttaccccggtttaaccccggaccccccgtttaaaccccgggaaaccccgggttaaccccgggggtaccccctttaaaccccggggttttccccggggttaacccccccgtttccccccgggttaccgggtaacccccccctttaccccccggtttaaccccgtaaaccccggtaaaccggggtaccccgttaaccccccgggg

SEQ ID NO: 139366 - DNA, 682 bp, Homo sapiens
  misc_feature: GYAE6OF01CJ2X9.46.67.G01.1.454.CMB.1.raw
  modified_base (171)..(171): a, c, t, g, unknown or other
  misc_feature (171)..(171): n is a, c, g, or t
tcagactagcagtacacgaccggtgctcgatttagagtatacatattgggtttgtcctcctgctggtggcagctcccagatgggtcctgtcctggtgcaactgcaggagtcgggcccacgactggtgaggccttcggagaccctgtccctcacctgcgctgtctctggtcncctcatcagtagttggtttctcgtggggctgggtccgcagcctcccgaaggggaacggggctaggaatactagttagggaacgttgtcctatcgtagtacggtggtacggttcctatactacgtccgtctctcaagagtcgtagtccaccatatctcgtgacaccgtcagacaactctacgttttccagaatagtcgtacgttcgtcgtacgccgccgtcgtacgacgtacgggtacgtttacttacgtggtacgcgacggaggacgtatattagtattaggttttggagttggttacttacgtacctacccgtaggcgtacgggaccggggtccttaccgggacccggtggggtaacccgagggtaacgttacgtccggtaccgaccggttccttacccgttacgccccgttaccgacccggtaccggtaccccgtaacgttccccggttcccgtttaccccccgcggtaacccctccccgtacccaacccgaacggtacccgtaccccg

SEQ ID NO: 139367 - DNA, 1123 bp, Homo sapiens
  misc_feature: GYAE6OF01CAQ9Z.46.67.G01.1.454.CMB.1.raw
  modified_base (214)..(214): a, c, t, g, unknown or other
  misc_feature (214)..(214): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgacgtggtgaggccttcggacgccctgtccctcacctgcgctgtctctggtcncctccatccgtaggttagttcggttttcctcggtgggggccttcgggggtccccggacgacggtcccgttaccccggaaggggggtaaacgggggtccgttaacggggtaaacttaaccgtaaggtttaacggggtaaacggttcggtttaccttaccgttacgtaaggtttaaggttacggggtaaccgggttttacccctttaaacgttttaaccgtaaccgggttttccccgttaccgttttaccggttaacgtaaaacgggttaaccgggttaccggtaccggttaacccgaaacccgttaattaaaccgtttccccgttacggttaaccgggtaaaccccgtaaacccggttaccccgtaaacggttaccgttaaaaacctttacccggtttaaacccggtttttttaccccccgaaagggttaaaaacgtaacggtttaacggttaacgggttttccgttaccggggtttacccggtaccccccgggtaccccggttacgggttaacccgtaaacccggggttaacccggggttttcccgttttttaaaccggttaccggtttagggttaccggaaccggtaaacggggtaccggtaacccggttatttttaaacgtttaacggttttaaggttttaacgggttttttaggggttaacgggtttttacggttttaaaccggttttacccgtaacccggttaacccgtttaagggtaaccggtttaccccgggggggaaccggggtttccccgttaacccccgggggtaccccggggttacccggggtaacccgggttaaacggggttaaccgtttaaccggggtttaccccgggtaccgttaacccccgggtttccgtttaacccccgggttaaccggttccccccgttaaaaccccccgggg

SEQ ID NO: 139368 - DNA, 719 bp, Homo sapiens
  misc_feature: GYAE6OF01E5QIL.46.67.G01.1.454.CMB.1.raw
  modified_base (336)..(336): a, c, t, g, unknown or other
  misc_feature (336)..(336): n is a, c, g, or t
  modified_base (703)..(703): a, c, t, g, unknown or other
  misc_feature (703)..(703): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccactccctcctgtctgacgaaccggtgggagacagtcgtccaccatcacgttcggcccgggacaaggtaccggaactatttcgaacctaaccgtttaattttaaaagttggtaactacaaactagtacggaaccgacggggaccgtaccctaagtcctacctaatcttancgctgctactccgtaggtttcgacgtaagggtccgggtacctagtcggtaggttcgtaggtcggtacgtaggtggtactcgggtaggtaactaggttacctttcgtacccttccgtaccgtaacctaacttacgtaagttactcgtaaccggtacgtaaacggttagttaaagtttacgtttacgtaacctttaaacgtttacttaacgtcggtaaactaaactaaagttaaactttacgttaagtttacgggtttacccggaacggtaacggtacctaaacgtaacctaaacgtaaacgttaacgtacgtacgtcgtaccacaccgtactattacgttcttaccttctaccgtccccgttacccgnttacctcgtagtaccg

SEQ ID NO: 139369 - DNA, 909 bp, Homo sapiens
  misc_feature: GYAE6OF01EE6LC.46.67.G01.1.454.CMB.1.raw
  modified_base (190)..(190): a, c, t, g, unknown or other
  misc_feature (190)..(190): n is a, c, g, or t
tcagactagcagtacacgaccggtgctcgatttagagtatacatattgggtttgtcctcctgctggtggcagctcccagatgggtcctgtccctggtgcaactgcgagggacggtccgggcccagacgtgggtgacggtccgttcggacgacccctcgtccctcaccgtgaaccgtctgtctcgtggtcnccctacagtacgtaggttggtttcggtttccgttgggtcgggggtcgttcgggggtcccgcgaccggtccgtaccgggaagggggaacgggtctaagggtaatacgtaggttagggtaacgttcgtctactagtaaggttaggtcgggttaccgttacctaacgttaccgtacggttcccgttctacgtaacgaaacggtcgtacgtacgtacctaacgtattacttccgtacgtacggtaccgtaccggtaccaacgtaactaacgttaccgttttaaccggttttaccgaaagggtaactaggttacggttacggtttacgtacggttaccggacccggtccggttacggtacgggtaaccgggtttacggtttaccgttacgttaccggtggtaacggaccggtaacgggaaccggttacggttaatttaaggtttacggtttaggttttaacggtttaggtacgggtttacgtttaccgttaccgaaccctttacggtacggtaccgggtaccgggggtaaccggtcccgttaacccgggcccgggtaacgggtaccggtagggttaaccttccggtaccgtaccggtcgttaacccgttccggtaccttaccccgaacccggtaaccgtcccggttaccgtaccccggttccccgggtttcccaccccgttccgtaaccccgttcccgtaaaccgtacgccggtcctacccggg

SEQ ID NO: 139370 - DNA, 783 bp, Homo sapiens
  misc_feature: GYAE6OF01DGT1C.46.67.G01.1.454.CMB.1.raw
  modified_base (772)..(772): a, c, t, g, unknown or other
  misc_feature (772)..(772): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgcgacatcgagctgacccagtcctccatccctcctgtctgccaaccggtgggaacacagtcgtcaccatctacgttcggccgggacaacggtcggaacctgtttacgaacctaaccttaatttttaaacgtggttaacttacaaaaccgtagtaacggaccgaacggggaaccggtacccctaaagcctcctaatctatcgccttgacctatccgtaagtttcgaacgtaaacggttcggggtacccaaggttcggtaaccgtttcggagttacggctaggttcgggtaacttcggtagggactacgtactttacgacttaccgttacgaacctattacccggtaattaacgttaccgttacggtaaccgttaacggttaacgaaacggtttacgtttttacggtaaactttaaccgtttactttaaccgttaacggttaacctaacccgtaatttaacttaaacttaacgtttttccgggtttaaccgacggtaaacggtacctaaccggtaaacctttaaacgaaaacgtttaaacgaaacgttacgttacggaaccgtccggtaacctacgtacgttacttcgttaacccgttacccgttattaccccgttacccggtacttacggttntacgttaaacg

SEQ ID NO: 139371 - DNA, 783 bp, Homo sapiens
  misc_feature: GYAE6OF01DZ199.46.67.G01.1.454.CMB.1.raw
  modified_base (238)..(238): a, c, t, g, unknown or other
  misc_feature (238)..(238): n is a, c, g, or t
tcagactagcagtacacgaccggtgctcgatttagagtatacatattggggttgggggacctcctgtgcaagaacatgaagcacctgtggtttgtcctcctgctggtggcagcctcccagatcgggtcctcgtccctggtgacaactgcgagggacggtccgggcccacggacgtgggtggacggtccgttacggacgtacccctgtcccctcacctggccgtctgtctcgtggtccncctcatcgtagttaggttcggtttcctcgggtcggggtccggtcggggtccggcgcggccgtaccggaggggacgggtacgtaggtaactacgtagttaggtagtgtccgtctactgttaaaaaaaaaaaaaaaaggtggtacggttacgttacgttacgtcgtccgtctctacgtaagtacgtacgtacgtacctactactacttctcgtacggtaaccgtaccgtaccgtacgtaactaacttacgttaccgtttaccgtacgtaacggttaagtaggttacgttacgttacggtaccggtacccggtccgtcgtacggtacggtacgggtttacgtttacgttacgtcggtacggacgtaggtacggtacgttacgttacgttagttagtttaggtttaggtttaggttacggtttacggtttacgttacctaccgtacgtacggtacggtaccgggtccggtaccggtcccggtaccgggtacgggtacggtaacgtacgtaccggtaccgtaccgtaccgtccgttccgtcccgtacccg

SEQ ID NO: 139372 - DNA, 763 bp, Homo sapiens
  misc_feature: GYAE6OF01DTOKG.46.67.G01.1.454.CMB.1.raw
  modified_base (490)..(490): a, c, t, g, unknown or other
  misc_feature (490)..(490): n is a, c, g, or t
  modified_base (709)..(709): a, c, t, g, unknown or other
  misc_feature (709)..(709): n is a, c, g, or t
  modified_base (752)..(752): a, c, t, g, unknown or other
  misc_feature (752)..(752): n is a, c, g, or t
tcagactagcagtacacgaccggtgctcgatttagagtatacatattggggtttggggagtctcggtcaggacacagaatggacatggacgggtccccgctcagctccgtggggctcctgctactcgtggcctccggagggtcgccagtagttcgcgactagtcggacgtctaccgaccctagtcctcctactccctcctgtctcgacgaacggtggacgacgtaggtcaccacctatccgtacgttcgggacccggacgtaacggtacgaacgtacgtacgtaaccttaactttaaattttaacgttagtaactaacaacgtaaggaccggaccggtaaccggacccgtaccctagtcccttactaacgtcatcgtctacgaccgttacgtaccgttaggtacgaacggtaaccgggtccggtacgtatacgggtacgttgaggtcggagtcggtagtacgtgggtaacgacgtttactacgtttaccnctttaccaagttaacccgtagttagtaacttcgtacgacgtaacggtaacgttaagttaccgttaattactaaccttagtttactaacgttaacaacgttaaacttaatacgtttaacggtacgtttacggtaaccggacggtaaccaacgttaactaaacgttaaacgttaacgacgtttaacgggcaagttcccacgtaaaccctgttacccgtttntacccgttactccttaaccgttccctacgtacttataccgttntaccgttaccg

SEQ ID NO: 139373 - DNA, 675 bp, Homo sapiens
  misc_feature: GYAE6OF01BSU57.46.67.G01.1.454.CMB.1.raw
  modified_base (229)..(229): a, c, t, g, unknown or other
  misc_feature (229)..(229): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttggccgggcaagtcggaanattgaacaccttatttaaattggtatacaacatacgaccgagggaccgaccctaagctacctaatctatgctgcactcctagtttgacgtaaaggtcggggtaccctagtcggtacggttcgaggtggcgaggtggagtcgtgggacagtatttccactcctaccacctatacgtaattactcgtagaccgtaacgttaggtaaattagttttacgaactttaaactttactttacgtacgttaacaaactaagttaactttaacgtagtttacgggttttaccggaaccgaaacgggtaacctaaccggtaaacttaaaccgtaaaagttaaaccgtacgttcgggttacgtccgtacgtaaccctaacgttacgttaccgtttgtttacccttttacccgttcccctttacccggaccttacttcgttagttacctttaaccgg

SEQ ID NO: 139374 - DNA, 640 bp, Homo sapiens
  misc_feature: GYAE6OF01CAXOY.46.67.G01.1.454.CMB.1.raw
  modified_base (395)..(395): a, c, t, g, unknown or other
  misc_feature (395)..(395): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtccctcacctgcgctgtctctggtgcctccatcagtagtggtttcttcgtggggctgggtccgcagctccgaggggagggctaggaatacattggaagtgtctctcagtagtggaggttcctaattacagtccgtctctcaagagtcgagtcaccatactctctggacacgtccagcaatctacgtttcctagagtatcgtagttctggtcgaccgtccgctcggacgtacggggtcttttattacgngttgcggagagacgggtctaattatgttagttttggtagttggttactttcgactaacccgttaggacgttcgggaccgggggtcctccggtaacccccggtggggtacccgagggtaacgttaaccgttggtacctaccgttcctccttacgccctaccgacccgaacgggtcccaacggttcccggttcccctttcccccgcggtacccctaccccttaccgtaccccaaaggtccgtacccg

SEQ ID NO: 139375 - DNA, 625 bp, Homo sapiens
  misc_feature: GYAE6OF01AP9JF.46.67.G01.1.454.CMB.1.raw
  modified_base (165)..(165): a, c, t, g, unknown or other
  misc_feature (165)..(165): n is a, c, g, or t
  modified_base (232)..(232): a, c, t, g, unknown or other
  misc_feature (232)..(232): n is a, c, g, or t
  modified_base (246)..(246): a, c, t, g, unknown or other
  misc_feature (246)..(246): n is a, c, g, or t
  modified_base (283)..(283): a, c, t, g, unknown or other
  misc_feature (283)..(283): n is a, c, g, or t
  modified_base (317)..(317): a, c, t, g, unknown or other
  misc_feature (317)..(317): n is a, c, g, or t
  modified_base (333)..(333): a, c, t, g, unknown or other
  misc_feature (333)..(333): n is a, c, g, or t
  modified_base (497)..(497): a, c, t, g, unknown or other
  misc_feature (497)..(497): n is a, c, g, or t
tcagactagcagtacacgaccggtgctcgatttagagtatacatattgggtttggggacctcctgtgcaagaacatgaagcacctgtggtttgtcctcctgctggtggcagcctcccagatgggtcctgtccctggtgcaactgcaggagtcggcccagactggngaggccttcggaagccctgtcccctagacctgcgctgtctctggtgcctcatcagtgtgtttctcgngggctggtccggangctccaggaggctggatcattggatgtctctcatagnggtagttcctattacgagttccgtctctacaagngtcgtacgtcaacctntatctcgtggactacgtccgaagctaatcgtaacgtttttccccagaaagtcttaggacgtttccgtggttcgaccggtccgtacgtcggtaacgtacgggttcgtttaattacgtcgtggtccgaggtaacgcgggtattagtttaagtgttattttacgggngttcggtttaactttcggaacctacgtagacgtcggtaccgggcttcccggaccggttccggggactaggggtacttaccgggtcttaccgggacccttaccgttaccgtaccgtcccgttaaacccg

SEQ ID NO: 139376 - DNA, 711 bp, Homo sapiens
  misc_feature: GYAE6OF01DOPBG.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgagggccttcgggacgaccctgtcccctcacctgcgctgtctctggtcgcctcatcagtgttggtttctcgtggggctgggtccgcagcctccgaggggagggctaggaatactagttggagtgtctctcagtaggtggtacggtttcctaagttacacgttccgttcctactacgaaggtcgtacgacggttccaacctattacgttcctcgacggacctaccggtccaagtctaaactccttacgttttcccgaagtaatagttgtacgtttctggtccggaccgtcccgcgtacggaaccggtacggggtttacttttagttaccgtggtcgacggtaaggacggaacgggttcttaagtttcgtagttttacgggttttgggtaaggtttggttttaacttccggaaccctaacggttgacggttccggggcgggtcctaccgggcccgtggggaaccggtagggacttcgtggtaccctcgttccgttccgtaccgccctacccgacgtaccgggccctacgttcccggtacccctcccggtaccgccctacccgtccctaaccgaggtccctacccgg

SEQ ID NO: 139377 - DNA, 908 bp, Homo sapiens
  misc_feature: GYAE6OF01AKNJ6.46.67.G01.1.454.CMB.1.raw
  modified_base (110)..(110): a, c, t, g, unknown or other
  misc_feature (110)..(110): n is a, c, g, or t
  modified_base (120)..(120): a, c, t, g, unknown or other
  misc_feature (120)..(120): n is a, c, g, or t
tcagactagcagtacacgaccggtgctcgatttagagtatacatattgggtttggggacctcctgtgcaagaacatgaagcacctgtggtttgtcctcctgctggtggcngcctcccagntgggtcctgtccctggtgccaactgcaggagtccgggcccacgactgggtgacggtcccttcgggacgaccccttcgtcccctccaccgttggccgtccttcggtccttacgtcggggtccgtaccccttccagtcccgtaggttcgtttggttttcccttcgtgggggggtccttcgggggtcccgactaggtccctaccccggtagggggtaacgggggtcctacgggaacttaaccgtaggtttagggaacgtcggttcctccgttaagtacggttaagggtcggggtaaccggttttaccctaggtttaaacccgagggtttccccttcctttccggtacctaaaggggtaccgttacggaccgttaccgaaccgttacggttattacccgttcgttaaccgggaccggttaacccgtcccgtaaggtaccttaaacttccgggttaccgttttttacccccgaaggtaaacgttaacccgttggtttacgtttaccgtttcgggtaccggtaaccccggttcccgacccgtttgggtaaacccggtacgggttaccgtttttaacgtcggttacgtccggttacggaacggtggtaccggtacttacgtaagtttcgtaagttttggacggtttggtttacctttacggacttaccgtgttaaccgtcgggtaccgggttaccctcggtcccccgggttgggacccgtaagggttaaacccgggccgttcgggttacccggaaccggttttcccacccggtttccgtaccggtaacccccggg

SEQ ID NO: 139378 - DNA, 627 bp, Homo sapiens
  misc_feature: GYAE6OF01D9L1V.46.67.G01.1.454.CMB.1.raw
  modified_base (171)..(171): a, c, t, g, unknown or other
  misc_feature (171)..(171): n is a, c, g, or t
  modified_base (209)..(209): a, c, t, g, unknown or other
  misc_feature (209)..(209): n is a, c, g, or t
  modified_base (428)..(428): a, c, t, g, unknown or other
  misc_feature (428)..(428): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttctcgtggggctgggtccgnagctccgagggagggctggaatacagttggaagtgtctctacagtaggtggacggttcctattacacgttccgtctctcaagagtcgagttcaccatatctcgtggacacgtccagcaatctacgtttttcccagaagtatcgtagtttctggtcgaccgccgacgtcgtaacgaccgggtcttttaacgtacgttgtcgacggaaggtagaccggttnttaagttagttagttagttttggagttggtttacttcgactacccgtagacgtcgggacgggtcctccggacccggtgggaccgtagggtaacttcggtcgtctacccgttctccgttacgccctaccgaaccgacggtccctacggttcccgttcccgttccccgtcggccctacccctaccgtaccacgcgtacccg

SEQ ID NO: 139379 - DNA, 593 bp, Homo sapiens
  misc_feature: GYAE6OF01DTZ6Y.46.67.G01.1.454.CMB.1.raw
  modified_base (218)..(218): a, c, t, g, unknown or other
  misc_feature (218)..(218): n is a, c, g, or t
  modified_base (228)..(228): a, c, t, g, unknown or other
  misc_feature (228)..(228): n is a, c, g, or t
  modified_base (289)..(289): a, c, t, g, unknown or other
  misc_feature (289)..(289): n is a, c, g, or t
  modified_base (292)..(292): a, c, t, g, unknown or other
  misc_feature (292)..(292): n is a, c, g, or t
  modified_base (327)..(327): a, c, t, g, unknown or other
  misc_feature (327)..(327): n is a, c, g, or t
  modified_base (577)..(577): a, c, t, g, unknown or other
  misc_feature (577)..(577): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctcctgtctgcaaccggtgggagacagtgtccaccatcacttggcggnaagtcgaacntgactacttattaatgtatcaacatagaccgagggaccgaccctaagcctactaatctatnctnctctctagttgacgaaggtcggtccagtcgagttnagtgcaggtgatcgtagggacagtactttcacttctcactctactagtaatcgtgaactacgtagtaaagttctttagacttaactttacttacgtagttacaacgtaagtaactttaactagtttcggtttaacccggacgtaaaagggacctaacgtaaccttaaactaaaagttaaaccgaactagggttgaccgtcgtaaccgtaacctagtttctacgttacttaccgtcgttacccgtacccgnttaactccgtgtaacc

SEQ ID NO: 139380 - DNA, 709 bp, Homo sapiens
  misc_feature: GYAE6OF01E0BP4.46.67.G01.1.454.CMB.1.raw
  modified_base (306)..(306): a, c, t, g, unknown or other
  misc_feature (306)..(306): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccagggaaggggctggaatacattggaagtgtctctcatagtggaggttcctattacagtccgtctctcaagagtcgacgtacaccatantctcgtacgtacacgtaccacgactaactacttacgtttaccgtacgtaagtagtacgtacgttcgttcgtaccgacccgccgtcgtacgtaccggtacggttacgtttacgtttacgttacggtcggacgaacggtacggtacggtacgttagttagttagtttagttttaggttaggttaggtttacgttaccgtacccgtaccgtacgtacggtaccgggtacggggtaccgtacccggtacccggtaccggggtaccggtaacggtaacgttacgttcggtaccgtaccgtccgtaccgtaccgtcccgtacccgtaacccggaaccggtacccgtaccgttacccgttccccgttcccccgttcccggtacccgtacccctccccgtacccgtaaccg

SEQ ID NO: 139381 - DNA, 750 bp, Homo sapiens
  misc_feature: GYAE6OF01D3HVP.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctccatcctcctgtctgcaaccggtgggagacagtcgtccaccatccacgttcggcccgggacaaggtccggaactattcgaacctaccttaattttaaagttggtatacaactatacgaccgacgggaccggtacccgtaacgtacctacctaatacttatgtctgtctactacgtacgttacgacgtaacggtacgggtaccgtacgtacggtacggttcgaggtttttttacggacgtaggtggtacgtcggtagggtaacgtaacgtacgtttactacctaccgtacctaaccgtactaacgtaacgttaactacgtacggtaacgtaacggtaacgtaagttaagtttacgtaacttaacctttaactttaacgttacgtaacgtaacgtaacgttaaacgttaacttaacgtttacggtttaaccggtaaccggtaaaccggaaccgtaacgtaaaccttaaacgttaaaacgttaaaccgtaacgttacggtacggtacgtacgtaccgtacctacttaccgttacgttaccgttacctaccgttacccgttacccgtaccctacttaccgttacgtaaccg

SEQ ID NO: 139382 - DNA, 825 bp, Homo sapiens
  misc_feature: GYAE6OF01C8BR0.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggccccacgactgggtgaggccttcggagaccctgtccctcacctgcgctgtctctggtgcctcatcagtagtggtttcttcgtggggctgggtccgcagctcccgaggggaaggggctggaatacagttggaagtgtctctcatagtggagttcctatactacgtccgtctctcaagagtcgagtcacctatatctctaggaccacgtccagacaatctacgtttccctagaagatgtagttcgtgtcgtacccgccgtctcgaccgtacggggttactttaagttaaccgttggtacggacggaaggtaacggacgggtacctttaagtttagttacggtttaaggtttttacgggtagggtttaggttttacgtttaccgtaacccgtaacccgtaaggtaacgttcccggggtaccggggggtcccgttacccggtaccccccgggtacgggggggtaaccccggtaacgggggtaaccgttaccggttacgggggttacccctaccccgggtttccccgttaccccggttttaaacccggaccccccgtttaaacccccgaaacccccggggtaaaacccgggggtccccccgttacgggttaccccccgggttttcccccccggtttacccccccggtacccgggtaccccccttaaccccccctttcccggaacccccgtaaaccgggtacccgtaacccccggg

SEQ ID NO: 139383 - DNA, 673 bp, Homo sapiens
  misc_feature: GYAE6OF01AMCPO.46.67.G01.1.454.CMB.1.raw
  modified_base (204)..(204): a, c, t, g, unknown or other
  misc_feature (204)..(204): n is a, c, g, or t
  modified_base (463)..(463): a, c, t, g, unknown or other
  misc_feature (463)..(463): n is a, c, g, or t
  modified_base (618)..(618): a, c, t, g, unknown or other
  misc_feature (618)..(618): n is a, c, g, or t
  modified_base (661)..(661): a, c, t, g, unknown or other
  misc_feature (661)..(661): n is a, c, g, or t
tcagactagcagtacacgaccggtgctcgatttagagtatacatattgggtttggggagtctcggtcaggacacagcatggacatggagggtccccgctcagcctccgtggggctcctgctactctggcctcgaggtgccagatgtgacatcgagctcgacccagtcctccatccctccctgtctgaccgaaccgggtgggaanacgtagtcgtaccacctactcctacgttcgggcccggtacaacgggtaccgaacctagttacgaaccttaaccgtttaatttaaagttgtactaccaaactagtacggaccgaacgggtacccgaccctaagcctactaagtctacgtgtctcgactacgtccgtaggtttacgaacgtaacgggtccggtacctagtcgtaggttcgaggtcggacgtaggtgacgtcggtagactagttcttcgactcctacaactntacgtatactcgtacgacgtagtagtaattacttacgaacttaatctactacgtaactaacgtaattaacttaacgttacgttacgttaaccggaacggtaaccgtacgtaacgttaaacgtaactaaaacgttacgacgttaggccgtcgtaanaccctcgttatcgttacttactacgtcccttccgtaccctacnttccgtgtaccg

SEQ ID NO: 139384 - DNA, 795 bp, Homo sapiens
  misc_feature: GYAE6OF01DHJR1.46.67.G01.1.454.CMB.1.raw
  modified_base (172)..(172): a, c, t, g, unknown or other
  misc_feature (172)..(172): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggccttcggagaccctgtccctaacctgcgctgtctctggtncctccatcagtagtggtttcttcgtggggctgggtccgcagcctccgaggggagggctaggaatactagttggaagttgtctctactagtaggtggtacggttaccttaattacacgttccgtcttctacgaagacgtcgacgtccaccatactctcgtggactaccgtccagactaatctacgttttccctagtaactagtgtagttcgtgtcgacccgtccgctacggtaccgtacgggttacgttttaattaccgtggttaggaccggtaggaacggtaaccggtacgttaagtttagttaggtttagtttttagggtagggtttaaggtttactttaccggaacctaccccgtagtacggtccgggtaccggggtacccgtcccgggtaccccgggtcggggtaccgggaacgggtaaccgttacggttccgggtacccgttacccggttaccttacccgttaacccgtccccgttacccgaaacccgggtaacccgggtacccccgtaaccggtttccccgggttccccccgttacccccccggttaccccggacccccgttaccccccgttaccccgtaaccccggtaaaccggcccggtaccccgttaccccgggg

SEQ ID NO: 139385 - DNA, 971 bp, Homo sapiens
  misc_feature: GYAE6OF01B4Y2R.46.67.G01.1.454.CMB.1.raw
  modified_base (194)..(194): a, c, t, g, unknown or other
  misc_feature (194)..(194): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgccaaccggtggganacagtgtcaccatcacgttcggccgggacaaggtacggaactattacgaacctaacctttaattttaaaagttcggtaattaccaaacgtaagttaacggaaccgaacggggacccggtacccctaagaccttacctaatcttaacgtcggtcttacgcctaacgttacccgttaggtttacggaaccgtaaaacgggttccggggttaaccccaggttaccgggtaaggttccgtaaggtacgggtaccgtagggtcggtaacgttacggtacggggtaactaacggttaccgttttaccgtaccctttacccgttaacccgtaacccgttaaacgttaccgttaaacggtttaaccgttaccggttaaccgtaaccggttaaaaccggttagggttaaaacgtttaacgtttttaacggaacccttttaaaccgtttttaacgtttaaaccgtttacggttaaaccctaaaaccggttaaagtttaaacgttttaaacccggtttaaagttttacccggggtttttaaccgggaaaccccggttaaaacggggtaaacccgttaaacccggttaaaacccttaaaacggtaaaaacccgttttaaaaccgggtaaaccggttacgggttaaccgggttacccgtaaccggtaaaccctaaccggttaaacgtttaccggtttacccggttttaaaccttacccggttttaaacccgttacccccgttttaccccgtaacccggtttacctttaaccggttaccgtttaaaacccg

SEQ ID NO: 139386 - DNA, 623 bp, Homo sapiens
  misc_feature: GYAE6OF01DI63U.46.67.G01.1.454.CMB.1.raw
  modified_base (251)..(251): a, c, t, g, unknown or other
  misc_feature (251)..(251): n is a, c, g, or t
  modified_base (315)..(315): a, c, t, g, unknown or other
  misc_feature (315)..(315): n is a, c, g, or t
tcagactagcagtacacgaccggtgctcgatttagagtatacatattgggtttgggggacctcctgtgcaagaacatgaagcacctgtggtttgtcctcctgctggtggcagctcccagatggtcctgtccctggtgcaactgcaggagtcgggcccacgactggtgaggccttcggagaccctgtccctcacctgcgctgtctctggtgcctccatcagttagtggtttctcgtggggtctggggtccgnagctcccgagggaggggctggaatacagttggaagtgtctctcatagtggtagttcctattacngtccgtctctcaagtagtacgagtccacctatatctcgtggacacgtccagccaatcagtttttcccagaacgtatgtagttctggtcgacccgcctacgtggaccgtacgggtacgttttacgttacgtggtgcggagtaaggtacggacttagtttagtgtttagtttttgggagtttaggtttactttcgacctaccgtaagacgtccgggaccggggtctccgggacccccgttggggcccgtaaggggtaaacttcggtacggttccctaacccgttccttaacccgttgtcccctaacccgg

SEQ ID NO: 139387 - DNA, 782 bp, Homo sapiens
  misc_feature: GYAE6OF01ALEQB.46.67.G01.1.454.CMB.1.raw
  modified_base (171)..(171): a, c, t, g, unknown or other
  misc_feature (171)..(171): n is a, c, g, or t
  modified_base (297)..(297): a, c, t, g, unknown or other
  misc_feature (297)..(297): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttctcgtggggctgggtccgcagcctcccgaggggaaggggctaggaatacagttgggaagtgtctctcagttaggtggtaggttcctattacagtccgtctctcaagngtcgagtcacctatatctcgtggaccacgtccagctaaatctacgttttccccagaagtatgtagtttctggtacgacccggtccgtcgtacggtaccgtacggggttacgtttttaacttaccgtgtacggacgggtaaggtacggaaccggtacttaagtttacgttaggtttaaggttttttggggaacggtttttagggtttaaccgtttttaccggtaacccgtaaccccggttaaggtacggttaccggggtaccgggggtcccgttaccccggtaccccgggttcggggggacccgaaaggggttaacctaaccgggttcggtacccgtacccggttccgttaccccgttccggtacccgtacccgaacccggtaaccgggtccccgttaacggttcccccgggtttccccgttacccccccggtcggtacccccgttacccccgttacccctacccgaaacggtcccgtacccccgg

SEQ ID NO: 139388 - DNA, 607 bp, Homo sapiens
  misc_feature: GYAE6OF01A4DND.46.67.G01.1.454.CMB.1.raw
  modified_base (332)..(332): a, c, t, g, unknown or other
  misc_feature (332)..(332): n is a, c, g, or t
  modified_base (338)..(338): a, c, t, g, unknown or other
  misc_feature (338)..(338): n is a, c, g, or t
  modified_base (460)..(460): a, c, t, g, unknown or other
  misc_feature (460)..(460): n is a, c, g, or t
tcagactagcagtacacgaccggtgctcgatttagagtatacatattgggtttgtcctcctgctggtggcatctcccagatgggtcctgtccctggtgcaactgcaggagtcgggcccacgactggtgaggccttcggagaccctgtccctcacctgcgctgtctctggtgcctccatcagtagtggtttctctggggctgggtccgcagctcccaggggagggctggaatacattggaagtgtctctcatagtggaggttcctattacagtccgtctctcaagagtcgagtcaccatactctctggacacgtccagcaatcagttttcccngaacgntgagttctgtacgacccacccgtctagaaccgtacggggtacgttttacttacgtggtgcggaagaggacggtcttaattagttgtagtttttggagtttggttatttcgacctaccttagngtcggtacggggtctccggaccccgtgggccgtagggatacgtggtccgtaccgtctccgttacgcctacccgacgtacggccctaacgttccggtacccttccccctcgggtcccctacccctccctacccgaagtccgtaccccg

SEQ ID NO: 139389 - DNA, 587 bp, Homo sapiens
  misc_feature: GYAE6OF01ER5X4.46.67.G01.1.454.CMB.1.raw
  modified_base (194)..(194): a, c, t, g, unknown or other
  misc_feature (194)..(194): n is a, c, g, or t
  modified_base (218)..(218): a, c, t, g, unknown or other
  misc_feature (218)..(218): n is a, c, g, or t
  modified_base (227)..(227): a, c, t, g, unknown or other
  misc_feature (227)..(227): n is a, c, g, or t
  modified_base (288)..(289): a, c, t, g, unknown or other
  misc_feature (288)..(289): n is a, c, g, or t
  modified_base (292)..(292): a, c, t, g, unknown or other
  misc_feature (292)..(292): n is a, c, g, or t
  modified_base (325)..(325): a, c, t, g, unknown or other
  misc_feature (325)..(325): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatccctccctgtctgcaaccgtgggancagtgtcaccatcacttgccgggnaagtcgganattgactacctattaaattgtatacaacatagaccacggacgccctaagctccaatcatannctnccattcgatttagcgtaactgggtccctagccnggttcagtggacagtggatcgtaggtacagtacttcactctacactactacgtagtactcgtacgaacgtagtaagtacttacttactacttaactactactactaactaacgtaattaacgttaacgtaacgttacggttaccgtaacggtaacgaacgtaaacgtaactaaacgttaaacgtaaacgtacgtacgtacgtcgtacgtacctactactacgttacgttaccttactacccttcccgttcccgtaccgtacg

SEQ ID NO: 139390 - DNA, 659 bp, Homo sapiens
  misc_feature: GYAE6OF01AGWQJ.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtgggctgggtccgcagcctccgagggaagggctggaatacagttggaagtgtctctcgattaggtggtaggttcctattacgagttccgtctctacaagtgtcgagtcacctatactctcgtcggaccacgtccagctatcgtacgtttccgagaagtatagtagttcgtcgtcgaccgccgtctcgacgtacgggttctttaattacgtgtgcgtagacgacgtatagtttagtagttagttttggtagttggtttagttaccgaccgtaccgtagtacggtacgggaccgggtccgtacccggacccgtcgggaccgtagggtaaccgttcgtccgggtacctaccgttccgttacccgtaccgtacccctaccgaacccggaccggtcccgtacggttcccgtccccgttacccccgtcggtacccctaccccttaccctaccgtaacggtccgtaccccgg

SEQ ID NO: 139391 - DNA, 703 bp, Homo sapiens
  misc_feature: GYAE6OF01EQLXV.46.67.G01.1.454.CMB.1.raw
  modified_base (217)..(217): a, c, t, g, unknown or other
  misc_feature (217)..(217): n is a, c, g, or t
  modified_base (223)..(223): a, c, t, g, unknown or other
  misc_feature (223)..(223): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactgggtgaggtccttcgggaacgcccctgtccctcacctgcgctgtctcgtggcncctccntcgagttgtcgtttctcggtcgggctcgggtccgcgacgtccgtaccggaaggggtacgggtcgtacggtaaactacgtaaggttaggtaacgttcgtccgtactacgtaagttaggttaggtacggtttaccttaagttaccgtacgttcccgtctctacgtaagacgtacgacgtaccaacgtactgtctcgtacgactaccgtaccagactaactcgttaccgtttccgaagtactacgttagttcgttcgtacgtaccggaccgtccgacgtacgaaccggtacggttacgtttacgttacggtggtacgacgtaggacgtacgtacttagttatagttttagtttagggttagtttaggtttacgttacccgtactaccgttaggtacggtacggtcccgggtactacccggaccggtcggggacaacgggtactacgtcggtaccaccgttccgttcgtaccgcctaaccccgg

SEQ ID NO: 139392 - DNA, 796 bp, Homo sapiens
  misc_feature: GYAE6OF01BT8VX.46.67.G01.1.454.CMB.1.raw
tcagactagcagtacacgaccggtgctcgatttagagtatacatattgggtttggggagtctcggtcaggacacagcatggacatgagggtccccgctcagctccgtggggctcctgctactctggctccgaggtgccagatgtgacatcgagctgacccagtctccatcctcctgtctgaccaaccggtgggacgacagtcgtaccaccatcctacgttcggcccgggacgtaaacggtccggaactagtttacgaacctaaccttaattttaaagttcggttaactaccaaacgagttaaccggaaccgacggggaacccggtacccctaaaggtccttacccgttaatcgttaacgtcgccgtcgctaaccgttccgtaggttttacgacggtaaaggtccgggtacctagttccggtaggtttaccgaggtcggtacgaggttacggtaacttcgggtacggggaactaacgttacttaccccgtacttaccgtaccaacccgttaagttacccgtaagttaacttacgtacggtaactacggttaggtaacgtacgttttacgtacttaacctttacgttacgtacgtaacctaaacgtagttaactttaaccgtaacgtttacggttttaccgaaccggtaacggtaaccgtaacgtaaacttaaaccgtaaacgttaaaccgtaacgttcggttaaccggtaccgtaccgtaccgtacttacgttaccgttcgttacgttacccttacccgttcccgttaccccgtattccgttacggtacgttaaccg

SEQ ID NO: 139393 - DNA, 644 bp, Homo sapiens
  misc_feature: GYAE6OF01EXUPT.46.67.G01.1.454.CMB.1.raw
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
  modified_base (228)..(228): a, c, t, g, unknown or other
  misc_feature (228)..(228): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatccctccctgtctgcaacggtggganacagtntcaccatcacttgccggcaagtcgaacnttgacaccttattaaattggtatacaactatacgaccgaggggaccgaccctaagcctacctaatctatgctcgctactcctagtttagacgtaaaggtcgggtaccctagtacggtaggttacgaggtggacgtaagtgggattcggagggtactaaggtactttacctactcctacaacctatacaagttaacttcgtagactaacggtagtaattactttagacttaacttattactataacaacgtataaactttactaagtttcgtttaccggaccgtaacggactaacgtaacttaaacttaaagttaaaccgtaacgtaggtacgtacgtacctacgtaaccttacttacgttccgttacctttacctacgtttccccgttaccccgaccttacttaccgtcgttaacg

SEQ ID NO: 139394 - DNA, 673 bp, Homo sapiens
  misc_feature: GYAE6OF01ALLB0.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgccaaccggtgggagacagtgtccaaccatcacttcggccgggacaaggtcggaactattgacctaccttaatttaaattggtatacaacatacgaccgagggaccgccctaagctacctaatctatcgactgctactctagtttcgacgtaaggtcgggtaccagtcggaggttcgaggtgcgtaggtggagtcgtagggactagtactttacactctaccacctagtacgtagttaactctacgtaacgtaacggtacgtaagttacttttacggaaccctttaaacttttaacgttaacgttacgtaactaaacgtaagttaaacttaagttaaccgtttcggttttaccggaaccggtaaacggacctaaaccgtaactaaaacgtaaacgttaaaccgtaacgttcgtacggtcctacggaaccctaacgttacttcgttcgttacctttacctaccgtttaccctcccgacttactacgttcgtaac

SEQ ID NO: 139395 - DNA, 643 bp, Homo sapiens
  misc_feature: GYAE6OF01EEP78.46.67.G01.1.454.CMB.1.raw
  modified_base (211)..(211): a, c, t, g, unknown or other
  misc_feature (211)..(211): n is a, c, g, or t
  modified_base (248)..(248): a, c, t, g, unknown or other
  misc_feature (248)..(248): n is a, c, g, or t
  modified_base (392)..(392): a, c, t, g, unknown or other
  misc_feature (392)..(392): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccagactggtgaggccttcggagaccctgtccctcacctgcgctgtctctggtcncctccatcagtagtgtttctcgtggggctgggtccgnagctccgagggaagggctggaatacagttggaagtgtctctcgattaggtggtaggttcctattacaggtcccgtctctcaagtgtcgagtcacctatactctcgtggacacgtcagtacaatctacgttttcccaggaacgtntagtacgttctggtacgacccgtcgctacggacgtacgggttctttacgttacgtggtcgcgtaaggacggtacggtacctatttagtggttaaggttttggtagttaggttttacgtttaccgtaaccgtacccgttaggtaacgttccgggaccgggggtcctcccgggtaccccggtggggacccgagggtaaacgttcgtaccggtccgtacccgttaccttaccgttaccggtccctaaccccggg

SEQ ID NO: 139396 - DNA, 684 bp, Homo sapiens
  misc_feature: GYAE6OF01ESV6P.46.67.G01.1.454.CMB.1.raw
  modified_base (193)..(193): a, c, t, g, unknown or other
  misc_feature (193)..(193): n is a, c, g, or t
tcagactagcagtacacgaccggtgctcgatttagagtatacatattgggtttgggggagtctcggtcaggacacagcatggacatgagggtccccgctcagctcctggggctcctgctactctggctccggaggtgccagatgtgacatcgagctgacccagtctccatcctcctgtctgcaacggtggganacagtgtcaccatcacgttcggccggacaagtcggaactattcgactaaccgttaatttaaagttggtaactacaaactagtacgaccgtacgggaccgaccctaagtcctacctaatctatcgctcgcactcctaggtttgacgtaacggtcgggtaccctagtacgaggttacaggtcggactaggtacggtacgttacgtacggggactaaggtactttccgacttccgtactaacctattacgtaagtaacttcgtaagtaacgaaacggtttaagtaatttacgtttttaagtaaactttaacgttacttacggaacctaaagttaaacgtaatttacgttaagtttcggtttaaccgacgtaaacgggaacctacgtaaactaaacgttaaacgtaagacgttagtacgtacgtacgacttaccgtatttcgtcgttccttacgtacctttcccgtaccccgtattatccgttagacgtttaccg

SEQ ID NO: 139397 - DNA, 667 bp, Homo sapiens
  misc_feature: GYAE6OF01BPBSK.46.67.G01.1.454.CMB.1.raw
  modified_base (196)..(196): a, c, t, g, unknown or other
  misc_feature (196)..(196): n is a, c, g, or t
  modified_base (375)..(375): a, c, t, g, unknown or other
  misc_feature (375)..(375): n is a, c, g, or t
tcagactagcagtacacgaccggtgctcgatttagagtatacatagttggggtttggggagtctcggtcaggacacagcatggacatgagggtccccgctcagctcctggggctcctgctactctggctccgaggtgccagatgtgacatcgagctgacccagtctccatcctccctgtctgccaaccggtggganacagtcgtccaccatcacgttcggccggacaaggtccgaactattgaacctaccttaatttaaagtgtatacaacatagaccgagggaccgaccctaagctacctaatctatcgctgacctaactccgttagtttacgacgtaacgggttccgggtaccctagtcggtacggtttacgnggttacggacgtaggtacggtacgtcgtagggaactaggttactttacccgactccgttaaccacgtactacgtaagttactccgtaggtaacctaagggttagttaactttacgtttacgaaacttaaccgttttactaccgtaagtaaccctaaagttacctaaactttacgtaagttttcggtaaccggaactaagggacctaacggtaataaacgtaactaacgtacgtggacgtataccgacctacttacttgtctaccttgacttcccttacacctatcctagtac

SEQ ID NO: 139398 - DNA, 666 bp, Homo sapiens
  misc_feature: GYAE6OF01AE08T.46.67.G01.1.454.CMB.1.raw
  modified_base (191)..(191): a, c, t, g, unknown or other
  misc_feature (191)..(191): n is a, c, g, or t
  modified_base (195)..(195): a, c, t, g, unknown or other
  misc_feature (195)..(195): n is a, c, g, or t
  modified_base (224)..(224): a, c, t, g, unknown or other
  misc_feature (224)..(224): n is a, c, g, or t
  modified_base (605)..(605): a, c, t, g, unknown or other
  misc_feature (605)..(605): n is a, c, g, or t
  modified_base (651)..(651): a, c, t, g, unknown or other
  misc_feature (651)..(651): n is a, c, g, or t
  modified_base (657)..(657): a, c, t, g, unknown or other
  misc_feature (657)..(657): n is a, c, g, or t
tcagactagcagtacacgaccggtgctcgatttagagtatacatattgggtttggggagtctcggtcaggacacagcatggacatgagggtcccgctcagctcctgggctcctgctactctggctccgaggtgccagatgtagacatcgagctcggacccagtctccatcctcctgtctgcaaccgtgganaccngtcgtacacctatccacgttggccggganagtccggaatacgttcgacctaaccttagtttaaactcggttataccaatactacgaccgtaagggacccgaccctaaacggtcctacctaagtactaacgtcgtactgcctactccgtacgtttcgaacgtaacggtccgggtacctacggtacgacggttctacggtggaccgtagtcggtacgtcgttacggggaactacgttagttacccagtaccctaccgtactacgttataccgtacttacgtacgtactaacgtagttaacgtattacgtactacgttagtaccttagtactaaccgtaataacgttataacgttacgttacgtacgaacgtactaaccgtaacgtactaaacttacgaacaggttcgacgtnaaccggtaaccttgtactcgtacctaccgtactacctacccgtaanccttancggtaaacc

SEQ ID NO: 139399 - DNA, 676 bp, Homo sapiens
  misc_feature: GYAE6OF01DXLK7.46.67.G01.1.454.CMB.1.raw
  modified_base (217)..(217): a, c, t, g, unknown or other
  misc_feature (217)..(217): n is a, c, g, or t
  modified_base (341)..(341): a, c, t, g, unknown or other
  misc_feature (341)..(341): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccggtgggagacagtgtcaccatcacttgccgggnaagtcggaacattgacactatttaaatggtatcaacatagacaggaccggccctaagctctaatctatgctgcatccagtttgacaaaggtgggtaccaagtcgtagtcagtggcagtgatcgngggacagtatttacactctacaacctatacgtaagtaatctaggaacaacggtagtaaacgttatttacgaacttaaactttactttagtacgttaaccaaacgtaaggttaaatttaacgttaacgtttaggttttaaccgggaaccgtaaaacggggtaaacctaaccggtaaacttaaaccgttaaaaaacgtttaaacccggaaaacgttacggttaacgggtaccttacggtaacccgtaacccttaagtttacccgtttagttacccttttaccgaaaccctttccccttaacccccggtacccttaaactttaccgttagttaaaccg

SEQ ID NO: 139400 - DNA, 756 bp, Homo sapiens
  misc_feature: GYAE6OF01DVGPK.46.67.G01.1.454.CMB.1.raw
  modified_base (289)..(289): a, c, t, g, unknown or other
  misc_feature (289)..(289): n is a, c, g, or t
  modified_base (329)..(329): a, c, t, g, unknown or other
  misc_feature (329)..(329): n is a, c, g, or t
tcagactagcagtacacgaccggtgctcgatttagagtatacatattgggtttggggagtctcggtcaggacacagcatggacatggacgggtccccgctcagcctccgtggggctcctgctactctggctccgaggtgccagatgtgacatcgagctcgacccagtctccactccctccctgtctgacgtaccggtgggacgactagtgaccacctatcctacgttcggacccgggacgaacggtacgaactattacgaacctaacttaagtttaatagtactacaanatacgaccggagggacccgacctagacctacctaatctancgctcgctacttccgtagttgaacggtaacgggtccggtaccaggtacggtaggttcaggtcggtacgtaggtcgtaacggtcggtagggaacttacggttacttaccaccgtacctacctaaccgtacgttaacgtaacttaccgttcgtaacggtaaccgttaaggttaagttaaacgttttacttttaacgttaaactttaacggttaactaacgtaactaaacgtattaacgttaataacggtttccgttaacggaacggttaaccgaactaaacgtaaaccgttaaacgttaaaaccgttaacggacgttacggtaccgttacgacgtaacccgtacttaccggttactttaccgttaccgtttaccctacccgtttaccccgtttacccaacggttaccttcgggtaacgtacgttaccgg

SEQ ID NO: 139401 - DNA, 777 bp, Homo sapiens
  misc_feature: GYAE6OF01CU6E8.46.67.G01.1.454.CMB.1.raw
  modified_base (248)..(248): a, c, t, g, unknown or other
  misc_feature (248)..(248): n is a, c, g, or t
  modified_base (260)..(260): a, c, t, g, unknown or other
  misc_feature (260)..(260): n is a, c, g, or t
  modified_base (287)..(287): a, c, t, g, unknown or other
  misc_feature (287)..(287): n is a, c, g, or t
tcagactagcagtacacgaccggtgctcgatttagagtatacatattgggtttgggggacctcctgtgcaagaacatgaagcacctgtggtttgtcctcctgctggtggcagctccagatgggtcctgtccctggtgcaactgcaggacgtccgggcccacgacgtggtcgacggtccctttcgggaacgtccctcgtcccctcacctgccgtctgtctcgtggtcacctcatcagtgttgttctcgngggctgggccgnacgcctacggagggaggctggaactanagttggaagttcgtactcgtacgagttacggtgggtacgtttccttagttacgtacgttccgtactactacgaagtcgtacgacgtaccacctatacgtctcgacggacctaccgtacgacgactataccgtttacgttttcccgaagtaacgtacgtaggttacttcgtggtaccgacccggtcgtacgtaggtaaccggtacggggttacttttaacgttccgtggtacggtacggaacgtacggtacggttactttaacgttaggttcggtttaaggtttttgggaacgtttacggttttaaccgtaccgtaacccgtaaccgttaaggacggttacccggggaaccggggttccgtaacccccggggtacccgggtaggggggtaacccgtaaggggttaaaccccgttacgggttacccgggtacccccgttttaacccggtacccttttaaccccgggtggtaacccccccgttaaaccccggg

SEQ ID NO: 139402 - DNA, 899 bp, Homo sapiens
  misc_feature: GYAE6OF01CPBW5.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcgaggagtccgggcccacgactgggtgaggtccttcgggacgacccctgtcccctcacctgccgctgtctcgtggtctcctccatcagttagttggttttctcgtggggtcttcggggtcccgcacgtccgtccggaggggggacggggtcgttagggaataaccgtagtttagggtaaagttcgtacttccttcgaagttaggttgggtacggtttcccttaacgtttacgtacggttcccgttcttcctacgaaggtacgtcgtacgtaccaacctattactctccgtaggacctaccgtcagtacaacttcctacgttttacccgagtaacgtatacggtagtttcgttcggtcggaccccggtccgtcgttacggaaccgtacgggtttctttaacgttaccgttaggtacgtccggtaaggaccggttacggtactttaaagttttaacggtttacgtttttagggtttttttaacggggtaacgggtttttacgggtttttaacgtttttaaccccggtaacccgtttaaccccgggtttaaagggtaaaacccggtttcccggggggtaaacccgggggggttccccgttaacccccggggtaaaccccccggggttaggggggttaaccccgggaaacggggttttaaacccggtaccccgggtttaccggggtttacccccgttaaacccccgggttaccggttttacccccgttaacccggtcccccccggttaaaacccccggg

SEQ ID NO: 139403 - DNA, 630 bp, Homo sapiens
  misc_feature: GYAE6OF01DUB52.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgacaaccgtgggagacagtgtccacatcacttcgccggcaagtcggaactatgacactatttaaatgtatcaacataacgaccgagggaccggaccctaagcctactaatctatgctgcatccagtttgacgtaaaggtcgggtacccagttcgtaggttcaggtggtcgaggtggaatcgtagggactagtacttcactctacacctatacgaagtaattcgcgtacgtaacgtagaagttatttgaacttaactttacttactacgtacaaactaagttaacttaactaagtttcggtttacgacgtaaacgggtacaacggtaacttaaacgtaaaacttaacgtaacgttaggttacgtaccttacgacctaaccgttacttcgttccggttacctttactaaccgtttccccgtaacccccgttacaacctttcgtagttaaaccg

SEQ ID NO: 139404 - DNA, 632 bp, Homo sapiens
  misc_feature: GYAE6OF01CTCOX.46.67.G01.1.454.CMB.1.raw
  modified_base (233)..(233): a, c, t, g, unknown or other
  misc_feature (233)..(233): n is a, c, g, or t
  modified_base (583)..(583): a, c, t, g, unknown or other
  misc_feature (583)..(583): n is a, c, g, or t
tcagactagcagtacacgaccggtgctcgatttagagtatacatattgggtttggggagtctcggtcaggacacagcatggacatgagggtccccgctcagctccgtggggctcctgctactctggctccgaggtgccagatgtgacatcgagctgacccagtctccatccctcctgtctcgaccaaccggtgggacacagtcgtaccaccatcgtacgttggacccgggtanaacggtcggaaactagtttacgaacctaaccttaagttttaaacgttggtaacttacaacgtagtacgaccgagggaccgaccctaagccgtacctaatctatgctgactatcctagttcgactaaggtcgggtaccctagtcgtaggttcaggtcggcgtaggtggtactccggtaggaactgtactttaccacgttaccacgtaacctatacgtagtaactcgagtacgacgttagtagttagttactacgtaactttattaacgtacgtagaaactagttaactaactagttcgtttaaccgacgtaggaacacgttaactaaactaaaggtacagtaggtcgtacncgactacagttctacgttcctactactccccgttacatctcgtcgtaac

SEQ ID NO: 139405 - DNA, 787 bp, Homo sapiens
  misc_feature: GYAE6OF01BKUOD.46.67.G01.1.454.CMB.1.raw
  modified_base (193)..(193): a, c, t, g, unknown or other
  misc_feature (193)..(193): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgtcaccatcacttcggccgggcaagtcggaacatttcgactaccttaattttaaacgttggtaatacaaactattaacggaacccgtaggggacccggtaccctaagcctacctaatctatgctgactactcctagtttcacgtaaacggtcgggtaccctagtacggtagttcgaggtcggacgtaggtggtactcggtaggggaacctaggttactttccgactccttacaacctaacgttactaacgttaacttccgttacgaaccgtaacgggttaagtaaacgtttacgttttaacggaccctttaaagttttaacctttaacgttacggtaacctaaacgtaaagttaaacgtttaaccgttaagtttttaccggtttaccgggaaacccggtaaacggggtaacccttaaaaccggttaaaccctttaaacgttaaaaaccggtttaaaaccggtaaccgtttacgggttaacggttacctaacgggtaaccctaacccgttaacgtttacgttcggttaccctttaccttaaccgttcccccgtttaccccgtaattcccttaacgttcggttaaacccgg

SEQ ID NO: 139406 - DNA, 837 bp, Homo sapiens
  misc_feature: GYAE6OF01ATD0H.46.67.G01.1.454.CMB.1.raw
  modified_base (162)..(162): a, c, t, g, unknown or other
  misc_feature (162)..(162): n is a, c, g, or t
  modified_base (190)..(190): a, c, t, g, unknown or other
  misc_feature (190)..(190): n is a, c, g, or t
  modified_base (827)..(827): a, c, t, g, unknown or other
  misc_feature (827)..(827): n is a, c, g, or t
tcagactagcagtacacgaccggtgctcgatttagagtatacatattggggtttgggagtctcggtcaggacacagcatggacatgacgggtccccgctcagctcctggggctcctgctactctggactcgaggtagccagatgtgacatcgagctgacccngtctcatcctcctgtctgcaccgtgganacagtgtccaccatcgacttcggaccgggctaaagtcggaactgttagacctacctttaatttaaaagttcggtaactacgtaactaacgtaacggtacccgtaggggtacccggtacccctaaaggtccttaccctaaattccttaaatcgtaccgtacaccgtattacccgtaagtttacgggtaccgtaaaacgggtccggggtttacccctaaggttaccggttacgggtttaccgtacgggttacggggtaaccggtttagggttaaccgggttaacgttcccggggttaacgggggtaacccgtaaaccggggttttaaccttttacccgtaacccggttttacccaccggttaaccgtaacgtttacgggttaaacttaaacggtttccgtacggtaaaccggttaaccggtaagtaaacgggtttttactttccggtaacctttaaaccgttttagtaaccgttcgaaacctaaacggtaacttaaacgttacgttacgtttacggttaccggaccgaacggtacaacggtacctaaagttaaacctacggattccggacggtacgtacgtacgttaccatttacgttcggttccctaaagtcccctttccgtaccccgacttacggtntcggttaaac

SEQ ID NO: 139407 - DNA, 1046 bp, Homo sapiens
  misc_feature: GYAE6OF01D35QM.46.67.G01.1.454.CMB.1.raw
tcagactagcagtacacgaccggtgctcgatttagagtatacatattgggtttggggagtctcggtcaggacacagcatggacatgagggtccccgctcagctccgtggggctcctgctactctggctccggaggtgccagatgtgacatcgagctcgacccagtctccactccctccctgtctgaccgaaccggtgggacacgtaggtcgtaccacctatccaccgttcggcccgggactaaacggtaccggaactacgtttcgaacctaaccgtttaaagttttaaaacgttggttaacttaaccaaaacctaagttaaccggaacccggtaacgggggaaccccggtaacccccttaaaggtcccctttaacccttaaaacttaccgtttaacggttacggtaccgttacggtaaccttaaccgttacccggttaacggtttttaacggaaacccggttaaaaacgggggtttccccgggggttaaccccctaaacgggttttacccggggtaacggggttttacccggtaaggggtttaccggggtaccggttaaagggtttacggggtaacgtttaccgggttaaagggggtaaacccttaaagggttttaacctttaacccggaaccctttacccgttaacccgaaacccttaacgttaccgttaaagggtttaacccttcggttaaccggtaaacccggttaaacgggtttaaggttaaaaaccgttttacggtttttaacccggaaacccttttaaaaccgtttttaaccgttttaacccgttaaccggtaaaacccttaaaacggttaaacgtttaaaacgttttaacccgtaaagggtttttacccgggttttaacccggaaacccggggtaaacgggtaaccctaaaccggttaaaacttaaaccgttaaaaacgtttaaccggtaacgttacggtaccggtaccgttacgtaacccgtaccgttattccgttaccgttaccttaaccgtaccctttaccccgttaccccgacttaacgttcgtaacgttaaccg

SEQ ID NO: 139408 - DNA, 590 bp, Homo sapiens
  misc_feature: GYAE6OF01BAU32.46.67.G01.1.454.CMB.1.raw
  modified_base (377)..(377): a, c, t, g, unknown or other
  misc_feature (377)..(377): n is a, c, g, or t
  modified_base (446)..(446): a, c, t, g, unknown or other
  misc_feature (446)..(446): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttgccgggacaagtcgaacattgacacctatttaaatggtatcaacatagaccaagggaccggaccctaagctacctaatcctaatgctgcaatcctagtttagacaaaggtcgggtacccatcggtaagtcaggtgcagtggatcgtgggactagtactttcacgtntaccacatacaagtaactctagtacaacgttgaaagttattttagaactaactttattactagtacaanagtaaattacaatttgtttcggaaccgaaggtaccaacggtaaactaaacgaaattaaaccgaactagtacggacctacgacacctatccttcggtactttacaactttcccgtaccccgtacctaacgttccgtaggtaaacc

SEQ ID NO: 139409 - DNA, 633 bp, Homo sapiens
  misc_feature: GYAE6OF01BOQBW.46.67.G01.1.454.CMB.1.raw
  modified_base (193)..(193): a, c, t, g, unknown or other
  misc_feature (193)..(193): n is a, c, g, or t
  modified_base (239)..(239): a, c, t, g, unknown or other
  misc_feature (239)..(239): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtcgccagatgtgacatcgagctgacccagtctccatccctcctgtctgcaacggtggganacagtgtccaccatccacgttcggccgggactaaggtcggaaactnttacgaacctacctttaagttttaaattggtatacaacataacgaccgaggggaccgaccctaagcctacctaatctatgctgcatccgtagtttcgacgtaaggtcgggtacccagtcggtagttcgaggtcggactaggtggatcgaggactagtattcactctcaacgatacaagttactcgtacgacgtaacggttgtaaagttatttcgaacttaacgtttattacgttagtaacctaacgtacgttaaacttaacgttagtttacgggtttacccggaacggaacgggtactaaccgtaaactaaactaaacgttaaacgacgtaggtacgtctacgactacttatcttcgtcttactacgttcccgttacccactacttcgtagtac

SEQ ID NO: 139410 - DNA, 580 bp, Homo sapiens
  misc_feature: GYAE6OF01BTTKP.46.67.G01.1.454.CMB.1.raw
  modified_base (101)..(101): a, c, t, g, unknown or other
  misc_feature (101)..(101): n is a, c, g, or t
  modified_base (223)..(223): a, c, t, g, unknown or other
  misc_feature (223)..(223): n is a, c, g, or t
  modified_base (312)..(312): a, c, t, g, unknown or other
  misc_feature (312)..(312): n is a, c, g, or t
  modified_base (398)..(398): a, c, t, g, unknown or other
  misc_feature (398)..(398): n is a, c, g, or t
  modified_base (543)..(543): a, c, t, g, unknown or other
  misc_feature (543)..(543): n is a, c, g, or t
tcagactagcagtacacgaccggtgctcgatttagagtatacatagttgggtttgggagtctcggtcaggtacacagcagtggaccatggagggtccccgntcagctccgtggggctcctgctactctggctccgaggtgccagatgtgacatcgagctgacccagtctccatcctcctagtctgccaaccggtggacacagtgtccacatcacttgccgggnaagtcgaacattgactacctatttaactggtatcaactagtagaccagggaccgccctaagctcctaatctatagctgcatccagtttnctaagtcgggttcccagtcgaggttcaggtcgcagtgatcgtgggactagatttcacgtctcactatcagtatctacgacaacgtntaagtacttttaggactaacttattaaccgtacgttacaacgagtaacttaacaactttagtttccggaaccttaagggtacctaaccggtacttaacctaaaacgttaactaactcggtagtctacgtccgtaactactcgttntacttcacttcccttacccgacctaacgtcctgtaac

SEQ ID NO: 139411 - DNA, 798 bp, Homo sapiens
  misc_feature: GYAE6OF01CKX5W.46.67.G01.1.454.CMB.1.raw
  modified_base (357)..(357): a, c, t, g, unknown or other
  misc_feature (357)..(357): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcgcctccatcagtagtggtttctcgtgggctgggtccgcagctcccgaggggaagggctaggaatacgagttcggaagttcgtctctctaagttaggtggtacggttcctaattacagttccgtctctcaagcgtcgagtcaccatatctcgtcgacacgtcagtcaatctacgtttccagaacgtntggacgtttctcggtacgacccgtccgtcgtcggtaaccgtacgggttacttttaacgttacgtggtacggtacggaggtaacggtaccggtctttaacgtttaggttagtttaagtttttgggtaacggtttacgggttttaacgtttacccggtaaccgtaacccggttaacggtacggttacccggggtaccggggtaccgttacccgggtacccccgggttacgggggacccggtaaacggggttaacgttaccggttaccgggttaacccgtacccgggtttacccgttcccggtttaaccgtaccccgttaccccgtaaacccggtaacccggggtaccccgttaaccggtttccccgggttaccccgtttaccccccgaccggtacccccgtaccccgttaccccgtaaccccgtaaacggtccgtaaccccgg

SEQ ID NO: 139412 - DNA, 736 bp, Homo sapiens
  misc_feature: GYAE6OF01CLADE.46.67.G01.1.454.CMB.1.raw
  modified_base (212)..(212): a, c, t, g, unknown or other
  misc_feature (212)..(212): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtcncctcatcagtagtggtttctcgtggggctgggtccgcagcctaccgaggggagggctaggaataacagttaggaagtgtactctacagtaggtggtacggtttcctattacgacgtccgttctctaccaaggtacgtcgacgttacaaccgtattactctacgtacggacctaccgtaccgaagacctaaacttccgttacgttttttccccgaaggtaaacgtagttggttaacgtttccgttacgggttaccgaccccggccgtacgtacggtaaccggtaccggggtttacttttacgtacgtcggttagaccggtagacggtacgtactttaacgttagttggtttaacgtttttggggtagtttagggttttacttaccggtaaccctacccggttaaggacgttccggggaccggggttcccgtacccgggtacccgggttcgggggaacccggtaagggtaaccttcggtccggttaccgtacccgttcctacccgttacgtccccgtaaaccccgg

SEQ ID NO: 139413 - DNA, 661 bp, Homo sapiens
  misc_feature: GYAE6OF01CLSJ0.46.67.G01.1.454.CMB.1.raw
  modified_base (195)..(195): a, c, t, g, unknown or other
  misc_feature (195)..(195): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcctaaccggtggganactagtgtaccaccatcacgttggccggacaaggtcgaactattcgactaccttatttaaagttgtactacaactagtacgaccgagggacccggaccctaagcctacctatctagtgtctagctacttccgtagtttacgacgtaaggtcgggtacctagtcggtaggttcgaggtcgtacgtagtagagttcgtacgggatacggtattcgacctctcactatctagtaactcgtagtaccgtaagtagtaattacgtttacgaacttaacgtttacttaacgtacgtaactaacgttaacgtaactttaacggtaccgtttacgggtttaccgaacggtaaacggtacctaacgtaacgttaaactaaacgtaaccgtagttcgtacggtactacgtaccctacgtattccgttcgtaccttagtaacccttccccggttacaccttacgtcgttagtaaccg

SEQ ID NO: 139414 - DNA, 869 bp, Homo sapiens
  misc_feature: GYAE6OF01DNMLW.46.67.G01.1.454.CMB.1.raw
tcagactagcagtacacgaccggtgctcgatttagagtatacatattggggtttgggggagtctcggtcaggacacagcatggacatgagggtccccgctcagcctccgtggggctcctgctactctggctccggaggtgccagatgtgacatcgagctcgacccagtcctcccactccctccctgtcctcgaccgtaaccggtgggaacgacgtaggttctaccacctataccgtaccgttcgggacccggggtactaaacgggtaccggtaaactagttacggtaaacctaaccttttaaagttttaaacgttcggttaaactaaccgtaactaaacgtaaccggaaccggaaccgggggtaaccccggtaaccccgtaaaggtccccttaacccgttaaactcgttaacgttcggtacctacgtacctaaccgttcccgttaaggttttacggaaccggtaaaacgggttccggggttaaccctaggttacgggtaacgggttccgaagggtcggtaccgtagggttacgggtaactcgggttacgggtaactaacggttactttacctacgttaccctacctaaccgtacgttaaccgtaaacgttaaccgttcgtaacggtaaccgttaacggttaacggttaacgtttacgtttaacggtaactttaaacgtttaccttaacgtaactaacgtaactaaacgtaacttaacgttacggtttaccggtttccggaaacgtaacggtacgtaacgaacctaaagttaaacgttaaacgtacgttcggtacgacctacgtactaaccgttagtcttacgttacctacttaccgttacccgtacctaccctcttaccgttgtaaccg

SEQ ID NO: 139415 - DNA, 713 bp, Homo sapiens
  misc_feature: GYAE6OF01E4PBA.46.67.G01.1.454.CMB.1.raw
  modified_base (194)..(194): a, c, t, g, unknown or other
  misc_feature (194)..(194): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatcctcctgtctgacaaccggtggganacagtcgtcaccatcaccgttcggccgggcaaggtaccggaactacgtttcgaacctaacctttaaattttaaaagttcggttaactaccaaacgtattaacggaaccgacggggacccgaccctaagcctacctaattctatgctagctactcgtagtttacgacgtaacggtcgggtacccagtcggtagttcgaggtcggacgtaggtacggtacgttacggtcgggtaactaagttacttttaccgaacccgtttacctaccaacccgtaagttacgtaacgtttaacctcgtaccgtaacgtaacggttagtaaacgtttagtttacgtactttaaacgttacttaccgttacgtaacaaacgtaagtaactttaacgtacgtttacggttacgaacgtaacggactaacgaaacttaaacgtaaacttaacggatcggtctaccgtcgaccctactacgttactccctttacgtacccttacgttccctacccgaattctacgtcgttaaccg

SEQ ID NO: 139416 - DNA, 724 bp, Homo sapiens
  misc_feature: GYAE6OF01CX8VL.46.67.G01.1.454.CMB.1.raw
  modified_base (98)..(98): a, c, t, g, unknown or other
  misc_feature (98)..(98): n is a, c, g, or t
  modified_base (186)..(186): a, c, t, g, unknown or other
  misc_feature (186)..(186): n is a, c, g, or t
  modified_base (275)..(275): a, c, t, g, unknown or other
  misc_feature (275)..(275): n is a, c, g, or t
tcagactagcagtacacgaccggtgctcgatttagagtatacatattgggtttgtcctcctgctggtggcagctcccagatgggtcctgtccctggtncaactgcgaggaggtccgggcccacgactgggtgacggtcccttgggacgacccctgtacccctcacctgccgtctgtctcgtggtcncctccatctaggtagttggtttctcggtgggcgtcgggtccgcagccgtccggaaggggaggctaggaatcgtagtggagtgtctctanagtaggtggtacgttactagtacgtcgttaccgtctctaacgaaggtcggtacgtagtacccaactattactccgtcgtacgaaccctaggtccaaggacctagtcctttaccgtttcgaagtaaacggtcttaggtacttccgttgaccggtccggcctcgtaagtacggttaccgggttacgttttaatacccgttgaccggagtaaggacgtaacggtcttaacttgtaagtttgtttaggtaggtttagttaccgttacaccgtacgtacggtacggtaccggacggggtcctacccggtacccgggtcgaccggtaaacgggtactacgtacggttacccaccttcgttacgtacctcccgaaccgtaacccgccggacccttacggtcccttacccccgtccaccggtcccctaaccgttcccaacgtacgaccgtaccccgg

SEQ ID NO: 139417 - DNA, 700 bp, Homo sapiens
  misc_feature: GYAE6OF01AX70U.46.67.G01.1.454.CMB.1.raw
  modified_base (190)..(190): a, c, t, g, unknown or other
  misc_feature (190)..(190): n is a, c, g, or t
tcagactagcagtacacgaccggtgctcgatttagagtatacatattggggtttgggagtctcggtcaggacacagcatggacatgaggtccccgctcagctcctggggctcctgctactctggctccgaggtgccagatgtgacatcgagctgacccagtctccatcctccctgtctgcaaccgtgganacagtcgtccaccatcacttgccgggacaagtcggaacattcgactacctatttaaattgtatacaactatacgaccgaggaccgaccctaagctacctaatctatgcctcgacactccgagtttacgacgtaaacggttcgggtacccagttccggacggtttcgaaggtcggacaggttacggtattccgtagggaactacgttactttactaccgtcctaccaaccctataccgtaacgttaactacgttacgacgtaacggtacgtaacgttacgtttacgaacttaactttacgttacgttacgtaaccgtaaactaacgttaaactttaacgtaacgtttacggttttaccggaaccctaaacggggtaacctaaccggaaccttaaacgtaaacgtttaaaacgtaacgttaggtacggtacttaacggtacctaaccgtattcggttacgttccgttaacgtccgttacccttccccgtacctccgttacgtaccgttaacg

SEQ ID NO: 139418 - DNA, 774 bp, Homo sapiens
  misc_feature: GYAE6OF01DYD0I.46.67.G01.1.454.CMB.1.raw
  modified_base (176)..(176): a, c, t, g, unknown or other
  misc_feature (176)..(176): n is a, c, g, or t
  modified_base (213)..(213): a, c, t, g, unknown or other
  misc_feature (213)..(213): n is a, c, g, or t
tcagactagcagtacacgaccggtgctcgatttagagtatacatattgggtttgtcctcctgctggtggcagctcccagatgggtcctgtccctggtgcaactgcaggagtccgggcccagactggtgaggcccttcggacgacccctgtccctcacctgcgctgtctcgtggtcncctcatcagtagttggtttctcgtgggctgggtccgnacgcctccggaaggggaacgggtctaggaatacgtagttagggaagttgttacctcgtagtagttacggtcgggtagttccttaattacgacggttccgttcgtctacgaacggtacgtcgacgttaccaacctattactccgttcgtacggaacctaccgtccaagtaccgtaaacttcgtacctttttacccgagtaacgtacgttgtaacgttctacggtcgacccggtccgtacgtacggtaccggtacgggtttacgtttactacgtcggtacgaccggaagtacggtacggtactttaagtttagttaggtttacgttttagggagtttacggtttacgtttaccgaaaccctaccggttaacggtaccgttcggggtaacccggggttcctacccggtacccgggtacggggaacccgaagggttaccgtacgttccgggtacctacccgttcttacccgacgtcccgaaccgacccggtaacggtcccctacggttcccgttaccccttcccgtccgaccccgttaccctcccgaaccgacgcccgtacccgg

SEQ ID NO: 139419 - DNA, 673 bp, Homo sapiens
  misc_feature: GYAE6OF01DOL1E.46.67.G01.1.454.CMB.1.raw
  modified_base (599)..(599): a, c, t, g, unknown or other
  misc_feature (599)..(599): n is a, c, g, or t
  modified_base (627)..(627): a, c, t, g, unknown or other
  misc_feature (627)..(627): n is a, c, g, or t
  modified_base (666)..(666): a, c, t, g, unknown or other
  misc_feature (666)..(666): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtccactatcacttggccggacaacgtccggaactagttacgactaccgttaattttaaagttggtaactactaaacagttaacgaccgaaggggacccgtaccctaaaaggtccttaccttaaactacgtaacgtacgtcgtacgtactacttacccgtaggttttagaacctaaaaggggttccggggtacccctaggttacggtacggtttaccgtaggtggaccgtaggttcggaacgttcggttacgggaacgtaaggttaaccttttaccacctttaccgacctaactacgtacgtagtaacttccgtacgaacgtaacgtagtaagtttactttaagacttaattacgttactgaacactataattactagttcgttacgaacgtagaacctanaaccttaactaaagtacgaactgtacgntaactccacttattcgtcttctctactccttaccattcnctagtac

SEQ ID NO: 139420 - DNA, 676 bp, Homo sapiens
  misc_feature: GYAE6OF01A51GN.46.67.G01.1.454.CMB.1.raw
  modified_base (194)..(194): a, c, t, g, unknown or other
  misc_feature (194)..(194): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggagacngtgtcaccatcacttggccgggcaagtcggaacattcgacaccttattaaagttgtatacaacatagaccagggaccgccctaagctcctaatctatgctgctacgtcctagtttcgacgtaaacggtcgggtccctagtccgtaggttcaggtggcgtaggtggaacttcggtagggaacctagtactttcgacctctaccaaccacttaccgaagttaactctacggaactaacggtacggtaaagttagttttacgaactttaaaccgtttaatttaaccttacgtaaccgtaaacgtaagttaaacttttaaactaacgtttacggtttaccggaacccgtaaacggtaacgtaaaccgttaaaccgttaaacgtaaaacgttaaaccgtaacgttaggtccgtactacggaccctaccgtattaccgttacgttcccttacgtacctttcccttaccccgctaacttcgtcgtaacg

SEQ ID NO: 139421 - DNA, 661 bp, Homo sapiens
  misc_feature: GYAE6OF01C988V.46.67.G01.1.454.CMB.1.raw
  modified_base (182)..(182): a, c, t, g, unknown or other
  misc_feature (182)..(182): n is a, c, g, or t
  modified_base (594)..(594): a, c, t, g, unknown or other
  misc_feature (594)..(594): n is a, c, g, or t
tcagactagcagtacacgaccggtgctcgatttagagtatacatattgggtttgtcctcctgctggtggcagctcccagatgggtcctgtccctggtgcaactgcaggagtccgggccccacgactgggtgagggcccttcgggacgacccctgtccctcacctgcgtctgtctcgtggtcncctccatcagttagttggttttctcgtggggctcggggtccggcagcctcccggaaggggaacggggtctaggaatactagttaggaagttgtctactcagtaggtggtacggttcctagttacgacgtcccgttcgtctacgaagtagttccggacgtaccaaccctaattatccttacgtagggaacctaccggtaccacgactaaacgtcttacgttttccccagtaagattgtagtttctggtaccgacccgccgtgtaggacccgtacggggttcttttaatacgtgtcgcgagaggcgtacttagttagttagtttagtttggtagttggtttacgttacgaccttaccgtagtacggttcgggaccgggtacctccggacccgtgggaccgtaggactcgcgtcncgtctcctgccctcgaccgtacgcctacgtccgtccctccgacgtcccacctaccacagtcctaccg

SEQ ID NO: 139422 - DNA, 638 bp, Homo sapiens
  misc_feature: GYAE6OF01DEFAF.46.67.G01.1.454.CMB.1.raw
  modified_base (463)..(463): a, c, t, g, unknown or other
  misc_feature (463)..(463): n is a, c, g, or t
  modified_base (484)..(484): a, c, t, g, unknown or other
  misc_feature (484)..(484): n is a, c, g, or t
  modified_base (596)..(596): a, c, t, g, unknown or other
  misc_feature (596)..(596): n is a, c, g, or t
  modified_base (601)..(601): a, c, t, g, unknown or other
  misc_feature (601)..(601): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccactccctccctgtctgaccgaaccggtgggagacagtcgtccaaccatccaccgttggcccgggactaaggtccggaactagttcgaactaacccttaattttaaagttggtatacaaactagtacgaaccgacgggaccgaccctaagcctacctaatctatcgctgactctccgtagtttcgacgtaaacggtcgggtaccctagtacggtaaggttcgaagtggacgtagtagggtactcggtagggtaacctaagttctttacgacctcgacctacatacgtaagtaactcnggtaaccagtagtagttattntactaattactctagtacaacgtagtaacttactaagtttgttaccgacgaaaggacctaacaaacgttaactaaaagttacgtaactaggtcggactacgtaccaccttanacttnttaccgttcaccgttccgttaccacctgttacagtac

SEQ ID NO: 139423 - DNA, 596 bp, Homo sapiens
  misc_feature: GYAE6OF01BNFEB.46.67.G01.1.454.CMB.1.raw
  modified_base (173)..(173): a, c, t, g, unknown or other
  misc_feature (173)..(173): n is a, c, g, or t
  modified_base (293)..(293): a, c, t, g, unknown or other
  misc_feature (293)..(293): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactgggtgaggccttcggagaccctgtccctcacctgcgctgtctctggtncctccatcagtagtggtttcttcgtggggctgggtccggcagcctccgaggggaagggctaggaatacagttggagtgtctctcatagtggaggttcctattacagtccgtctctcaagngtcgagtcacatatctctggacacgtcagcaatctagttttcccagaagatgtagttctgtcgaccgccgtctgacgtacgggtcttttattactgtcgcgagagacgcttattatgttagttttggagttggttatttcgacctacctagacgtcgggacggggtcctccggacccgtcggggaccgaaggggtaacttacggttcgtccgtaccgtccttccgttacgtccctacccgaccgaccggcctacgtccggtcccttccccgcggtccctaccctaccctaccaagcgtacccg

SEQ ID NO: 139424 - DNA, 817 bp, Homo sapiens
  misc_feature: GYAE6OF01B9VBH.46.67.G01.1.454.CMB.1.raw
  modified_base (213)..(213): a, c, t, g, unknown or other
  misc_feature (213)..(213): n is a, c, g, or t
  modified_base (236)..(236): a, c, t, g, unknown or other
  misc_feature (236)..(236): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggacgaccctgtccctcacctgcgctgtctctggtcncctcatcagtgttcgtttctcgnggggctgggtccgcacgcgtccggagggacgggctaggtaactacgagttgggaagtgtactctactagttaggtagggtacggtttacctattacgacggttccgtacttctacgaagtacggtcgtacgtacaacctatactccttacgtacggacctaccgtaccagtacctaattccgttacgttttcccgaagtaaagtacgttacggttacgtttacgtcggtacccggacccggtcccgtacgtaaccggtacccgggttaccggggtttaacttttaaccgttacgggttcggttacggacggtaacggtaacgggtaccggttaactttaagtttaacgttgggtttttaaggtttagggttagggttttacgtttaaccgtttacccgtaacccgttacccgttacggtaaccgggttaccgggggtaacccggggttcccgtaaccccggggtccccgggttacgggggacccggttaaacggggttaacccttaccggggtttaccggtacccgttacccccgggtttacccttaccccggttacgtacccccccggttaacccccggg

SEQ ID NO: 139425 - DNA, 785 bp, Homo sapiens
  misc_feature: GYAE6OF01DET3F.46.67.G01.1.454.CMB.1.raw
  modified_base (227)..(227): a, c, t, g, unknown or other
  misc_feature (227)..(227): n is a, c, g, or t
  modified_base (250)..(250): a, c, t, g, unknown or other
  misc_feature (250)..(250): n is a, c, g, or t
  modified_base (265)..(265): a, c, t, g, unknown or other
  misc_feature (265)..(265): n is a, c, g, or t
  modified_base (373)..(373): a, c, t, g, unknown or other
  misc_feature (373)..(373): n is a, c, g, or t
tcagactagcagtacacgaccggtgctcgatttagagtatacatattgggtttgggggacctcctgtgcaagaacatgaagcacctgtggtttgtcctcctgctggtggcagctcccagagtgggtcctgtccctggtgcaactgcaggagtccgggacccacgacgtggtgacggtccgtacggacgacccctgtcccctcaccgtgccgtctgtcctcgtggtcncctcatcgagtgttgtttctcgngggcgtcgggtccgnacgtcccgtaccggagggacggggtctaggaatacgtagttaggacgtgtctctcgaagttggtaggttacgttcctaagttacgacgttccgcttacgtacgaaagnggttaccgtaagtacctaacctaatccgttacctccggtaacggaacccttaccggaccgaaacgtaccgtaaaactttcccggtttaaccgttttacccgaaggaaagttccgttaggttacgtttccgtaggttaccgacccgtcccgtcggtaacggtaccggtaaccgggtttacgttttaacgttacgtcgggtaacggtacggaacggtaacgggaacggtttacgttaattaggtttaggttttaaggttttacggtagggtttacggtttaacgtttacccggacccttaacccggtagtacggacccggggtccgggtacccgtacccggtacccgggacgggtaccggaaggttactaggttccgtaccgtacccttaccgtcccttaccgcccgtaacccg

SEQ ID NO: 139426 - DNA, 742 bp, Homo sapiens
  misc_feature: GYAE6OF01BDP2U.46.67.G01.1.454.CMB.1.raw
  modified_base (212)..(212): a, c, t, g, unknown or other
  misc_feature (212)..(212): n is a, c, g, or t
  modified_base (437)..(437): a, c, t, g, unknown or other
  misc_feature (437)..(437): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtcncctcatcagtagttggtttcttcgtgggctcgggtccggcacgctcccggaggggaagggcgtaggaatacgtagttggaagtgttactctacgagtaggtggacgtttccttagtaactcggttccgtctcgtacaagtacgttcgaagtccaacctagtacttctcgtcggaactacgtaccaggactaaacgttccttacggttttccctaaggaaacgttntacgtacgtttcgtcggttacgtaccgccgtacgtaggtaccggtacgggttacgtttacttacgtgtcggcgtaggtacggacgtcttaagtttacgtttagtttagtttttcgggaaggttttacggttttacgtttaaccgtacccgttaccgttaaggtaccgtacccggggtacggggtaccccggttacccggtccccgggttacgggggacccggtaaaggggttaaccgttacggttacgggttaaccccgttccgtttacccgttacccgttaccgggtcccgttaaaccccccgg

SEQ ID NO: 139427 - DNA, 698 bp, Homo sapiens
  misc_feature: GYAE6OF01DIVAD.46.67.G01.1.454.CMB.1.raw
  modified_base (198)..(198): a, c, t, g, unknown or other
  misc_feature (198)..(198): n is a, c, g, or t
  modified_base (216)..(216): a, c, t, g, unknown or other
  misc_feature (216)..(216): n is a, c, g, or t
  modified_base (384)..(384): a, c, t, g, unknown or other
  misc_feature (384)..(384): n is a, c, g, or t
  modified_base (392)..(392): a, c, t, g, unknown or other
  misc_feature (392)..(392): n is a, c, g, or t
  modified_base (399)..(399): a, c, t, g, unknown or other
  misc_feature (399)..(399): n is a, c, g, or t
  modified_base (690)..(690): a, c, t, g, unknown or other
  misc_feature (690)..(690): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctcgacccagtcctccatccctcctgtctcgacgaccggtggganactaggtcgtccaacctntccgtacgttcggccgggacaacggtacggaactattacggacctaccttaaatttaagtggtactacgaaactagtaccgaccggacggtaccgccctaagcctacctaatctagtgctgactacgtcgtagttcgacgtaacgtcgggtacctagtcgtagttacnggtacggngtacggngtacgttcggaggactaacgttacttcctacgtcctaccaaccgtattacgattaacgtcgacgtaactagggtaatacgtttacgttacgtaacttaacctttaacgtcgtaactaaccgtaaacgtaacggttaaactttaacgtacgttttacgggtaacccggaacgtaacggtaccgttaaacgtaaacttaaacgtaaacgttaaccggtagtaaccggtgttaccgagtaaccctatacgttactcgttacttcctaacttcccgttaaccctattcgtacgtnttaacccg

SEQ ID NO: 139428 - DNA, 842 bp, Homo sapiens
  misc_feature: GYAE6OF01D6UET.46.67.G01.1.454.CMB.1.raw
  modified_base (204)..(204): a, c, t, g, unknown or other
  misc_feature (204)..(204): n is a, c, g, or t
tcagactagcagtacacgaccggtgctcgatttagagtatacatattgggtttgtcctcctgctggtggcagctcccagatgggtcctgtccctggtgcaactgcagggagtccgggcccacgtacgtgggtgacgggtccctttacgggacgtaccccttcgtcccctacacccgttggccgtcttcgtcctcgttgggtccnccctacctatcgtaaggttggtttcggtttcttcgggtcgggggtccgttcgggggtcccggcgacggtcccgtaccgggaaggggggaacgggtctaaggtaacttacgtagttacgggattcgtacctctagtaggttaggtcggtacggtttaccttaagtttaaccgcgtttcccgttctacgtaaccgaaggtcgtcgactaccaacctattaccttctacgacgaccctccgtaccgatacctacttccgtttaccgtttaccgagtaactcgttaggttacgttcgtcggtacccgccgtaccggtcgtaacggtaccggttacggtttacttttaacgtcggtcggttacggaacgtacgacggttactacgttagttagtggttttaagtttggacggttttacgtttacgtaccgtaccgacgttaaggtccggtaccgggggtaccggttcccgtcggtacccggggtacggtacggtaacgggtaacctttccgggtctacccgtaccggtttccctaccggtacccgtcccgtaacccgccgggtaacccgtccttacccgggttccctcccccgttacccgccgttacccctacccgttaacccacggtagtccccgtacccgg

SEQ ID NO: 139429 - DNA, 690 bp, Homo sapiens
  misc_feature: GYAE6OF01ETCNA.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtccgggcccacgactggtgaggccttcggagaccctgtccctcacctgcgctgtctctggtcgcctccatcagtagtggtttctcgtgggctgggtccgcagcctccgaggggagggctggaatacagttggaagtgtctctacagtaggtggtacggtttacctattacgacgttccgttcgtctacaagtacgtcgacgtacaccatactctcgtggaccaccgtccacgcaattctacgttttcccagtaacgatagtacgttctgtaccgccgccgtcgtacgacggtaccgggttcttttaacgttacgtggtacgcgaggtacggtacggtacttaagttagttagtttagttttagggtagtttaggtttacgttaccgtacctacccgtaggtacgtcgggtaccggggctaccgggacccggtcgggaccgacgggtaatcggttcggactacccgttctacccgtacgtcccgtaccgaccggaacccggtccctaccgggttcccgttaccccgttcccccggtaccggtccccttaccccgtcccgtaacccgagtcccgtaccccgg

SEQ ID NO: 139430 - DNA, 883 bp, Homo sapiens
  misc_feature: GYAE6OF01BB5SD.46.67.G01.1.454.CMB.1.raw
  modified_base (864)..(864): a, c, t, g, unknown or other
  misc_feature (864)..(864): n is a, c, g, or t
tcagactagcagtacacgaccggtgctcgatttagagtatacatattgggtttggggagtctcggtcaggacacagcatggacatggagggtccccgctcagctccgtggggctcctgctactctggctccggaggtgccagatgtgacatcgagctcgaccagtctcctactccctccctgtctcgaccgtaaccgggtgggactacgagttcgtaccacctattccgtacggttcgggacccgggtactaagggtaccggaaactagtttacgaaccttaacctttaaattttaaaggttcggtaactaaccgtaaactaggtaaccggaacccggaacgggggtaacccggtacccttaacggtaccttaaccttaacgttacttacgtcgcgttaccggacctaccgtttaccggttaggtttacgaaccgggttaaacggggttccgggtacccttaaggtaccggttacgggtttacggacgggttcggtacgtagggtacggtacgtacggttacggggaaccttacgttactttaccgtacccgtacctaacgtaacctaacggttacgtaaacgttaccgttacggtacggtaaaccgttaaagggttacggttaaacgtttcgttttacgaaacctttttaccgtttaacgtttaaccttaggttaaaccaaagtttaacgttaaccgtttaacgtttacgttttaacggggtacccgaaccgggtaacggtaacctaaccgtaaacgttaaacgtaaacgttaaccgaacggttcgtacggtcctaacggtaccctaacggttcttacggtttcccttacgttaccctacccgggtaccctttacccgaactntttccgggttaactaaacg

SEQ ID NO: 139431 - DNA, 757 bp, Homo sapiens
  misc_feature: GYAE6OF01CWQSG.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctcgtggtcgcctccatcagtagttggtttctcgtgggctgggtccgcagcctccgaggggaagggctaggaatacagttgggaagtgtctactcaagtggtggtacggttcctattacgacggtccgttctcgtacaagtagtcgagtccacctatactcgtcgtcggaccaccgttaccgagacaacttcctacgtttttccccgagaagtataggtagtttcgtggtacgacccgccggtctcggaaccgtaccgggttacgttttaacgttacgttggtacgcggtaaggtaacggtaccggtactttaagttaacgttaggtttagttttacgggtaggtttacggtttaacgtttccggtaaccgtacccgtaacggtacggttaccggggaccggggtcccgtaccggtaccccgggtacggggaccgtacggggtaacttaccggttcggtaccgtacccgttccgtccccgttaaccgcccgtaaccccgaccggtaacccgggtccctaaccggttccccgttaccccgttccccccgtacggtacccctacccccgtccttacccggaacgtaccgtaccccg

SEQ ID NO: 139432 - DNA, 727 bp, Homo sapiens
  misc_feature: GYAE6OF01D9TDV.46.67.G01.1.454.CMB.1.raw
  modified_base (250)..(250): a, c, t, g, unknown or other
  misc_feature (250)..(250): n is a, c, g, or t
  modified_base (288)..(288): a, c, t, g, unknown or other
  misc_feature (288)..(288): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagttggtttcttgtggggctgggtccgnagctccgagggagggctggaatacatggaagtgtctcncataggtggaggttcctaagttcagttccgtctctacaagagtcgagtcacatatctcgtaggactacgtccaagactaacgtcttacgttttccctaaggtaaacgtacttaggtacgttttacgtagttaccggaaccccgtcccggtcgttacggaaccgtaaccggggttaacgtttttaacgtttaaccgtggttacggacgggtaaggtaacggtacgggttaactttaattttagtaggttttaacgtttttaggggtacggtttaggtttaacgtttacgtacccgtaacccgttaagaccgtaccgggggtacgggggtaccgttaccccgggtaccccggttacgggggaaccgtaaggggtaaacgtaccgtttacgggtaccttaacccggttacccttcccgttaacggtcccccgtaaaccccgg

SEQ ID NO: 139433 - DNA, 607 bp, Homo sapiens
  misc_feature: GYAE6OF01EV25C.46.67.G01.1.454.CMB.1.raw
  modified_base (194)..(194): a, c, t, g, unknown or other
  misc_feature (194)..(194): n is a, c, g, or t
  modified_base (197)..(197): a, c, t, g, unknown or other
  misc_feature (197)..(197): n is a, c, g, or t
  modified_base (228)..(228): a, c, t, g, unknown or other
  misc_feature (228)..(228): n is a, c, g, or t
  modified_base (360)..(360): a, c, t, g, unknown or other
  misc_feature (360)..(360): n is a, c, g, or t
  modified_base (375)..(375): a, c, t, g, unknown or other
  misc_feature (375)..(375): n is a, c, g, or t
tcagactagcagtacacgaccggtgctcgatttagagtatacatattgggtttggggagtctcggtcaggacacagcatggacatggagggtccccgctcagctcctggggctcctgctactctggctccgaggtgccagatgtgacatcgagctgacccagtctccatcctccctgtctgcaaccggtggganacngtgtcacatcacttggccggcaagtcgaacntgacacttatttaatgtatcaacatagaccgagggaccggccctaagcctacctaatctatgctgctactcctagttgactaaggtcgggtccagtcgagttcagtgcagtgatcgtaggaatcttcgctcncactatactagtatntacgacaacgtgtaagttagtttagacttaacgttacttactgtaactaataagtaacgttactaagtttcggtttaacgaccgtaacggtacctaacgtaaccttaacgtaaaacgttaaccgtaacgttcggttacggaccgttacggtacctaaccgtacgttaccgttacgttaccttacgtaaccgttccccttacccggtacctaccgttactcgttaacgtaccg

SEQ ID NO: 139434 - DNA, 665 bp, Homo sapiens
  misc_feature: GYAE6OF01BAYY2.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaccgtgggagacagtcgtcacctatccacttggccgggcaagtcggaacattcgacaccttattaattggtatcaacatagaccgaggaccgtccctaagctacctaatctatgctgactatcctagtttgacgtaaaggtcgggtcccctagtccggtaggttcaggtggactaggtggatcgagggactagtactttcactctacaccatacaagtatcgtgacaacggtagtaagtagtttacgactaacgtttattaacttacgtaacaaactaagtaactttaacgtaagtttacgttttaccggaaccgtaacggtaccgtaaccggttaaccttaaacgtaaacgttaaaccggtaaacgttcggtacggtaaccgtacgtaaccctaaccggtacttaccggttcctttacccgttaccttaaccctttaccccgttaccccggtaccctaacgtttcccgttaaggtttaacccg

SEQ ID NO: 139435 - DNA, 954 bp, Homo sapiens
  misc_feature: GYAE6OF01B67EW.46.67.G01.1.454.CMB.1.raw
  modified_base (180)..(180): a, c, t, g, unknown or other
  misc_feature (180)..(180): n is a, c, g, or t
tcagactagcagtacacgaccggtgctcgatttagagtatacatattgggtttgtcctcctgctggtggcagctcccagatgggtcctgtccctggtgcaactgcgaggacgtccgggcccacgctgggtggaggccttcggacgccctcgtccctcacctgccgtctgtctcgtggtcncctcatctaggttagttcggtttcttcggtcggggtcgtcggggtccggcgacgtccgacccgggaagggggaacggggtcgtaggtaagtacgtaggttaggtaacgttgtcctcgtacgtagtaggtacggttacgttaccttattacgcgttaccgtctacgtacaaaggtcggtacgacgtaccaactacttacttccgtacgtacgaaccgtaccgtacctaacggaaccttacgttacgtttaaccgttttacccggaaagtaacggttcgttacggttagtttaccgtttcggaaccggtccccggtaccgtcggttaaccggtacggtttacgggtttacgttttaacgtaccggttaggttacgacggggtaacgtaacgggttacggttattaagttttacggttaaggtttttagggttttagggttaacggtttttacggttttaacccgttaacccggttaaacccgtaccggtttaacgggtacccgggtccgggggttaaccggggtaccccggtttaaccccgggtacccgggggtaccgggttaacgggtaaccggggttaaaccgttccggggttaacccgcccgtttacccggttacccgttacccgttaccccgggacccttaaacccgggaaccccggtaacccgggccccctttaacgggtcccccggtttcccccccgtttccccgggtaccccggtacccccgttaccccgtttaccccgtaccaaacccggggtcccggttaaccccgg

SEQ ID NO: 139436 - DNA, 736 bp, Homo sapiens
  misc_feature: GYAE6OF01DM8HD.46.67.G01.1.454.CMB.1.raw
  modified_base (193)..(193): a, c, t, g, unknown or other
  misc_feature (193)..(193): n is a, c, g, or t
  modified_base (695)..(695): a, c, t, g, unknown or other
  misc_feature (695)..(695): n is a, c, g, or t
  modified_base (719)..(719): a, c, t, g, unknown or other
  misc_feature (719)..(719): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgcaccggtggganacagtgtccaccatccacgttcggccgggactaagtacggaactattacgaacctaaccttaattttaaagttaggtaactacaaactaagtaacgaacccgaacggggaaccggacccgtaacgcctaccttaactcgttatcgtcgtgcctacttaccgtagtttacgtacgaacgggttcgggtacccacgtcggtaaggtttcgtagttcgggacgtaggtggtacgttaccggtgggaacgtacgtaactttcgacttaccgtactaacctaacgtacgtagttaaacttcgtacgaacgtaacgtaggtaaatttgtttacaacgttaactttacgtttactacttaaccaaattaacgtaaatttaccgtaagttttaccggtttaccgggaacggtaaacggaccgttaaaccgtaaaccttaaacgtaaaacgtttaacgtaacgttacggttcggaccgttaccgaccctaacccgtattacgttaccgttnttaccgtacctttccgtacccccnttaaccgtgtccgtaac

SEQ ID NO: 139437 - DNA, 950 bp, Homo sapiens
  misc_feature: GYAE6OF01BJYVZ.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggacgtccgggcccacgactgggtgaggccttcggacgacccgtgtccctcaccgtgcgtctgtctcgtggtcgcctcatcgagtagttcggtttcttcggtggggtctcggggtcccgacacgtcccgtaccggaagggggaacgggctaggtaaacttacgtagttagggaagtcgttctactagtaagttggttggtacgtttaccttattacgacggttccgtcttacctacgaacgaggtccgtacgtcctaacctagttacttccgtccgtacggacctaccgtccaacgtactaacttccgttaccgtttttacccgagtaaagtacgttcggttacgtttcgtcggtaccgaccccgtccgtaccgttacggaaccggttacgggtttacttttaacgttacggtcggttacgggaccggtaaggtaccgggtaccgtttacgtttaaaggttttacgtttaggttttagggtttttacgggttaaggtttttacggtttttaaccggttaaccccggttaacccgttaacccggtttaacgggtaccgggttacccgggggtaacccgggggtccccttaaccccggggtaccccgggttacgggggacccggttaaaggggttaccgtttaccggttaccgggtacccgttacccgttaccccgtttaccgtttaaccccgggtaccctaacccccggtaaaccccggggtaaccggttacccccgttaccggttccccccggggtttcccccctttaccccccgggacccccgttacccccttaacccccgttaccccgtaacccggtaaaccggtccccccgtaaccccggg

SEQ ID NO: 139438 - DNA, 653 bp, Homo sapiens
  misc_feature: GYAE6OF01E181V.46.67.G01.1.454.CMB.1.raw
  modified_base (193)..(193): a, c, t, g, unknown or other
  misc_feature (193)..(193): n is a, c, g, or t
  modified_base (196)..(196): a, c, t, g, unknown or other
  misc_feature (196)..(196): n is a, c, g, or t
  modified_base (230)..(230): a, c, t, g, unknown or other
  misc_feature (230)..(230): n is a, c, g, or t
  modified_base (301)..(301): a, c, t, g, unknown or other
  misc_feature (301)..(301): n is a, c, g, or t
  modified_base (368)..(368): a, c, t, g, unknown or other
  misc_feature (368)..(368): n is a, c, g, or t
  modified_base (402)..(402): a, c, t, g, unknown or other
  misc_feature (402)..(402): n is a, c, g, or t
tcagactagcagtacacgaccggtgctcgatttagagtatacatattgggtttgggggagtctcggtcaggacacagcatggacatgagggcccccgctcagctcctggggctcctgctactctggctcgaggtgccagatgtgacatcgagctgacccagtctccatcctccctgtctgcaaccggtggganacngtgtcaccatcacttggccgggcaagtcggaacnttcgacaccttatttaaattggtatcaacatagaccagggtacgaccctaagctccgtaatctatcgcgtncactccagtttgactaaaggtcgggtaccagtcgtacggttcagtggataggtcgtatcgtaggacngtactttcactctactacctatacgaagttaacnctacgacgtaacgtagtaaacgttagttttacgactaaacgtttactaacttcgtacaacgtaataacttaacgtaacgttcggttttaccggaaccgtaaaggaaccgtaacgtaaacttaaaacgtaaaacgttaaaccgaacgttacgggtagtcccgtagtaacccgtaaccttactaccgtttacggtttcccttacttaaccgttccccgtttaccccggaacctacgttacggtacttaaaccg

SEQ ID NO: 139439 - DNA, 704 bp, Homo sapiens
  misc_feature: GYAE6OF01AY5GE.46.67.G01.1.454.CMB.1.raw
tcagactagcagtacacgaccggtgctcgatttagagtatacatattgggtttggggagtctcggtcaggacacagcatggacatgagggtccccgctcagctccgtggggctcctgctactctggctccggaggtgccagatgtgacatcgagctgacccagtctccatcctcctgtctgcaaccggtgggagacagtcgtccacatcacgttcggccggggactaacggtaccggaaactacgtttacggaaccttaacctttaaagttttaaaagttcggttaattaccaaactaattaacggaacccgaacggggtaccggaccccttaaaggcccttaccttaaattaccgttaatcggtactcggactactccgtagtttacgacgtaaaggtcgggtacctagtcggaggttcacggtggacgtaggtggtatcggtacgggactagtactttcacgttactcgaacctagtactaagttatcgtacgaccgtaagtgtaaagttcgtttacgacttaaacgttattacgtactaacaactaagtaactttactaagtttcggtttaccgaacgtaaggtacctaacgtaacttaaactaaagttaacgtacgtagtacggacttaccgactacttacgtacttcgttaccttaacgttaccttcccgttaccgaccttacttacgtcgttaaaccg

SEQ ID NO: 139440 - DNA, 687 bp, Homo sapiens
  misc_feature: GYAE6OF01E4EQC.46.67.G01.1.454.CMB.1.raw
  modified_base (359)..(359): a, c, t, g, unknown or other
  misc_feature (359)..(359): n is a, c, g, or t
tcagactagcagtacacgaccggtgctcgatttagagtatacatattgggtttggggagtctcggtcaggacacagcatggacatgagggtccccgctcagctccgtggggcctcctgctactctggctccggaggtcgccagatgtgacatcgagctcgaccctttagtcctccatccctcccttgtctgaccgtaaccggtgggacgacgtagtcgtaccaacctactaccaccgttcggccgggactaacggtaccggaaactagttacgaaccttaacctttaattttaaaagttggtactacaaaccgataacggaccgaacggggaccgaccctaacgcctaccttaatctancgtactcgacctagtccgttagtttacggagtaaacgggtccgggtaccaggttcgtagggttccgaggtacggcgtagtggtacgtcggtagggatactacgtttcactctacctacacgtactaagtactcgtacgactaaggtcgttaagttactttacgaccttaactttctaagtataacaacttagaaactttactacgtttcggttacgacgaaacggtacctaacgtaactaaactaacttaacggactcgaggtactacgaacctaccgtatttacgtcttacgttcctaccgttcccttacccatacttgtattaacg

SEQ ID NO: 139441 - DNA, 718 bp, Homo sapiens
  misc_feature: GYAE6OF01APM19.46.67.G01.1.454.CMB.1.raw
  modified_base (192)..(192): a, c, t, g, unknown or other
  misc_feature (192)..(192): n is a, c, g, or t
  modified_base (211)..(211): a, c, t, g, unknown or other
  misc_feature (211)..(211): n is a, c, g, or t
  modified_base (237)..(237): a, c, t, g, unknown or other
  misc_feature (237)..(237): n is a, c, g, or t
  modified_base (344)..(344): a, c, t, g, unknown or other
  misc_feature (344)..(344): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccagactgggtgaggccttggagacccctgtccctnacctgcgctgtctctggtncctccatcagttagttggtttctcgnggggctgggtccgcagccgtccggagggaacgggctaggaatactagttggaagtgtctctctataggtggtacggttccttattacgagttccgtctctacgaagngtcgacgtccaccattactctctacggactacgtcacgactaactcgtacgttttcccaggtaacgtagttgtacgtttcgtggtacggtacccggtccgtcgtacggtaaccgtacggggttacgttttaagttaccgttggtacggacggtaacggtaacgggtaccggtacgtttaactttaggttaagttttaacggtttttaggggtaaggttttacgggtttttaacttccggtaacctacccggttaaggtaccggtccgggtacccggggtccttacccgggtaccccggtcggggtaccgacgggttaacgttaccgttcgggtacccgtaccgttaccgttacccgtacggtccctaaccccgg

SEQ ID NO: 139442 - DNA, 891 bp, Homo sapiens
  misc_feature: GYAE6OF01AHL9V.46.67.G01.1.454.CMB.1.raw
tcagactagcagtacacgaccggtgctcgatttagagtatacatattgggtttgtcctcctgctggtggcagctcccagatgggtcctgtcccctggtgcaactgcaggagtccgggcccacgactggtgaggccttcggacgaccctgtccctcacctgcgctgtctcgtggtcgcctccatcagtagttggtttcttcgtggggcgtcgggtccggcagccgtcccggaaggggacgggcgtaggaatactagttggaagtgtcgtctcagtagtggtacggttcctattaccacgttccgtctctacgaagacgtcgtacgtaccacctattactcgtcgtacggacctaccgtaccgacgactaacgtcctttaccgttttacccgaggtaaacgtagttacggtagtttcgttacggtccggaacccgtccgtacgtacggtaacccggttacggggtttacctttttaacgttacggttggtacggtacgggaagtacggtaaccggtctttaagtttacgttaggttttacggttttagggtacgtttttaacgggttttaccgtaccgttaaccgtaaccccgtttaggtaccgggtttaccggggaccgggggttacccgtaccccgggtaaccccggggtaccgggggtaaccggtaaggggttaacccgttacgggttaccgggttaccctaaccccggttacccgtttacccgttaacccggtcccccgttaaacccgggaaaccccggtacccggggtcccccttaacccgggtttccccccgggtttaccccccgttttaccccccggccccgggttaaccccccttaccccccggtaacccctaacccgggtaacccgtcccggttaaccccccgg

SEQ ID NO: 139443 - DNA, 692 bp, Homo sapiens
  misc_feature: GYAE6OF01EFQT9.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatcctccctgtctgcaaccgtgggagacaggtgtcacctatcacgttcggccgggacaaggtcggaactattcgaacctaacttaattttaaacgtggtatacaacagtacgaccgagggaccgaccctaagcctacctaatctatgctgcactcgtagttcgacgtaaagggttcgggtaccctagtcggtaacggttcacgggtggacgtaggttcggagttcgtagggactagtacttcacttcactacctacgtacgtaagttactcgtacgacgtaagttagtaaagttctttacggtaacttaaacgtttacgttaacctaggtaactaaacgtaacggttaaattaacgttaatttcgggttttaaccggaaccggtaaacgggactaaacgttaacctaaaacgttaaacgtaaaccggtacgttacggtacggtacgtaaccgtacctaaccgtattaccgttcggttccttaaactaccgttcccttaccccgacgtttactccgtgttaacccg

SEQ ID NO: 139444 - DNA, 764 bp, Homo sapiens
  misc_feature: GYAE6OF01CM2KH.46.67.G01.1.454.CMB.1.raw
  modified_base (262)..(262): a, c, t, g, unknown or other
  misc_feature (262)..(262): n is a, c, g, or t
  modified_base (449)..(449): a, c, t, g, unknown or other
  misc_feature (449)..(449): n is a, c, g, or t
  modified_base (481)..(481): a, c, t, g, unknown or other
  misc_feature (481)..(481): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgactgggtgacggtccctttcgggacgaccccttggtccccctccgaccctgccgccttgtcctcgtggtcgccctccatcaggttagttggttttctcgnggggcttgggtccgacaggcctacccggaggggaacggggctaggtaataccgtagttaggaagttcgtactcgtacgtaagttaggtcgggtacggtttaccctaagtttaccgaaccgttccggttccttccgtaagaacggtacggtacgtacgtcaacctatactcgtctcggactacgaccncgacgtaactcgtaccttttccgagtaacgtntacgtacgttctcggtccgtaacccgtccgaccgtacggaaccggttacgggttagttttaaccgttacgtggttacgacggtaacgacggtaaccggtacttaagtttacgtagtttacgtttttagggtagtttcggtttaacgttaccgaaccgttacccgtagttacccgtcggggaccggtccgtacccgggtaccccggtagggtacccgtagggttaactaccggttacggtacccgtaccggttccttaaccccggttacgtcccgtaaccccgg

SEQ ID NO: 139445 - DNA, 716 bp, Homo sapiens
  misc_feature: GYAE6OF01CK9X7.46.67.G01.1.454.CMB.1.raw
  modified_base (206)..(206): a, c, t, g, unknown or other
  misc_feature (206)..(206): n is a, c, g, or t
  modified_base (709)..(709): a, c, t, g, unknown or other
  misc_feature (709)..(709): n is a, c, g, or t
tcagactagcagtacacgaccggtgctcgatttagagtatacatattggggtttggggagcctcggtcaggacacagcatggacatggacgggtccccgctcagctccgtggggctcctgctactctggcctccggaggtgccagatgtgactatcggagctcgacccagtcctccactccctcctgtctcgcgacggtggacacngtcgcacctactctacgtcggccggacgtaacgtacgtaactagttacgaacctaaccgtttaagtttaaacgttacggtaactaaccgaacgtaagtaccggaaccggaacgggaccccggtaccctaagtccttaccgtatacgttatcggtcacgacttacgtcgtaggtttacgacggttaacggtcggtaccgagttcggtagttcgagtcggacgtaggtcgtaacgtcggtacggtaactcgttaacttccactcctaacctctagtaacttacgtacttcgaacgtagtaaccggttagtaatttcgtaactacttacgttataacgtactaacaaacgttaattacgtaatttacggttcggtaaccggaacgaacggtaacccgtaaagtaaccttaaaacggtaacgtttaacgaacggttcggtaccgtcgtaactccggtaaacttcgtaccgttagtcccctacgttactccctacgtctattaccggnttaaccg

SEQ ID NO: 139446 - DNA, 684 bp, Homo sapiens
  misc_feature: GYAE6OF01E3VKL.46.67.G01.1.454.CMB.1.raw
  modified_base (171)..(171): a, c, t, g, unknown or other
  misc_feature (171)..(171): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtncctcatcagtagttggtttctcgtgggctcgggtccgcacgcctccgaggggaagggctaggaatacgagttggaagttgtctctcagttagtggagttcctattacagtccgtctctacaagagtcgagtcactatactctctggaccacgtccagacaatctacgtttccgagaagtagtagtacgttctgtcgaccgcgtcgtcgacgtacgggttcttttactacgttgtacgtacgtagtacggacgttaccgttaagtttacgttagtttagttttacgggtagtttacggttacgtttaccgaccgttacccgtagtacgtaccgggacggggtccgtaccggtcccggtacggggtaccgtaagggtaacttacggttcggtaccctaccgttcctaccgttacgcccctacccgtaacccggtaccggtacccctcggttccccgttaccccgttcccccgtcggtacccctaccccgtaccctacccgaagtccgtaccccgg

SEQ ID NO: 139447 - DNA, 787 bp, Homo sapiens
  misc_feature: GYAE6OF01C0ZMV.46.67.G01.1.454.CMB.1.raw
  modified_base (219)..(219): a, c, t, g, unknown or other
  misc_feature (219)..(219): n is a, c, g, or t
  modified_base (380)..(380): a, c, t, g, unknown or other
  misc_feature (380)..(380): n is a, c, g, or t
  modified_base (425)..(425): a, c, t, g, unknown or other
  misc_feature (425)..(425): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggccttcggagaccctgtccctcacctgcgctgtctcgtggtcgcctcatcagtagttggtttcttcgtggggctgggtccggcagccnccgaggggaagggctaggaatcagttggaagtgtctctcataggtggacggtttccttaatactacgttccgtacttctacgaagtaactcgagtaccaacctatatccgtactggaccaaccgtcaagactaacttcgtacgttttaccccgagtaacgngttcgtagtttcgtcgtacggacccggtccgtacgtgtaaccggngggtttaccttttaactttacgtgtacgggacggtacggtaacgtacgggttactttaagtttacgttagtttaagtttttgggtaggttttacggttttacgtttacccggtaacctaacccggttaggtacgggttcccggggtaaccgggggtacccgttaccccggggtacccccgggttaacggggggtaccggaacggggttaaaccgttccgttaccgggttaccgtacccgttccgtaccgtttacccgaccccgtaccgaaccggtaacccgggacccttacggttccccggttacccccttccccggtacgaccccgttacccctaccgtaaccggaacgtcccgtacccgg

SEQ ID NO: 139448 - DNA, 896 bp, Homo sapiens
  misc_feature: GYAE6OF01DRKRH.46.67.G01.1.454.CMB.1.raw
  modified_base (175)..(175): a, c, t, g, unknown or other
  misc_feature (175)..(175): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggacgaccctgtccctcacctgcgctgtctcgtggtcnccctcatctagttagttggtttcttcgtggggtcgtcggggtccggcacgtccgtacccggaagggggaacggggtcctaagggtaaacttacgtaggtttagggaacgtttcggtaccttaccgtactaaggtttagggtcgggttaacggttttacccttaagtttaaccgtacggttcccgttactaccgttaaccgaaagggttacggtaccgtaacgttaccccaaacctagttaaccgttcctaccggttacgggaacccctaaccggtacccgaacggtaaccttaaacgtttcccgtttaaccggtttttacccgtaaggtaaacggtacgttaggttaaccgtttcgtacggtaccgacccggtccgtcgtaaccggacgggttaccgggtttcttttaacgtacggttggtacggacgtaacgtaggtaccggttactttaagtttaggtttacggttttaagtttttgggtaagggttttagttttaaccgtttaccgaaccgttaaccgtagtaccggtccgggggaacgggtttacccgtcccgggtacccgggtacggggacccgtaagggttaaccttccggtacgtcccgtaccgttccgtaccgttacccgcccgtaacccgaccggtccgtacccttcggttccccgtccccgtccccggtcgtacccccgtacccttaccgaccgtaacgtccggtaccccg

SEQ ID NO: 139449 - DNA, 605 bp, Homo sapiens
  misc_feature: GYAE6OF01BIYIR.46.67.G01.1.454.CMB.1.raw
  modified_base (193)..(193): a, c, t, g, unknown or other
  misc_feature (193)..(193): n is a, c, g, or t
  modified_base (214)..(214): a, c, t, g, unknown or other
  misc_feature (214)..(214): n is a, c, g, or t
  modified_base (258)..(258): a, c, t, g, unknown or other
  misc_feature (258)..(258): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagacccttgtccctnacctgcgctgtctcgtggtcncctccatcaaggtagttggtttcttcgtggggcttggggtccgnagcctaccgaggggaagggctaggaactacgagttggaagtgtctctacataggtggaggtttcctagttacgagttcccgtctctacgaagcgtcgagtcacctattactctcgtaggacaccgtccgagtcaatcgtagttttcccaggtatagtgagttcgtgtcgaccgcgctcgacgcgggttactttaacgttacgtggtagacgtaggacggtacgtcttattcgtagtttagttttggagtttgtttacttcgactaccgtagcgtcggacgggtctccggaccggtgggacgtagggtaactcggtcggtaccctacgtccgttactccgcctacccg

SEQ ID NO: 139450 - DNA, 640 bp, Homo sapiens
  misc_feature: GYAE6OF01C5I8V.46.67.G01.1.454.CMB.1.raw
  modified_base (217)..(217): a, c, t, g, unknown or other
  misc_feature (217)..(217): n is a, c, g, or t
  modified_base (257)..(257): a, c, t, g, unknown or other
  misc_feature (257)..(257): n is a, c, g, or t
  modified_base (299)..(299): a, c, t, g, unknown or other
  misc_feature (299)..(299): n is a, c, g, or t
  modified_base (357)..(357): a, c, t, g, unknown or other
  misc_feature (357)..(357): n is a, c, g, or t
  modified_base (365)..(365): a, c, t, g, unknown or other
  misc_feature (365)..(365): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgacggccttcggagacccctgtcccctcacctgcgcttgtctcgtggtcncctccatcagttagttggtttctcgtggggctgggtccgnagcctccgagggaggctggaatacgagttggaagtgtctctnagtagtggacgttcctattcgacgtccgtctctacgagcgtcgagtcacctatactcnctggaccngtccagcaatctacgtttccagaagtagtgtagttcgtgtacgaccggccgtcgtacgaaccgtacggggttacttttaacgttacgtggtacggcggaaggtacggtaccgtactttatttaagttggtttacgttttaggaggtttacgtttagttaccgaacttaccgtaacgtcgtcggggacccgggtcgttaccccggaccggtaccgggacggtacgggacttacggtcggtccctaccggttccttcccgttacgcccgtaaccccg

SEQ ID NO: 139451 - DNA, 833 bp, Homo sapiens
  misc_feature: GYAE6OF01B0GER.46.67.G01.1.454.CMB.1.raw
tcagactagcagtacacgaccggtgctcgatttagagtatacatagttggggtttgggggacctcctgtgcaagaacatgaagcacctgtggtttgtcctcctgctggtggcagcctccagatcgggtcctcgtccgtggtgcaacgtgcgaggacggtccgggcccacggacgtggtcggacggtccgttcggacgacccctcgtcccctcgaccgtgccgtcttcgtctcgtggtctccctcatcgtaggttggttcggtttccgttcggtcggggtcgttccggggtccggaacgcggtcccgaccggggaagggggtacgggtctaaggactacgtaggttaggacgttgtacctgagtaaggttacggtcggttacgtttcctaagttaccgacgttccgttcacgtaacgaagtcgtacgtaagccctaatatttcgcgtacggtacgaaactccgtaccgagtacttaacgttcgtttaaccttacggagtaagtacgttgttacgttcgcgggttaccgacccgttcggcgttaacggtaccggttaccggtttactttaagtccggagggtacgaaccggtaacgggtacgttacttagttttaacgtttcggtttagggtttaacggttttgggaacggttttttcgtttaaaccgtacccggtaaacccgttaacgtggggtacccgggttccgggggtccccgggttaccccgttacccggggaaccgggtaggggtaacccgtaacgttttacccggcggttaccccggttacccggttaccctacccggggttccttaaacccgcccccgggtaaaacc

SEQ ID NO: 139452 - DNA, 807 bp, Homo sapiens
  misc_feature: GYAE6OF01CL54Z.46.67.G01.1.454.CMB.1.raw
tcagactagcagtacacgaccggtgctcgatttagagtatacatattgggtttgggggagtctcggtcaggacacagcatggacatgacgggtccccgctcagctcctggggctcctgctactctggctccggaggtgccagatgtgacatcgagctcgacccagtctccactccctccctgtctcgacgaaccggtgggagacagtgaccaccatcacgttggccggacgaacggtacggaactagttacgacctaacctttaattttaaacgttggtaactacaaactaagtacggaaccgaggggacccgacccttaacgaccttaccttaactctacgtcgtctacgactacgttcctaaggtttcggaacgtaaacgggttccggggtacccaacggttacggtacggttacgagggtacggacgtaggttacggtacgttacggtacggggtaactaacgtacgttttacctacgttactaaacccgtaactaagttaccgtaagtttaactccggttaacgtacgaaacggttagtaacgttttacgtttacgaaactttaactttacttaacgttacctaaaccgtaaattacgttaaacttacgtttaagggtttcggttaacccggaacgggtaaggtaaaccctacggttaaacttaaaaccgttaaaaacgttaacggaaccgttttcgggtaacgtacccgtaagacccttacgttacgttcgtttaccgtttacctttaaccccgtactttcccccttaaccccgttataagtttaacccggacgtttaaccc

SEQ ID NO: 139453 - DNA, 629 bp, Homo sapiens
  misc_feature: GYAE6OF01BRD1C.46.67.G01.1.454.CMB.1.raw
  modified_base (385)..(385): a, c, t, g, unknown or other
  misc_feature (385)..(385): n is a, c, g, or t
tcagactagcagtacacgaccggtgctcgatttagagtatacatattggggtttgggggacctcctgtgcaagaacatgaagcacctgtggtttgtcctcctgctggtggcagctcccagatgggtcctgtccctggtgcaactgcaggagtccgggcccacgactgggtgaggccttcggacgaccctgtcccctcacctgcgctgtctcgtggtcgcctccatcagttagtggtttcctcgtggggctgggtccgcagcctccgaggggagggctaggaatacagttggaagttgtctctctagttaggtgggtacggtttcctaattaccgacggttccgtctctaccaaggcgtacgagtccaccatactctcgtggaccncgtccagactaactcttacgttttccctagaagtatgtagttccgtgtccgcccgcgctacggtaccgtacgggttctttacttacgtggtcgcggagacgtacggtacttattagtgtttagttttggtagtttacggtttattccgactacccgtagaccggtcggaccggggtcctccggcccggtgggaccgtaggtacgtacgtcggtacctcccgttccttccctcgccccgtacccg

SEQ ID NO: 139454 - DNA, 789 bp, Homo sapiens
  misc_feature: GYAE6OF01EWTV3.46.67.G01.1.454.CMB.1.raw
tcagactagcagtacacgaccggtgctcgatttagagtatacatattgggttgtcctcctgctggtggcagctcccagatgggtcctgtccctggtgcaactgcaggagtccggcccacgactggtgaggcccttcggacgtacccctgtccctcacctgcgctgtctcgtggtcacctcatcagtagttgttcgtcgtgggctcgggtccgcacgtccgtaccgaaggggtacggcgtaaggaatactagttaggaacggtcgttctaccgtatagttaggtacggtacggtttaccttaattaccgtacgttcccgtaccttacgtacgtaaggtacgtccgtaacgtacccgaactaacgttacctaccttcggtaacgtaaccgtacccgtaacccgacgtaactaaccgttaccgtttaccgttttacccgaaggttaagtagttacgtacgttacgtcgtaccggtacccgacgtcgtacgtacggtaccggttacgtttaacgttcgaggtacgacgtaggtaccgtacggttactttagtttaagttggtttaacgtttaggtaacgtttacgtttacgttaaccgacccgttaccggtagtacccggtcgggtaccggtaccgtcccggaccccggtgggtaacccgaggtaaccgttccgtacgtacccgtaccgttcccgtaccgtcgtacccctacccgaacggtacccgtacctaccggttcccttccccggtcccgcccgtaccccctaccgtaccctacgaacgtcccgtcccg

SEQ ID NO: 139455 - DNA, 840 bp, Homo sapiens
  misc_feature: GYAE6OF01CTRLV.46.67.G01.1.454.CMB.1.raw
  modified_base (177)..(177): a, c, t, g, unknown or other
  misc_feature (177)..(177): n is a, c, g, or t
tcagactagcagtacacgaccggtgctcgatttagagtatacatattgggtttgtcctcctgctggtggcagctcccagatgggtcctgtccctggtgcaactgcgaggagtcgggcccacgacgtggtgacggccttcggacgccctgtccctcacctgccgctgtctcgtcggtnccctccatcaggttagttgggttttcctggtcggggcgttcgggggtcccgacgacgtccgtacccggaagggggaaggggtcctagggaataccgtagttagggaagttcgtccttcgataaggttaggtaggtaacggttcctaagttaacgacggttcccttactccttacgaaaggcgtaccgtaagttccactaacttcgtccttcgacggaccacgtcccgaagactaacttcgttaaccgttttccgagtaaacgtagtcgtaagttccgtggtaccggaacccgtccgattacgggaaccttaccggggtacgtttttatacgtggtaccgtaggacggaacggtcggtacttaagttagttagttaggttttaggtaggtttacgtttaacgtttccgaaaccgttaccgtaagtacggtacggacggggtcccgtacccggtaccccgggtagggcccgtaaagggtacgttaaccgtcggttaacccgaccgtttccgtttaccgtaaccggtaccccgtacccggtaaacccgggtaacccgggtacccgtaaacccgtttccccgggtttaaccccccgttccccccgggttaccgttacccccgtacccccgttacccgtaaaccccggaaggtaacccggacccccgg

SEQ ID NO: 139456 - DNA, 559 bp, Homo sapiens
  misc_feature: GYAE6OF01DP47S.46.67.G01.1.454.CMB.1.raw
  modified_base (215)..(215): a, c, t, g, unknown or other
  misc_feature (215)..(215): n is a, c, g, or t
  modified_base (272)..(272): a, c, t, g, unknown or other
  misc_feature (272)..(272): n is a, c, g, or t
  modified_base (494)..(494): a, c, t, g, unknown or other
  misc_feature (494)..(494): n is a, c, g, or t
  modified_base (513)..(513): a, c, t, g, unknown or other
  misc_feature (513)..(513): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtggagacagtgtcaccatcacttgccgggnaagtcgaacatgacactattaatgtatcaacatagacaggacgccctaagctctaanctatgctgcatccagttgcaagtgggtccagtcgagtcagtgcagtgatcgtagggactagtatttcactctacactatacgagtaatctagtactaacggttagtaagtatttagaacttactttattactcgtacaacaagtaacttaactaagtttcgtttaaccggacgtaaggtacacgtaactaacgaaagtttaacgaacgttagtacgccgtanaccgtaaccgtatttcctnttaccgttactaccttccttacccgtactaacgttcttacggtaac

SEQ ID NO: 139457 - DNA, 940 bp, Homo sapiens
  misc_feature: GYAE6OF01E1K33.46.67.G01.1.454.CMB.1.raw
  modified_base (195)..(195): a, c, t, g, unknown or other
  misc_feature (195)..(195): n is a, c, g, or t
  modified_base (216)..(216): a, c, t, g, unknown or other
  misc_feature (216)..(216): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgacggccttcggacgaccctgtcccctnacctgccgctgtctctggtcncctcatcagttgtcgtttctcggtggggctggggtccgcacgccgtaccggaggggacgggctaggaaatacgtaggttagggaagttcggtaccttccgtacgtaagttacgggtcgggttacggtttaccctttaacgtttaaccggtacggtttccccggttacgttaccgttaacgtaaacggttacggttaccggtaacgtttaccccaacccgttaatttaccgttaccgttaccgtaacgggtaacccttacccggttaccgaacggtaaccctaaacgtttcccgttttaaaccggtttttacccccgtaaaggtaaacgttaacgtttacgggttaaccggttttccgttacgggttaacccggtacccccgggttaccgttaccggttaaccgggtaacccgggttaaccgggttttaccgttttttaaccgtaacccgggttttggggtaccgtaaccgggtaacgggttaaccggttaaccggtttaccgtttaagtttaacggttcgttttaaagggtttttagggtacggttttaacgttttaccgttacgaacccgttaaccggtagtaccgggttacccgggtaccgggggttacctacccccggggtacccgggtaggggaacccgttagggttaacccgtccggttaccggggtaaccccttacccgttaccccgtttcccgtaccggtcccccttaaaccccggg

SEQ ID NO: 139458 - DNA, 699 bp, Homo sapiens
  misc_feature: GYAE6OF01C4C3F.46.67.G01.1.454.CMB.1.raw
  modified_base (196)..(196): a, c, t, g, unknown or other
  misc_feature (196)..(196): n is a, c, g, or t
  modified_base (208)..(208): a, c, t, g, unknown or other
  misc_feature (208)..(208): n is a, c, g, or t
tcagactagcagtacacgaccggtgctcgatttagagtatacatattgggtttgtcctcctgctggtggcagctcccagatgggtcctgtccctggtgcaactgcagggagtccgggcccacgactggtgaggccttcggacgaccctgtccctcacctgcgctgtctctggtgcctcatcagtagtgtttctcgngggctggtccgnagctccgaggggagggctggaatacgagttgggaagtcgtctctcgtagtaggtggtacggttcctatacgtacgtccgtctcctacgaaggacgtcgagtcaacctattatcctcgtacggaccaccgtccagacaactcttacgtttccagaactatgtacgttctagtcgacccgcgtctagtaccgacgggttatttacgtacgtgtagacggagtacggacggtacttaagttacgttaggtttagttttgggaagttttacgtttacgtttaccgtaaccgtacccgtagacgtccgggtacggggccgttcccggtacccggtggggaccgtagggtaactccggttcgggtaccctaccggttcccttaccggttacctaccccgtaccgaacccggtaaccggtccccttacggtccccggtttaccccttcccccgtacggtacccctaccccgttccctaaccgaacgtcccggtacccg

SEQ ID NO: 139459 - DNA, 902 bp, Homo sapiens
  misc_feature: GYAE6OF01BCJ8E.46.67.G01.1.454.CMB.1.raw
  modified_base (158)..(158): a, c, t, g, unknown or other
  misc_feature (158)..(158): n is a, c, g, or t
tcagactagcagtacacgaccggtgctcgatttagagtatacatagttgggtttggggagtctcggtcaggacacagcatggacatgacgggtccccgctcagcctccgtggggctcctgctactctggctccgaggtgaccagatgtgactatcganctcgaccctagtcctccacttccctccctgtaccgtcgaccgtaaccggtggactactgtcgtaccacctatccgtacgttcgggaccgggactaacggtaccggtaactacgttaccgaaccttaacctttaagttttaaaacgttggaaccttaccgaaaccgtacggtaaccggaccccggaacgggggtaccccgtaccccttaaagtcccttaacccttaagtctacgtcgtacgtcacttaccgttacgtacggtttacgaaccgtaacgggttccggaccctagtccggtagttcgaggttgactagggctacgtcggtaagtactagtttaccttacgacctttaccgacctaacgtactacgtaacgtacgtacgtacgaaccgtttaacggtagttaaaccgtttacgtttaacccgaaaccgtttaacggtttaaccttaaccgggtttaccgtaaacccgtaaacggttaaccgtttttaaaccgtttaacccggtttaaccgggtttttaaccggggttaaccccgggaaaaccccggttaaccgggtaaaccgtttaaacccggttaaaaaccgtttaaacgtaaaaccggtttaaccggtaaacggttcggtacccggtaccctacgggttaacccccatttaccccgggtttacaccccggtttttacccaaccgtttaccgtttacccccacccgttaattaaccgtttccggaaacgtttcccggg

SEQ ID NO: 139460 - DNA, 1086 bp, Homo sapiens
  misc_feature: GYAE6OF01D4IHC.46.67.G01.1.454.CMB.1.raw
  modified_base (243)..(243): a, c, t, g, unknown or other
  misc_feature (243)..(243): n is a, c, g, or t
tcagactagcagtacacgaccggtgctcgatttagagtatacatattgggtttgggggacctcctgtgcaagaacatgaagcacctggtggtttgtcctcctgctggtggcagcctcccagatcgggtcctcgtcccgtggtgcaactgcgagggacgtccgggccctacggactgggtcgacggtcccttcgggaactccccttcgtcccctcaccgtcgccgtcttcgtcgtcgtggtccnccctcctagtaccgtaaggttacggtttggttttccgtcgggtcggggggtccggttcgggggtcccgacgacgtcccggttacccgggaagggggtaacggggtcgtaagggtaactaacgtaggttacgggtaacgttcggttcctcgtacgtaaggtttagggttacggggttaaccggttttacccttaacgtttaaccggtaccgttcccggttaccttaccgttaacggaaacggttacgtacccgggttaaccgttaacccctaacccttaatttaaccgttaccgttaccccggtaacgggtaaccccgtaccccggttaacccgaaccggtaaccttaaccgtttacccggtttaacccgttttttaccccggtaaaggttaaaacgttaccggtttaaccggtttaaccggttttaccggttacccgggttaaccgggaaccccccggtcccggttaccggttaaacccggggttaaacccggggtttaaacccgggggtttttacccgtttttaaacggtttacccgggtttacgggttaacggtaacccggggtaaacggttaacgggtaccgtttaacgtttacgtttaaggttagggttttaacgggtttttacggtacgggtttttaacgggttttaacccgtttaaccggtaaccccgtaccggtttaaccggaccggggttaaccggggtaccccgggggttcccgttaaccccgggggtccccgggttacgggggaaacccgggtttaacgggtaccgttaccgggttccggttaaccccggtccgtttacccgttacccggttcccgaccccgtaacccccggg

SEQ ID NO: 139461 - DNA, 854 bp, Homo sapiens
  misc_feature: GYAE6OF01EL1PW.46.67.G01.1.454.CMB.1.raw
  modified_base (237)..(237): a, c, t, g, unknown or other
  misc_feature (237)..(237): n is a, c, g, or t
tcagactagcagtacacgaccggtgctcgatttagagtatacatattgggtttgggggacctcctgtgcaagaacatgaagcacctgtggtttgtcctcctgctggtggcagctcccagagtcgggtcctgtcccgtggtcgcaactgcgagggacgtccgggcccacgacgtgggtcgacggtcccgttcggacgtacccctcgtcccctcaccgtgcgtctgtcctcgtcggtcncctcatcgtagttggttcgtttcttcggtcggggtcgttcggggtccgacgacgccgtaccggaaggggacggggtctaggtaatacgtaggttaggaagtcgttctcgtcgtagtaggtggtacggttacttacgttacgcgttccgtacttctacgtaagtcggtacgtacgtacctacctattacctccgtcgtacggaacccgtaccgtccgaacgtaccgtaacgttcgtttaccgtttacccaggtaactgtacgtttacggttcgtcggtacccgccggtaccgtcgttacggaaccggttacgggtttactttacgttacgtcggtaagggaccgtaacgggtaccggttacgtttattaacgttttcggttaaagggtttttggttttaacgggtagttttaccgggttttacccttaaccggtaccccttaaccgggttaagtacccgggtacccgggggttaaccccggtcccgggttaaccccgggtccccgggttaaggggaacccggtacgggggtttaacctttccgggtaccccgggttaacccgttaccccggtttaccccggtttaacccggttaccgtaccccccggttaaccccggg

SEQ ID NO: 139462 - DNA, 859 bp, Homo sapiens
  misc_feature: GYAE6OF01DDFEL.46.67.G01.1.454.CMB.1.raw
  modified_base (852)..(852): a, c, t, g, unknown or other
  misc_feature (852)..(852): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtcctagcaaccggtggacacagtcgtaccaccattcaccgtttggcccggactaaaggtccggaacctagttagaaccttaccttaagttttaaacttgggttaacttaaccaaacgtacgttaacggaacccgtacgggggtaacccggtacccctaaaaggtccccgtttacccttaaaattccgttaaacgttcgggtaccttacgggttacctaacccgtttacccggttaaggtttttaccggaacccgggttaaaaggttcccgggggttacccctaaacgggttccggttaacggggttacctagggggttaccgtaccgtaaggggttacggaacgttacccgggtaggggtaaactacgggtttaaccttttcccgaaccttaccggttacaaacccgttctaaccgggttaaacttaaccgtggttaaccgaaccgttcgtaaaggtagtttttacgtacctaaactttaacttacgtacgttacaaactacggaaatttacgtaaacgtggtttacggttaaacccaacggggtaaacgtccgtaaaccttacgtaaaacttaacgggtaacctcggttacggtaacctgaccctaaccgactttaacgggttcttcccggtaacttcccgtaaccctttcccgacccgaaacctttctacggttntaaaccc

SEQ ID NO: 139463 - DNA, 703 bp, Homo sapiens
  misc_feature: GYAE6OF01CJK0J.46.67.G01.1.454.CMB.1.raw
  modified_base (234)..(234): a, c, t, g, unknown or other
  misc_feature (234)..(234): n is a, c, g, or t
  modified_base (405)..(405): a, c, t, g, unknown or other
  misc_feature (405)..(405): n is a, c, g, or t
  modified_base (443)..(443): a, c, t, g, unknown or other
  misc_feature (443)..(443): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcagggacgtccgggcccacggacgtgggtgacgggtcccttcgggacgaccccttggtcccctcacccgtgccgcgttgtctcgtggtcncctccatcgagttgttggtttctcggtggggctcggggtaccgcgacgtccgtaccggaggggaacggggtctaggaactagagttaggtaagtcgtctctctagtagtggtacgttctactacgacgttccgtctctacgaagtacgtagacgtacacctatactctcgnggacacgtcagactactctacgtttcccgtagaacgtntaggtacgttcgtaggtacggacccgtcgtacgttacgaaccgtaccggggttacttttacggtacgtggttacggacgtaagtaccgggtacgtactttagttacgtgtttaggtttcggtaggtttacggttattaccgaaccgtaccgttaggacggtccggggaccgggtctaccccggtccgggtaggggaccgtagggtaacttcggttaccggtacccgtacccggttctacccgtaccgccctaaccccggg

SEQ ID NO: 139464 - DNA, 728 bp, Homo sapiens
  misc_feature: GYAE6OF01ECFV7.46.67.G01.1.454.CMB.1.raw
  modified_base (74)..(74): a, c, t, g, unknown or other
  misc_feature (74)..(74): n is a, c, g, or t
  modified_base (170)..(170): a, c, t, g, unknown or other
  misc_feature (170)..(170): n is a, c, g, or t
  modified_base (196)..(196): a, c, t, g, unknown or other
  misc_feature (196)..(196): n is a, c, g, or t
  modified_base (251)..(251): a, c, t, g, unknown or other
  misc_feature (251)..(251): n is a, c, g, or t
  modified_base (348)..(348): a, c, t, g, unknown or other
  misc_feature (348)..(348): n is a, c, g, or t
  modified_base (366)..(366): a, c, t, g, unknown or other
  misc_feature (366)..(366): n is a, c, g, or t
tcagactagcagtacacgaccggtgctcgatttagagtatacatattgggtttggggagtctcggtcaggacanagcatggacatgagggtccccgctcagctcctggggctcctgctactctggctccgaggtgccagatgtgacatcgagctgacccagtctcatccnccctgtctgcaaccgtggagacagtntacaccgatcacttcgccgggcaagtcggaacattgacacctaatttaaatgtanacaacagtagaccagggaccgacccaagctacctaatccttaatgctgcatcccgagtttagacgtaagtcggggttacccatcgtaaggttcaggnggacaggtacggtatcgnggactaagtattccacgtctacaccgtataccgaagttaactacgttacgaacgtaaacggttaacggtaaacggtttaagttttaccggtaaccttaaaaccttttaagtttaaaccggtttacgttaacgtaaaacggttaaattaaacgtttaaccgttaacggtttacggtttttaaccgggaaccggttaaaacgggtaacaaaccggttaaacttaaaaccgtaaaaagtttaaaaccgaaaccgttacgggtacggtaccttaaccggtaccgtaaacctacgttaccgttaccgttaacgttcccgtaacgttacccgttccccgaacccgtacgtttacgtacgttaaacccg

SEQ ID NO: 139465 - DNA, 575 bp, Homo sapiens
  misc_feature: GYAE6OF01E3DXL.46.67.G01.1.454.CMB.1.raw
  modified_base (566)..(566): a, c, t, g, unknown or other
  misc_feature (566)..(566): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagatagtgtcaccatcacttgccgggcaagtcggaacattgacacctatttaaatgtatcaacatagaccagggacgtccctaagctcctaatctatgctgcatccagtttgcaaagtcgggtcccatcgaggttcagtggcagtgatcgtgggacaggtatttcactctcaccatcagttaactctagctaacgtagtaagtattttcgactaacgtttattactatacaaacgtaataactttaactaagttcgttttaccggaaccgaaagggtactaaccgtaactaaactaaacgttaaacgtaactggtagtactcggacctactaacttcttcgttaccgttactaccttccttaccccgtacctcttntcgttaacg

SEQ ID NO: 139466 - DNA, 641 bp, Homo sapiens
  misc_feature: GYAE6OF01A8978.46.67.G01.1.454.CMB.1.raw
  modified_base (221)..(221): a, c, t, g, unknown or other
  misc_feature (221)..(221): n is a, c, g, or t
  modified_base (433)..(433): a, c, t, g, unknown or other
  misc_feature (433)..(433): n is a, c, g, or t
  modified_base (613)..(613): a, c, t, g, unknown or other
  misc_feature (613)..(613): n is a, c, g, or t
tcagactagcagtacacgaccggtgctcgatttagagtatacatattgggtttgggggacctcctgtgcaagaacatgaagcacctgtggtttgtcctcctgctggtggcagcctcccagatgggtcctgtccctggtgcaactgcaggagtccgggcccacgacgtggtgaggccgttcggacgtaccctgtcccctcacctgcgtctgtctcgtggtcncctcatcagtgttgtttctgtgggtctcgggtccgcagtccgtccgaggggacggctaggaactacgagttaggagttgtctacgtctagttggtcgggtacgttcctaagttaccgacgttccgtctcgtacgaagtcgtcgacgtaccactatactccgtacgtacgacctaccggtacagactactccgttaacgtttccagtaacgtnttaggtacgttctggtccggccgtccgtctaggacgtcgggttatttacgtacgtggtcgacgagtacgactagttacttagtggtttagtttggtaggtttagttccgtacgactaccgtagcgtccgggcgggtacctccgggtacccggtgggaccgtaggtactccggtcgtaccnccgttacctccgttccgccctaacccgg

SEQ ID NO: 139467 - DNA, 739 bp, Homo sapiens
  misc_feature: GYAE6OF01D5P7M.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctcgacccagtcctcctactccctcccgtgtctcgaccgaaccggtggagactagtcgtaccaccatcaccgttcggccgggtacaaggtacgaactattacgaacctacctttaaagtttaagttacggtataaccaactaacgtacgaaccggaccgggaccgaccctaacgtccttacctatcttagtgactcgtactacgtcgtagttagacgtaacggtccgggtactacgtaggtacggtcgtaggtcgtagtaggtggtacgttcggtagggtactaaggtcctttacgactacctacacgtacttaccgtaagtactacggtactacggtaagttaacgttagtttaacttaccgtactttaaacgtttacgtatttaaccgaacttaaacgtaacgtttaacttaacttacggtttacggttaccgaacggtaacgtaaccgtaaagttaacctaaacggttaaacgttaaaccggtcgtaaggtacccggtactacccgtaaccttcaacgtttcccgttaattccttaaccgttaccctccctttaacccggtacctagtttccgaacggtttaac

SEQ ID NO: 139468 - DNA, 648 bp, Homo sapiens
  misc_feature: GYAE6OF01AOGPF.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcgaaccgtgggagacagtgtccaccatcacttggccggacaagtcggaacattgacacctatttaagttgtatacaacatagaccgagggaccgccctaagtcctacctaatctatgcgtgacactccgtagtttcgacgtaaacggttcgggtccctagtacggtaggttcgaaggtcggacgtaggtggtactacggtagggaactaggtactttcgactcgtaccacctatactaagtactacgtgacctaaggtataaagttagtttacgtaactttaacgtttattaccttagtaacaacgttaagtaacttaacgtaagtttcgtttacggaacgtaacggaacctaacgtaacttaaaacgtaaacgttaacgtaacgttaggtactcgtaccgacctaacgtacttacgttactcgttaccttacgttccccgttacccgtacctacttccgtagtaacg

SEQ ID NO: 139469 - DNA, 602 bp, Homo sapiens
  misc_feature: GYAE6OF01BW9CH.46.67.G01.1.454.CMB.1.raw
  modified_base (342)..(342): a, c, t, g, unknown or other
  misc_feature (342)..(342): n is a, c, g, or t
  modified_base (346)..(346): a, c, t, g, unknown or other
  misc_feature (346)..(346): n is a, c, g, or t
tcagactagcagtacacgaccggtgctcgatttagagtatacatatttggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccgcagccgtcccgaggggaaggggctaggaatacgagttggaagttgtctctcagtagtggaggttcctattacagtccgtctctcaagagtcgagtcaccatatctctggacacgtcagcaatctagtttcccngaanatgagttctgtcgaccgccgctgactacgggcttttatacgtgtgcgagagacgtctattagtgttagttttggtagttgtttatttcgacctaccgtagtactcgggacgggtccgtccggaccccgtggggaccctaaggggtaacttcgtacggtcacccgttcgttccttacgtccctccgaccgtaacgggcccacgtcccggttcccttcccccgtggaccctacccctccctaccgaacgcgtaccccg

SEQ ID NO: 139470 - DNA, 673 bp, Homo sapiens
  misc_feature: GYAE6OF01CGCSO.46.67.G01.1.454.CMB.1.raw
  modified_base (348)..(348): a, c, t, g, unknown or other
  misc_feature (348)..(348): n is a, c, g, or t
  modified_base (397)..(397): a, c, t, g, unknown or other
  misc_feature (397)..(397): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactgggtgagggccttcggacgaccctgtccctcacctgcgctgtctcgtggtcgcctcatcagttagtcggtttcttcgtggggcgtcgggtccggcacgccgtccggaaggggaaggggtctaggaatactagttggaagttcgtctctacagttaggtcggtaggttacctattacgacgttcccgtctctacgaagtcgtcgagtaccacctatactcctcgngacctacgtcagacaatctacgttttccgagtaacgtagtgtagttcgngtaccgaccgccgctaggtacgcgggtttatttactacgtgcgacgagacgtcgtatagttagtagttatttgggtagtttgtttactacgtaccgtacctagtaccgtcgggtacgggccgtaccggcccggtagggacgaagggttacctacgtcggtacctaccgttcgtaccgtccgtaccctaccgaacccggtacggtacccgttaccggttcccgttcccgttacccgccgtacccctacccgtcccgaacctacggtacccgtaccgg

SEQ ID NO: 139471 - DNA, 561 bp, Homo sapiens
  misc_feature: GYAE6OF01ESTZW.46.67.G01.1.454.CMB.1.raw
  modified_base (392)..(392): a, c, t, g, unknown or other
  misc_feature (392)..(392): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgcaaccgtggagacagtgtcaccatcacttgccggcaagtcggaacattgactacctatttaaatggtatcaacatagaccaggacgccctaagctcctaatctatgctgcatcctagtttgactaaaggtcgggtcccagtcgaggttcaggtgcagtggatcgtgggacagtacttcactctcacctatcagtatctgcaacgtgaagtntttgactaacttattactgtacaactaagtaactttacaattgtttaccggactaagggtactaacgtacttaactaaagttaacgaacttgtacgtactacgtacgaccgtagttactcgttacttaccgtacttacccgtttaccccgaccttacttccgtgtaacg

SEQ ID NO: 139472 - DNA, 770 bp, Homo sapiens
  misc_feature: GYAE6OF01ET7QU.46.67.G01.1.454.CMB.1.raw
tcagactagcagtacacgaccggtgctcgatttagagtatacatattgggtttggggagtctcggtcaggacacagcatggacatggacgggtccccgctcagctccgtggggctcctgctactctggctcggaggtgccagatgtgacatcgagctacgaccagtcctccactccctcctgtctgcacggtggacacagtctacactatcacgttcggccggtacaaggtacgaatcgttacgaccttactttaagtttaaagttggtactactaactacgtaacggaaccgacggggacctacccgtaagtcccttaacctatacgtatcgctcgactactcgttagttcgacgtaacgggtccggtactacgtacggtacggttcaggtcgacgtaggtacgtcgtacggtacgggaactagttacttccgaacgtccctaaccgaccgtataaccgtaagttacgtaccgtagaaccggtagttagttaacgtttactttaacgtaacgtttaaacctttacgtttacgtaacggttaaacctaaacgttaacgttaaacgttttaaccgtaacggttttaccggtttaaccggaaacccgggttaacgaaacccgtaaacgtttaaaccgttaaaacgttaaaccgttaaacggtacgttacggttcgaccgttaacccgttactaacccgttattcccgttaccgtttaccttaacggttcccctttacccggtacccttacgtaccgttcctaacggtttacc

SEQ ID NO: 139473 - DNA, 694 bp, Homo sapiens
  misc_feature: GYAE6OF01EZLS7.46.67.G01.1.454.CMB.1.raw
  modified_base (335)..(335): a, c, t, g, unknown or other
  misc_feature (335)..(335): n is a, c, g, or t
  modified_base (350)..(350): a, c, t, g, unknown or other
  misc_feature (350)..(350): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctcatcagtagtggtttcttcgtggggctgggtccggcagctcccaggggaggggctggaatacattggaagtgtctctcatagtggaggttcctattacagtccgtctctcaagagtcgagtcaccatatctctggacacgtccagcaatctagttttcccngtaagatgacgtttntgtcgaccgccgtctgaccgacgggtcgttttacttacgttgtcggcgaggaaggtaccgggtcttaagtttagttagttagttttttagggtaggtttagggttttattttccggtaactaccccgttaaggaacgttccgggacccgggggtaccccgtaccccgtccggggtaccgggacgggtaacggtacgttacggttccgtaaccgttccgtccgttacgtcccgtacccacccgtaaaccgggcccgaccgttacccggttcccctttacccccggttccccgtacccgtacccccgttacccctacccgaacccggtacgccgttaccccccggg

SEQ ID NO: 139474 - DNA, 672 bp, Homo sapiens
  misc_feature: GYAE6OF01EVKZT.46.67.G01.1.454.CMB.1.raw
  modified_base (310)..(310): a, c, t, g, unknown or other
  misc_feature (310)..(310): n is a, c, g, or t
  modified_base (315)..(315): a, c, t, g, unknown or other
  misc_feature (315)..(315): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgcagatgtgacatcgagctgacccagtctccatccctccctgtctgccaaccggtgggacgacagtcgtaccaccatctacgttggccgggacaaggtaccggaactattgacctacttaatttaaatggtatcaacatagaccagggaccggaccctaagcctacctaatctancgtcngcactctagttgacgaagtcgggtcccagtcgtaggttcgagtggctaggtggacttcgagggtatagtacttctaccgtcaccaacgatactaagttaactcgtacgactaacgttaggtaaagttaacgttttacggaacttaaacctttacgttaacttacggtaaactaacgttaaaggtaactttaaaccgttagtttaacggttttacccgggaaccggtaaacgggtaaccgtaaaaccggtaacttaaaaccgttaaacgttaaaccgtaacgtacgttaggtaccgtacgacctaacctacttcgtacttccttactacttccctacccgaccctacgtgtagtaccg

SEQ ID NO: 139475 - DNA, 815 bp, Homo sapiens
  misc_feature: GYAE6OF01E29G2.46.67.G01.1.454.CMB.1.raw
  modified_base (765)..(765): a, c, t, g, unknown or other
  misc_feature (765)..(765): n is a, c, g, or t
  modified_base (806)..(806): a, c, t, g, unknown or other
  misc_feature (806)..(806): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctccactccctcctgtctcgaccgtaaccggtggacgacgtaggtcgtccacctactccgtacgttcggcccgggactaacggtacggtaaactacgttacgaaccttaaccgtttaattttaaaagttacggtaactaaccaaacgtaagtaaccgggaacccggtaacggggaacccccgtaaccccgttaaagtaccccttaaccctaattaccgttaagtccgtacctacggtaaccctaccttaccggttaacggtttacggaaccggttaaaccggggttcccgggtacccgttaagttccggggtaagttccggtaagggtcggtaccgtagggtacgtaacggttcggtaagggtaccttaacgttctttacccgaacttccctaaccgtaactacgtaacgttaactcgacgttaccgaactaacgtttagtaaatttacgtttaacgttaatttacgtaactagtaactaaagtacgtttaagtacgttacgtttcgggtaccaacgggtaacaacgttaaccctaaagtttaaaccgtaaaacgtacggtacgttcggacgttacggacctacgttaccttactgtttaacgnttaccccggtacttccccgtacccgaatttagccgtttacngtttaaccg

SEQ ID NO: 139476 - DNA, 831 bp, Homo sapiens
  misc_feature: GYAE6OF01CB28Z.46.67.G01.1.454.CMB.1.raw
  modified_base (214)..(214): a, c, t, g, unknown or other
  misc_feature (214)..(214): n is a, c, g, or t
  modified_base (263)..(263): a, c, t, g, unknown or other
  misc_feature (263)..(263): n is a, c, g, or t
tcagactagcagtacacgaccggtgctcgatttagagtatacatattgggtttgtcctcctgctggtggcagctcccagatgggtcctgtccctggtgcaactgcaggagtcgggcccacggactgggtgaggccttcggacgacccctgtcccctcacctgcgtctgtctcgtggtcgcctcatcagtagtgtttctcgtgggctgggtccgnagcctccggaggggagggtctaggaatacgtagttaggagtcgtctctntagtaggtggtacggttcctaacgttaccacggttcccgttctctacgaaggacgttcgacgtccaaccgtattacgttcctacggtacgggaccctaccggttaccacgtaaccttaaacgttccgtttaaccggtttttccccgaagggtaaaaccgttggtttacggttaacgttttccggttgggttaaccccgaccccgggtcccgtaccgttacggaaaccgggttaccggggtttacttttacgttaacgtcgggtacggtaccgggaaaggtaccgggtacggttcgttaagtttaggtttacggttttaaggtttttagggtacggttttacggttttacgtttaccgaaaccccgttaaccgttaggtaaccggtacccgggggtccgggtacccgttaccccgggtcccggggtacggggtaccgaacggggtaacttccggtacggtccctacggtccgttaccgtgacccctacgacccggtacgtccctcggttcccgttccccgttccccggccgtaccctacccccggttcaaccggtaagcccgtaacccg

SEQ ID NO: 139477 - DNA, 649 bp, Homo sapiens
  misc_feature: GYAE6OF01DRFB0.46.67.G01.1.454.CMB.1.raw
  modified_base (192)..(192): a, c, t, g, unknown or other
  misc_feature (192)..(192): n is a, c, g, or t
  modified_base (643)..(643): a, c, t, g, unknown or other
  misc_feature (643)..(643): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctcctgtctgcaacggtggganacagtgtacacatcacttcggccgggacaacggtcggaactagttgaacctaaccttaatttaattggtatacaaacatagaaccgaggaccgccctaagctacctaatctatgctgacactccgtagtttacgacgtaaaggtcgggtacccagttcgaaggtttcgagtcgcgtagtagtatcggtggaactagtactttcacttcctacaacctatacctaattaacttcgtaacgtacctaacggttagtaaacgttaatttagtaacttaaacgtttaactttaacgttacgttaactaaactaagttaaactttaacttaacgttacggttttaccggaaccgtaaacggaaccgtaacgtaaacttaaacgtaaaacttaaacgtaacgtagtggtacctaggacctacctaatcgttactcttacacttccttaccactcttntagtac

SEQ ID NO: 139478 - DNA, 744 bp, Homo sapiens
  misc_feature: GYAE6OF01BNQ6L.46.67.G01.1.454.CMB.1.raw
  modified_base (194)..(194): a, c, t, g, unknown or other
  misc_feature (194)..(194): n is a, c, g, or t
tcagactagcagtacacgaccggtgctcgatttagagtatacatattgggtttggggagtctcggtcaggacacagcatggacatgagggtccccgctcagctccgtggggctcctgctactctggctccgaggtgccagatgtgacatcgagctgacccagtctccatcctccctgtctgaccacggtggganacagtcgtccacatcacgttcggccgggacaacggtcggaactgttacgaactaccttaatttaagttggtatacaactatacgaccgacgggaccgtaccctaagctacctaatcctagtcgctacgacacttccgtagtttcgacgtaacggtcgggtacccagtaccggtaggttacaggtcggtactaggtcggtaacgttcggtagggaacctagttacctttaccgaccttcctactaacctattaccgtaagttaaccgtcgtacgaaccgtaaggttacgtaacgtttagtttacggaacctttaaacgttttacgtttacgtacggtaaacctaacgtaaagtttaacctttaacgtaagttttcgggtttaaccggaaccgtaaacgggtacctaaaccggtaaccttaaaacgttaaaccgttaaaccgtaacggttgggtaacggtaccgtacgtaaccctaacgtttacgtaccgtttcggttaccttccccttaaacgttccccttaacccgacttacgtttacgtacgttaaacg

SEQ ID NO: 139479 - DNA, 662 bp, Homo sapiens
  misc_feature: GYAE6OF01BT9IH.46.67.G01.1.454.CMB.1.raw
  modified_base (173)..(173): a, c, t, g, unknown or other
  misc_feature (173)..(173): n is a, c, g, or t
  modified_base (303)..(303): a, c, t, g, unknown or other
  misc_feature (303)..(303): n is a, c, g, or t
  modified_base (307)..(307): a, c, t, g, unknown or other
  misc_feature (307)..(307): n is a, c, g, or t
  modified_base (332)..(332): a, c, t, g, unknown or other
  misc_feature (332)..(332): n is a, c, g, or t
  modified_base (369)..(369): a, c, t, g, unknown or other
  misc_feature (369)..(369): n is a, c, g, or t
tcagactagcagtacacgaccggtgctcgatttagagtatacatattgggtttgtcctcctgctggtggcagctcccagatgggtcctgtccctggtgcaactgcaggagtccgggcccagactgggtgaggccttacggagccctgtccctcacctgcgctgtctctggtcncctcatcagtgttgttcttcggtgggctggggtccgcagcctacccggaggggacgggtctaggaatacgagttggaagttcgtctcgtatagtaggtggtacggttctaagttacgagtccgtctctanaagngtcgatccacatactctcgtgaccngtccagcatcttacgtttaccagaagtgtgtacgttntcggtacgacccgcgtactcgacgtacgggtactttatcgtgtcgacgagaggtacgtattattagtgttagtttggtagttggttacttacgtaacctccgtagtacggtcgggtaccgggtcctaccggacccggtgggtaccgtaacggggtaacttacggttccggtactacccggttcgtacccttacggtacccaaccccgtaccgggaaccgtacccgaccggttccccggttcccctaccccgtccgacccgttaccccgtaccgtaacccacgtacccgtcccg

SEQ ID NO: 139480 - DNA, 752 bp, Homo sapiens
  misc_feature: GYAE6OF01DBKUD.46.67.G01.1.454.CMB.1.raw
  modified_base (192)..(192): a, c, t, g, unknown or other
  misc_feature (192)..(192): n is a, c, g, or t
  modified_base (256)..(256): a, c, t, g, unknown or other
  misc_feature (256)..(256): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccggtggganacagtgtcacatccacttggccgggacaagtcggaacattgacacttaatttaatggtatcaanatagaccgagggaccggccctaagccttacctaatctatgctgctacgtacctaggtttcgacgtaacgggtcggggttacccagtacggtacggttacgacggtgggaccgaggttagggtacgttcgtacggggtaactaacggttacttttaccacgttcctaaccgacctaacttaaccgtaaggttaacttccgtacggtaacgtaacggttaacggtaaagtttactttacgtaaccttaaactttttacgttacgtttacgtaacctaacgtaacgttaaactttaacgttaagttttccggtttaccggaacccggtaaacgggtaacccgaacgttaaaccttaaacgtaaaaccgtttaaacggaccgtttagggtacggtacttaccggacccttaaaccgtcgtttaccgtttacggttaccctttagtaaccccgttttcccggttacccccgttaccgtaactttcggttaacgttaacccg

SEQ ID NO: 139481 - DNA, 700 bp, Homo sapiens
  misc_feature: GYAE6OF01A8LXU.46.67.G01.1.454.CMB.1.raw
  modified_base (207)..(207): a, c, t, g, unknown or other
  misc_feature (207)..(207): n is a, c, g, or t
  modified_base (285)..(285): a, c, t, g, unknown or other
  misc_feature (285)..(285): n is a, c, g, or t
  modified_base (336)..(336): a, c, t, g, unknown or other
  misc_feature (336)..(336): n is a, c, g, or t
tcagactagcagtacacgaccggtgctcgatttagagtatacatacttgggtttgtcctcctgctggtggcagctcccagatgggtcctgtccctggtgcaactggcaggagtcgggcccacgactggtgagccttcggagccctgtccctcacctgcgctgtctctggtgcctcatcagtgtggtttctcgtggggctgggtccgnagctcccgagggagggctggaatacagttggaacgtgtctctcatagtggagttcctattacagtccgtctctcaagngtcgagtcaccatatctctggcacgtcagcaattcagttttcccagaacgntgagtctgcgaccgcgctgacctacgggtcgtttaattaccgtggtacgacggagacggaccggtacttacgttacgttggttaagttttttcgggaggtttcggtttacgttttacccgtaaccgtaccccgtaggacgttccgggtaaccgggggtaccttcccgggaacccccgggtcggggaccgtacggggtaacgttaccggtcggttacctacccggttccgttacccgttaccggccccgttaccccgaaccccggtaacgggtccccccgtaagttccccgggttacccctttccccccggtaccggtccccctaacccccgttaccccgtccccgtaaaccgccggtaaccccg

SEQ ID NO: 139482 - DNA, 697 bp, Homo sapiens
  misc_feature: GYAE6OF01CWFLZ.46.67.G01.1.454.CMB.1.raw
  modified_base (230)..(230): a, c, t, g, unknown or other
  misc_feature (230)..(230): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaacgtgggagacagtcgtcaccatcacttggccgggacaagtcggaactnttgaccacgttaatttaacgtgtaatacaaacatacgaccgaggaccggacctagcctactaatctatcgctgctatccgtagtttacgacgtaaacgggtcgggtacccagtcggtaggttacgaggttcggagtaggtaggtaacgtcggtagggaactacgtacttttaccgacctttacgtcctaaccagttacgtagttaactacgtgtaccgtaacgtagtaaacgtttatttacgtaacttaactttacttacgtacgttaacgaacgtaacttaaactttaaccttaagtttcggttttaaccgggaaccgtaacggtaaccgtaacccgtaagttaaaaccgtaaaacgttaaccggtaacgttggttaaccgcggttacgaccgttaaccgtatttacctcgttacttacccgtactttaccccgtaacccgtaccttaactcccgttaagtacccg

SEQ ID NO: 139483 - DNA, 887 bp, Homo sapiens
  misc_feature: GYAE6OF01EA3KV.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtcctccactccctcctgtctcgaccgaaccggtgggacgacgtagtcgtaccaacctactacctacgttcgggcccgggactaacggtaccggaactagttacgaaccttaacctttaaattttaaagttaggttaactacaaactaagtaaccggaaccggaaccggggaacccgtacccgtaagtccctaccttaattactactcgtcgtcgactactacgtagttacgaacggtaacgggtccgggtacctacggtacggtaggttacgtagggtcggacgtaggttcggacgttcgggtacgggtaactacggttactttaccgtacctaccgtaaccaaccgtaacttaacgtaaacgtttaaccgtccgttaacggaaccggtaaacgttagttaaagtttacgtttaaccgtaaactttaaacgtttaacgtttaccgttaacgtaaaccgtaaacgttaacgttaaaccttttaaaggttaaccggttttaccgggtttaacccgggaaaccgggtaaaccgggtaacccgttaaaccgttaaaaccgttaaaacgttaaaaccggtttaaaaccggtaacggtttacgggtacggttacctacccggtaaaaccgtacccgtttaacgttccggtttaacccgtttaccttaacccgtttaaccccgtttacccccgttaaccccgacgtttaaccgtttcgttaccgttaaaccg

SEQ ID NO: 139484 - DNA, 811 bp, Homo sapiens
  misc_feature: GYAE6OF01BAWCS.46.67.G01.1.454.CMB.1.raw
  modified_base (174)..(174): a, c, t, g, unknown or other
  misc_feature (174)..(174): n is a, c, g, or t
  modified_base (209)..(209): a, c, t, g, unknown or other
  misc_feature (209)..(209): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgagggccttcgggagaccctgtccctcacctgcgctgtctctggtcncctcatcagtagtgtttctcgtgggctgggtccgnagcctccgaggggagggctaggaatacagttggaagtgtctctgtagttaggtggtaggttccctaagttacgacgttccggttctaccgttagaaggtacgtcgacgtacacctatatcctcgtaggacctactcagactaactctacggtttcctaggaacgtgtagtagttcgtacggtcgaaccgccgtgtacgtaccgtacggggtttactttacgttacggtcggttaggacggtaacgggtaacgtacccggggttacttaacgttttaaggttagtttttaacgggttttacggggttaagttttaacggggtttttaactttcccgggttaaaacccgttaacccggttagggttaaccggtcccggggttaaacggggggttcccccgtaacccggggttacccccgggtaggggacccgggttaaaggggtaaaccgttcgggttaccggttacccgtacccgggttaccctttacccggtaccgtaccccggtaacccgaacccgggtaccggtcccgtacggttccccgttacccccgttcccggtaccggtacccctaccccgttacccaacgtaccgccgtacccgg

SEQ ID NO: 139485 - DNA, 770 bp, Homo sapiens
  misc_feature: GYAE6OF01DDBQN.46.67.G01.1.454.CMB.1.raw
tcagactagcagtacacgaccggtgctcgatttagagtatacatattgggtttggggagtctcggtcaggacacagcatggacatgacgggtccccgctcagctccgtggggctcctgctactctggctccggaggtgccagatgtgacatcgagctcgacccagtcctccactccctccctgtctgaccgtaaccggtgggagacaggtcgtaccacctatcctaccgttcgggacccggggataacggtaccggaactacgtttacgaacctaacctttaattttaaagttacggtaactacaaactacgtaacggacccggaaccggggacccggtacccgtaacgaccttacctaacttctatcggtctgaccgtacttacgtaggtttacgaacgtaacgggtacgggtaccagtacggtacggtacgaggtcggacgtaggtacccggtagtcggtacgggtaacgtacgtactttaccgtaccttacctacctaacctacgttacgttaacgtaccgttacgtacgaaccgttaacggtagttaacgtttactttaacgtaacctttaactttaacgttacgttaacgtaactaaacgttaacgttaacttaacgtttaacgtttacggtttaaccggaaccggtaaacggtaaccgtaacgttaacgtaaaacttaaacgttaacgtaacggttacgtacggtactacgtaccgtactacttcgttcttaccttctacgttccctctactactcgttagtac

SEQ ID NO: 139486 - DNA, 737 bp, Homo sapiens
  misc_feature: GYAE6OF01ETOW9.46.67.G01.1.454.CMB.1.raw
  modified_base (182)..(182): a, c, t, g, unknown or other
  misc_feature (182)..(182): n is a, c, g, or t
tcagactagcagtacacgaccggtgctcgatttagagtatacatattgggtttgtcctcctgctggtggcagctcccagatgggtcctgtccctggtgcaactgcaggacgtccgggcccacgacgtgggtgacggtccttcggacgacccctgtccctcacctgccgctgtctcgtggtcnccctcatcagttgttgtttctcggtgggtcgtgggtccgcacgccgtaccggaagggggacgggtctagggtaactacgagtttaggaagttcgtctgtacagttaggtggtacgttacctattacgcgttccgtctctacgaaggtacgtacgacgtaccaacctagttacttccgtacgtacggaacctaccggtaccgaagacctaacttcctttaccgttttacccgaagtaaggtattacggtacgtttcgtacggtaccgacccgtccgtaccggtacgtaaccggttacgggtttacttttaacgtacgtgggtacggacgtacggacggtaccgtattacgttacgttaggtttagtttaggtacgtttgtttactaccgacctacgtagtacggtcggggtacgccgtacccggaccggtcgggtaaccgtagggtaacttcggtacgtaccgtccgttccgttacctaccgtcccaccggaccggtaccgtaccgtcgtcccccggttcctaccccgtcgacccctcgtaccacgacgctcccgg

SEQ ID NO: 139487 - DNA, 650 bp, Homo sapiens
  misc_feature: GYAE6OF01CMLEW.46.67.G01.1.454.CMB.1.raw
  modified_base (176)..(176): a, c, t, g, unknown or other
  misc_feature (176)..(176): n is a, c, g, or t
  modified_base (216)..(216): a, c, t, g, unknown or other
  misc_feature (216)..(216): n is a, c, g, or t
  modified_base (274)..(274): a, c, t, g, unknown or other
  misc_feature (274)..(274): n is a, c, g, or t
  modified_base (306)..(306): a, c, t, g, unknown or other
  misc_feature (306)..(306): n is a, c, g, or t
  modified_base (311)..(311): a, c, t, g, unknown or other
  misc_feature (311)..(311): n is a, c, g, or t
  modified_base (383)..(383): a, c, t, g, unknown or other
  misc_feature (383)..(383): n is a, c, g, or t
  modified_base (555)..(555): a, c, t, g, unknown or other
  misc_feature (555)..(555): n is a, c, g, or t
  modified_base (607)..(607): a, c, t, g, unknown or other
  misc_feature (607)..(607): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgacggtccttggacgaccctgtccctcacctgcgctgtctcgtggtcnccctacatcaggttagtgtttctcgtgggctgggtccgancgtcgtaccgaggggtaacgggcttaggaactacgtagttaggaagttcgtctcgtanaagttgtggtacgttcctatacgacgtccgtntctanaagtgtcgagtaccactattactctacgtaggtacacgtcagtacgtaactcgttacgtttaccaaggtaanacgttgtaacgttctacggtacggaacccgtccgtacgtcgaaccgttacggggttatttagttacgtgaggaccgaggtacggtagtacgttattacgtagtttagtttaggcgtttagtttactaccgacctaacgtaggtacgtcgggacgttacgccgttaacccggngggactaacgggtatccgtagtcccacgttctaccgttgacccagaacccgngtcctcggtcctccctccgctcccacttccagtcgccgtaccg

SEQ ID NO: 139488 - DNA, 778 bp, Homo sapiens
  misc_feature: GYAE6OF01CM183.46.67.G01.1.454.CMB.1.raw
tcagactagcagtacacgaccggtgctcgatttagagtatacatattgggtttgggggacctcctgtgcaagaacatgaagcacctgtggtttgtcctctgctggtggcagctcccagatgggtcctgtccctggtgcaactgcgaggagtccgggcccacgacgtggtgacggtccgttcggacgacccttcgtccctcacctgcgctgtctcgtggtcgcctctaaaatccgagttaggttcggtttctcggtgggcgttcggggtccggcacgccgtaccggaggggaacgggctaggaactaacgtaggttaggaagttcgtacctctcgtagttaggtgggtaacgtttcctattaaccgtcgttcccgtctactacgaaggtacgtccgtagtacctacctattaccgtcgtacgttacggtaaccctaccgtaccaacgtacgtaaactttccgtttaaccgttttaccaacggtaaacgtgttacggttaacgttttcggtacgggttaacccgccccgtacgtcggttaaacccggtacgggttaacccgggttttatttttaaccgggtactgggtaccggaaggtacgacggtaccgttattaaggttttcgtaaacgttttggttttaagggtcggtttacgttttaaccgtcgacccgtacggtaggtaccgggtacgggccgggttccctacccgggcccgggttagggaaccgtaaggtactcggttacggccttacgtccctttacggcccctcgtacccgg

SEQ ID NO: 139489 - DNA, 891 bp, Homo sapiens
  misc_feature: GYAE6OF01AOEMM.46.67.G01.1.454.CMB.1.raw
  modified_base (212)..(212): a, c, t, g, unknown or other
  misc_feature (212)..(212): n is a, c, g, or t
  modified_base (354)..(354): a, c, t, g, unknown or other
  misc_feature (354)..(354): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtcnccctcatcagttgtcggtttctcgtggggcttggggtccggcagccgtcccggaggggaacggggtctagggaactacgtagttggaacgttgtcctctcgagttacggtaggtacggtttacctattaccgagttcccgtntctacgaaagtcgtcggacttccaacctaattactccgttcgtacgggacctaccggttacccaaggtacctaaactttcccgttaacggttttttaccccgaaggtaaacgtacgtttcgggtaagttttccgtacggttaccgggaaccccgtcccggttaccgtacggtaaacccgggttaaccgggggttaccgtttttttaaacgtacccggttgggttacggacccggtaaagggtaacggttaacccggggttactttaaacggtttaaacgttttcggttttaaaggtttttttaggggtaacgtttttacggggttttaacttttaccgggtaaccccgtaacccggtttaaggtaaccgggtcccggggttaacccgggggggttcccttaccccggggttaaccccccgggtaggggggaaccccggttaaaggggtaaacccgttaccgggttacccgggttaaacccgttacccccgggtttacctttacccccggtttaacggtccccccggtaaacccccgg

SEQ ID NO: 139490 - DNA, 685 bp, Homo sapiens
  misc_feature: GYAE6OF01CPVH5.46.67.G01.1.454.CMB.1.raw
  modified_base (216)..(216): a, c, t, g, unknown or other
  misc_feature (216)..(216): n is a, c, g, or t
  modified_base (257)..(257): a, c, t, g, unknown or other
  misc_feature (257)..(257): n is a, c, g, or t
  modified_base (303)..(303): a, c, t, g, unknown or other
  misc_feature (303)..(303): n is a, c, g, or t
  modified_base (324)..(324): a, c, t, g, unknown or other
  misc_feature (324)..(324): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgactgggtgaggccttcggacgaccctgtcccctcacctgcgctgtctctggtcncctccatcagttagtggtttctcgtggggtctggggtccgnacgcctaccgaggggagggctaggaatacagttggaagtgtctctnagtaggtggacgttctatacncgtccgtctctacaagtagtcgagtccaacctattactctcgtacggacaccgtaccagtactaacttccgttacgttttacccgagtaacgtattacggttacgtttccgtgtaccggtaccccggtcgtaccgtacggtaaccggtaccggggtttacttttacgttaccgtggtcggaccggtagacggtacggttacttaagtttagttgtttaaggttttggtagtttcggtttacttacgtacctaccgtagtcggtcgggaccggggtcctaccgggtacccggtggggtaccgtaacgggttaactcggttccggtacctaccggttaccttcccgtacgtcccctaacccgg

SEQ ID NO: 139491 - DNA, 982 bp, Homo sapiens
  misc_feature: GYAE6OF01DHMHP.46.67.G01.1.454.CMB.1.raw
  modified_base (175)..(175): a, c, t, g, unknown or other
  misc_feature (175)..(175): n is a, c, g, or t
  modified_base (263)..(263): a, c, t, g, unknown or other
  misc_feature (263)..(263): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactgggtgaggccttcggacgaccctgtccctcacctgcgctgtctctggtcncctcatcagtagttggttctcgtggggctgggtccgcagccgtacccggaggggaacgggctaggaatacgagttggaagttgttccnctactagtaggtggtacggtttcctaagttaactacggttcccgttacttaccgtacgaaggtacgttaccggacgtaccaaccctattacgttcctcggttacgggaacctacccggtaccaggtaacctaacttccgttaaccggttttttaccccaggaaacgttaacgtttacggtttacggtttacttacgggtacccggaaccccgggtccccgtaccggttacggaacccgggttccgggggttttaccgtttttaatttaccgggttcggttacgggacgggtaacggtacgggtacccggttaatttaacgtttagtttaggttttaacggttttttaggggttacggttttacggtttttaaccgtttaacccgtaacccgttaacccggttaacgtacgggttacccgggggtaccgggggtaccccgtttacccgggtaaccccccggggttacgggggaacccgggtaaagggggttaaccgtttaccgggttacccgggttaccccgtttaccccggttaccccgtttaccccgtttaccccgaccccgttaccccgaacccccgggtaaacccggggttacccccttaaccgggttttcccccccggttttaccccggttttcccccccccggacgggttaaccccccctttacccccgttacccccgtaaacccgtaaaccgggtccccggttaacccccggg

SEQ ID NO: 139492 - DNA, 704 bp, Homo sapiens
  misc_feature: GYAE6OF01ERGF0.46.67.G01.1.454.CMB.1.raw
  modified_base (402)..(402): a, c, t, g, unknown or other
  misc_feature (402)..(402): n is a, c, g, or t
tcagactagcagtacacgaccggtgctcgatttagagtatacatattgggtttgggggacctcctgtgcaagaacatgaagcaccttgtggtttgtcctcctgctggtggcagctcccagatgggtcctgtccctggtgcaactgcaggagtcgggcccacgactggtgaggccttcggagaccctgtcccctcacctgcgctgtcctcgtggtcgcctccatctacgtagttcggttttctcgtggggctggggtccgcagcctcccgaagggacggggctaggaactaacagttaggaagtcgtctctacagttaggtggtaacgttccttaagttaccacggtccgtactctacgaagagtacgagtccaacctatactctacgtggactaccgccganactaattcctacgtttaccctaggaatagtcgtaagtttcgtgtacgaccgccgtcgtacgacgtacgggttactttacgttacgtgttacggacggaacggtaggtacggtactaattacgttaggtttaggttttaggtagtttaggttactttcggaaccctacccgtaggacggttaccggggtaccggggtcccgttaacccgggaccccggtacggggaaccggaaggggtaacgttacgtaccggttacccgaaccccggtttacctaccggttacccgtcccgtaaacccccgg

SEQ ID NO: 139493 - DNA, 671 bp, Homo sapiens
  misc_feature: GYAE6OF01DWRYP.46.67.G01.1.454.CMB.1.raw
  modified_base (244)..(244): a, c, t, g, unknown or other
  misc_feature (244)..(244): n is a, c, g, or t
  modified_base (333)..(333): a, c, t, g, unknown or other
  misc_feature (333)..(333): n is a, c, g, or t
  modified_base (338)..(338): a, c, t, g, unknown or other
  misc_feature (338)..(338): n is a, c, g, or t
  modified_base (344)..(344): a, c, t, g, unknown or other
  misc_feature (344)..(344): n is a, c, g, or t
  modified_base (484)..(484): a, c, t, g, unknown or other
  misc_feature (484)..(484): n is a, c, g, or t
  modified_base (594)..(594): a, c, t, g, unknown or other
  misc_feature (594)..(594): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgaccagatgtgacatcgagctacgacccagtcctccactccctccctgtcctagaccgaaccggtgggacaacgtgtcgacacctacgtctacgttcggcccgggtaanaacggtaccggaatacgttcgaacctaacttaagttttaactggtactacgacagtacgacgacgggacacctagctacctatcgttancgtcngactanccgtagtttcgacggtaacggttcggacctaagtccggtaagttccgagggttcggacgtaggtcgtacgttacggtacgtacgtacgttacttcgaaccttcacacgtctacgtatactctagacctatacggtaattnttacgaactttacgttacttcggtactaactactaagtaactacgttagttacgttaacgacggtaacggtctaaacgtaacttaaacaaagttaccgaaacgttcggtnacccgtgtaaccacgtttactacgttattccctacttacctttaccccgggcccttacgacttcccggtaagtcccg

SEQ ID NO: 139494 - DNA, 644 bp, Homo sapiens
  misc_feature: GYAE6OF01AHLPM.46.67.G01.1.454.CMB.1.raw
  modified_base (235)..(235): a, c, t, g, unknown or other
  misc_feature (235)..(235): n is a, c, g, or t
  modified_base (481)..(481): a, c, t, g, unknown or other
  misc_feature (481)..(481): n is a, c, g, or t
  modified_base (493)..(493): a, c, t, g, unknown or other
  misc_feature (493)..(493): n is a, c, g, or t
  modified_base (513)..(513): a, c, t, g, unknown or other
  misc_feature (513)..(513): n is a, c, g, or t
  modified_base (591)..(591): a, c, t, g, unknown or other
  misc_feature (591)..(591): n is a, c, g, or t
  modified_base (602)..(602): a, c, t, g, unknown or other
  misc_feature (602)..(602): n is a, c, g, or t
  modified_base (613)..(613): a, c, t, g, unknown or other
  misc_feature (613)..(613): n is a, c, g, or t
  modified_base (636)..(636): a, c, t, g, unknown or other
  misc_feature (636)..(636): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatccgagtctgaccgagtccgtaccactcccgtcccgtgtctcgacgaaccgtggaagcagttcgcaccataccacgttcggaccgggnaacggtacgatattcgaactacttaatttaatggatactaacagtacgacgacgggacctacccgtaagcctacctaatctgtgtacctgacctacgtaccggtagtttacgaacggttaaacggtccggggtaccctaaggttcggtaccgggtttaagcggttaccgggagtaggtttaagggctttaccgggaggtttaccgagtacctttacgacctcgtaccgtactactgaactttacgntcggactaggtntaacgttattcaacgtttanaacgttcaagtcaacttagacttatcgtttacgtacggaagtaacacgtaactaacgtaaagtaataaccgtgtcggnttacacgtacnccggatctaancttactactcgtcccaatcgtancccttagg

SEQ ID NO: 139495 - DNA, 751 bp, Homo sapiens
  misc_feature: GYAE6OF01DJO8B.46.67.G01.1.454.CMB.1.raw
  modified_base (207)..(207): a, c, t, g, unknown or other
  misc_feature (207)..(207): n is a, c, g, or t
  modified_base (268)..(268): a, c, t, g, unknown or other
  misc_feature (268)..(268): n is a, c, g, or t
  modified_base (560)..(560): a, c, t, g, unknown or other
  misc_feature (560)..(560): n is a, c, g, or t
  modified_base (737)..(737): a, c, t, g, unknown or other
  misc_feature (737)..(737): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtcccgtggtgacactgcaggagtccgggcccacgactggtgacggccgttcggacgtccctgtccctcaccgtgcctnttgtctcgtggtcacctcatcgtagttgttcggtttctcggtgggtactcgggtaccgacncgcccgtccggaagggtacggcgtaggtaatacgtagttaggaacgttgtacctctacgtagttcggtaggttacgtttacgttaacgttaccgtaccgttcccgtcttacgtaccgtaaggtaccggtacggtacgtaccctaactaacgttacttccgttacgtacggtaacctaccgtacgaccgtactaccgtttaccgttaccggttttaccaaggtaatagttacgttacgttcgtcgtaccggtccgtacgtcgtacggtacggtacggtttacgtttacttcgnggtacgacgggtaagtacggtaacggttactttagttagttacgttttacgtttaggtagggtttaccgtttaacgttacccgtaaccgttacggtagtaccgggtcggtaccggtccctacccggtaccgggtacggacgtaggtaacgttcgtacgtccgtaccgtaccgttacnccgtccctaccggg

SEQ ID NO: 139496 - DNA, 722 bp, Homo sapiens
  misc_feature: GYAE6OF01DKFJP.46.67.G01.1.454.CMB.1.raw
  modified_base (705)..(705): a, c, t, g, unknown or other
  misc_feature (705)..(705): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatccctccctgtctgccaaccggtgggacgactagtcgtccaacctatcctaacgttcggacccgggactaaaggtaccggaaactagtttacggaacctaaccgtttaaatttttaaagttggtaactacctaaactagtaacgaccgaacggggacccgaccctaagccttactaatctatcgctgctactccgtagttacgagtaacgggtcgggtaccctaagtcggtaggttcaggtgacgtaggtcgagtcgtaggactagtcctttacgaccttcctactaactactacgtaacgttaacttccgacgtaacgtaacggtgtaaagtttcgtttaacaactttaacgtttatacgttaacgtacctaaataacgtttaactttaacgagttttacccggttacggaacccggtaaacggtacctaaccgttaaactaaacgttaaaacgttacgtaccgttagggtcgaccgttacgacctaaaccgtcgttacgttcctactttcctaaaccttccccggttaaaccccncgttagttcgtagtacc

SEQ ID NO: 139497 - DNA, 662 bp, Homo sapiens
  misc_feature: GYAE6OF01BD4F8.46.67.G01.1.454.CMB.1.raw
  modified_base (168)..(168): a, c, t, g, unknown or other
  misc_feature (168)..(168): n is a, c, g, or t
  modified_base (189)..(189): a, c, t, g, unknown or other
  misc_feature (189)..(189): n is a, c, g, or t
  modified_base (214)..(214): a, c, t, g, unknown or other
  misc_feature (214)..(214): n is a, c, g, or t
  modified_base (224)..(224): a, c, t, g, unknown or other
  misc_feature (224)..(224): n is a, c, g, or t
  modified_base (645)..(645): a, c, t, g, unknown or other
  misc_feature (645)..(645): n is a, c, g, or t
tcagactagcagtacacgaccggtgctcgatttagagtatacatattgggtttggggagtctcggtcaggacacagcatggacatgacgggtccccgctcagctcctggggctcctgctactctggctccgaggtgccagatgtgacatcgagctgacccagtctccntcctcctgtctgcacgtgganacagtgtcaccatcacgtggccggnaagtcgaacnttgacctactatttaatgtatacaacatagaccgagggaccgaccctagctactaatctatgctgacctactccgtagtttcgacgtaaggtccgggtaccagtcggtaggttgaggtggactaggtggtactcggtagggactaggttacttcaccttcctacgtaccctagttacaacgttactaccgttacgaccgttaacggtaagttaacgttaacttttcggtaaactttaaacctttactttacgtacgttaacctaagtaaacgttaacttaacgtttagtttaacggtttaccggaaccggtaaagggtacctaaaccggtaacttaaacgtaaactaacgtacgttaggagtaccgtagaccctacgttattcggttacttccgttacgacctttcccgtacccgttaccncgtttaccgtagtaccg

SEQ ID NO: 139498 - DNA, 641 bp, Homo sapiens
  misc_feature: GYAE6OF01DXDH2.46.67.G01.1.454.CMB.1.raw
  modified_base (187)..(187): a, c, t, g, unknown or other
  misc_feature (187)..(187): n is a, c, g, or t
  modified_base (216)..(216): a, c, t, g, unknown or other
  misc_feature (216)..(216): n is a, c, g, or t
  modified_base (606)..(606): a, c, t, g, unknown or other
  misc_feature (606)..(606): n is a, c, g, or t
tcagactagcagtacacgaccggtgctcgatttagagtatacatattgggtttggggagtctcggtcaggacacagcatggacatgagggtccccgctcagctccgtggggctcctgctactctggctccgagtgcagatgtgacatcgagctgacccagtctccatcctcctgtctgcacgtgganacagtgtcaccatcacgttcggccggganaagtcggaactattacgactaccgttaattttaaattggtactacaactagtaacgaaccgacgggaccgaccctaagtcctacctaatctatgctgcatcgtagttagacgaaacggttcgggtacccagtcggtaggttacgaggtcggacgtagggtcgtagtcgtacgggatacggttactttccgtacgtcctacgaactacttacaagtttactcgtacgtacgtaacgttagtaaagttatttacgaccttaaatttactaacgttacgtaactaaataagttaaacgtttaactaagttttcggtttaaccggaacggtaacggtacctaacgtaacgttaaaactaacgtaaacgtacgttaggtgtacacgtactacttntactcttcttacacgttcctccatcttgtctaacg

SEQ ID NO: 139499 - DNA, 593 bp, Homo sapiens
  misc_feature: GYAE6OF01DIROC.46.67.G01.1.454.CMB.1.raw
  modified_base (250)..(250): a, c, t, g, unknown or other
  misc_feature (250)..(250): n is a, c, g, or t
  modified_base (331)..(331): a, c, t, g, unknown or other
  misc_feature (331)..(331): n is a, c, g, or t
  modified_base (400)..(400): a, c, t, g, unknown or other
  misc_feature (400)..(400): n is a, c, g, or t
  modified_base (450)..(450): a, c, t, g, unknown or other
  misc_feature (450)..(450): n is a, c, g, or t
  modified_base (462)..(462): a, c, t, g, unknown or other
  misc_feature (462)..(462): n is a, c, g, or t
  modified_base (470)..(470): a, c, t, g, unknown or other
  misc_feature (470)..(470): n is a, c, g, or t
  modified_base (582)..(582): a, c, t, g, unknown or other
  misc_feature (582)..(582): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtcgcctccatcgagttagtgtttctcgtgggctgggtccgnagcctccgagggagggctggaatactagttaggaagtgtctctcagtgtggtacgttctattacacgttcgtctctcaagntcgagtaccgactagttactcgtacgtacgacacgtccagtctaatcttacgttttaccgagtaacgtntagtcgttcgtgtcgaccgtcgtcgtgacgtacgggtacttttacgttgngttcgacgtagnggtacgtnttagttatagttagttttcggagtttggttacttaccgaactaccgtaggacgtcgggacggtcgtaccgcccggtggaccgagggtactacgtcgttaccgacgttctacncgccctaaccg

SEQ ID NO: 139500 - DNA, 1059 bp, Homo sapiens
  misc_feature: GYAE6OF01DHV1J.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagcctcccagatgggtcctgtccctggtgcactgcaggagtccgggcccaggtacgtgggtgacggccctttcggacgaccccttgttccccctacaccttggcccgtcttcggttccttccgttcgggtccgtccccttaccacttccgtaagggtttacggtttcggttttttccttcggtgggggtccgttacgggggttcccggacgacgtcccgttaccggaacgggggtaacggggtaccgttaggtaaacgttaaccgtaaggtttaggggtaaacgtttcggtacctttccgttacgtaacggttagggttacggggtttaacgggtttacctttaacgtttaacgtaccggtttaccccgttaccttaccgttacggtaaacggttacgtaccgggtaaacggttaccctaaacccgtaatttaacgttcccgtttccggtacggggtaaaccccgtaccgttacccgaaacggtaacctaaaccgtttacccgtttaccggttttttacccctaagggaaacgttacgttaacggttacggttttccgttcgggtacccggtacccccggtcggtacccgttaacggtaacccgggtaacgggttttacgttttaactttaccgggtcgtaaccgggtacggaacggtaacgggtacccggttaacttttacgtttaaggtttggttttacggttttttaacgggttacggggttttaaggttttaaccgttttacccgtaaacccggtttcccgggttaaacggtaccgggtttacccggggggtaccccggggtaccggttaacccccgggttaccccccgggtagggggtaaccccgggttaaagggttaaccccgtttacgggttacccggttaaccccggttacccggtttacccttttaccccgggtacccgtcccccggttaaacccccggg

SEQ ID NO: 139501 - DNA, 823 bp, Homo sapiens
  misc_feature: GYAE6OF01D5S88.46.67.G01.1.454.CMB.1.raw
  modified_base (174)..(174): a, c, t, g, unknown or other
  misc_feature (174)..(174): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggcctttcgggagaccctcgtccctcacctgcgctgtctctggtncctccatcagtgtggtttcttcgtgggctgggtccgcagctaccgagggacgggctaggaatacgagttggaagttgtctctcagtaggtggtacggttctagttactacgtccgtctctacgaagagtcgagtccactattacttcctcgtcggaccacgtccagtacaattctacgttttacccagtaacgtagttacgtagttcgtcggtccgacccgtccgtacgtaccggaccggtaccggggttaccgtttttaacgttacgtcgggttacgacgggacggtaacggacccgggttatttaagtttaacggtttggtttaaggttttttaggggttaggttttacggttttaccgtttaccggtaacccgtaccccgtttaagggtaccgttaccgggggtacccgggggttaccgttacccgggaaccccgggtttcggggggaacccggttaaacggggttaaccgtttaaccgggttaccggttacccggttacccggtttaccgtttaccccggttacccgtaccccgtacccgtaaccccgggtaaccgggtcccctaccggtttccccgggttacccccttccccgggaccggtccccctaccccgttaccccgtaccggaaacggtccgtaccccg

SEQ ID NO: 139502 - DNA, 631 bp, Homo sapiens
  misc_feature: GYAE6OF01BYD65.46.67.G01.1.454.CMB.1.raw
  modified_base (172)..(172): a, c, t, g, unknown or other
  misc_feature (172)..(172): n is a, c, g, or t
  modified_base (254)..(254): a, c, t, g, unknown or other
  misc_feature (254)..(254): n is a, c, g, or t
  modified_base (350)..(350): a, c, t, g, unknown or other
  misc_feature (350)..(350): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggcccttcggagaccctgtccctcacctgcgctgtctctggtncctccatcagtgtgtttctcgtgggctgggtccgcagcctcccgaggggaagggctaggaatacgagttggaagtgtctctnataggtggaggttcctattacagtccgtctctacaagagtcgagtcaccgatactctctcggacacgtccagcaactctacgttttcccagtaatntgtagttctggtacgaccgtccgctgaccgtcgggtctttatacgtgtgacgtagagacgtactagttagtgttagttttggagttgttacttcgacctacctagtacgtcggtacgggccgtccgtacccgtacgggccgaagggtaactacgtcggtaccgtaccgtccttaccgttaccgtcccgtacccgaccggaaccgggtccctaccgttcccggtaccccgttcccccgtacgggtaccctaccccgtaccctacccgaacggccgtaccccg

SEQ ID NO: 139503 - DNA, 778 bp, Homo sapiens
  misc_feature: GYAE6OF01BDAAY.46.67.G01.1.454.CMB.1.raw
  modified_base (184)..(184): a, c, t, g, unknown or other
  misc_feature (184)..(184): n is a, c, g, or t
  modified_base (212)..(212): a, c, t, g, unknown or other
  misc_feature (212)..(212): n is a, c, g, or t
  modified_base (647)..(647): a, c, t, g, unknown or other
  misc_feature (647)..(647): n is a, c, g, or t
  modified_base (695)..(695): a, c, t, g, unknown or other
  misc_feature (695)..(695): n is a, c, g, or t
tcagactagcagtacacgaccggtgctcgatttagagtatacatattgggtttgtcctcctgctggtggcagctcccagatgggtcctgtccctggtgcaactgcaggagtccgggcccacggactgggtgacgggccctttcgggacgacccttgtccctcacctgccgctgtctcgtggtcncctccatcagttagttggtttccttcgnggggtccttggggtccgcagcctaccggagggggaagggtcctaggaaatacgtgttagggaagttgtctctcagttcggtggtacgttctattacacgttccgttctctacaaggtacggtcgaacgtcaacccgtagttactaccttcgtaacggacctaccggttaccagacctaaatcccgtttaacgtttttaccccaggtaaaacgtgttacggtacggtttacgtcgggttaccgacccggcccgtacggtaacggacccggttacgggtttaccgttttaaatttcggtcgttacgggacggaggtaaccggtacgggttactttaacgtttagttaacggtttaagttttacgggtaggttttacggttaccttacggtacctaaccgtggtacgtccggggtacggtcctaccggtaccccgggngggacccgtagggtaccgtacgttcggaccgtaccgttctccgttacnccccgtaccgaacgacccggtcccttacgtcccggttacccctacccgcgtacccctaccccttacaacaaccgtcgtacccg

SEQ ID NO: 139504 - DNA, 841 bp, Homo sapiens
  misc_feature: GYAE6OF01C7PLI.46.67.G01.1.454.CMB.1.raw
  modified_base (175)..(175): a, c, t, g, unknown or other
  misc_feature (175)..(175): n is a, c, g, or t
tcagactagcagtacacgaccggtgctcgatttagagtatacatattgggtttgtcctcctgctggtggcagctcccagatgggtcctgtccctggtgcaactgcaggacgtccgggcccagactggtgaggccttcggagaccctgtccctcacctgcgtctgtctcgtggtcncctcatcagtagttggtttcttcgtggggtctcggggtccgcacggtcctcccggagggggaacggggtctagggaactacgtagttagggaacgtgttcctctcgtaacgttaggttcggtacggtttcctagttacgacgttccgtctactacgaaggacgtcgacgtcacctattactctcgtcggaccaccggtacacgtctaaacgttcttaccgttttacccctaggaaacgtacgttaggtacgttttacggttacgggtacccggaccccgggtccggtacttaacggtacccgggtaaccgggggttttactttaaacggtttacggttcgggacggtacgggtaacggtacggtaaccgggttacttaaggtttcgttaggtttttacgttttagggtacggttttagtttaccgttaccggtaaccccgttaaccgtaggtaccgggttcggggaccgggttcccgtacccggtaccccgggtagggggtacccgtaaggggtaccttaccgggttcggttacccgtaccggttccttacccggtccgaccccgttaccgaaccggtaccgggtcccctacgggttccccggttaccccttcccgtacggtacccccttacccgttacccaaacccggtcgtaccgttaccccgg

SEQ ID NO: 139505 - DNA, 680 bp, Homo sapiens
  misc_feature: GYAE6OF01DG6DV.46.67.G01.1.454.CMB.1.raw
  modified_base (191)..(191): a, c, t, g, unknown or other
  misc_feature (191)..(191): n is a, c, g, or t
  modified_base (216)..(216): a, c, t, g, unknown or other
  misc_feature (216)..(216): n is a, c, g, or t
  modified_base (226)..(226): a, c, t, g, unknown or other
  misc_feature (226)..(226): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgganacagtgtcaccatcacttgccgggnaagtcgaacnttgacactatttaatgtatcaacatagaccgaggaccgccctaagcctactaatctatgctgcatcctagtttgactaaggtcgggtcccagtcgagttcagtggctagtggatcgtagggacagtatttcacttctacgaccatactaagttaactctagaacctaacggtagtaaacgttattttacgaacctttaaactttatttaaccttacggttaaccaaacgtaagtaaacttttaacgtaaacgttttcgggttttaaccggaaccggtaaaacgggtaaccctaaccggttaaaccttaaacttaaaacgtttaaaccgtaaggttaccggttaggacccttacgtaaccggaacccttaagtttcccgtttacggttacccttttacgaacccgttttaccccgtttacccccgaacctttacgtttccgttaagttaaacccg

SEQ ID NO: 139506 - DNA, 757 bp, Homo sapiens
  misc_feature: GYAE6OF01CLMI5.46.67.G01.1.454.CMB.1.raw
  modified_base (198)..(198): a, c, t, g, unknown or other
  misc_feature (198)..(198): n is a, c, g, or t
tcagactagcagtacacgaccggtgctcgatttagagtatacatattgggtttgggggagtctcggtcaggacacagcatggacatggagggtccccgctcagctcctggggctcctgctactctggctccgaggtgccagatgtgacatcgagctgacccagtctccatcctccctgtctcgacaaccggtgggaanacagtcgcacatcacgttggccgggacaagtcggaactattacgaactaaccttaatttaaagtggtaatacaaacatacgaccgagggaccgacctaagctactatctatgactgcatcacgttgactaaaggtcgggtaccagtcggtaagttcgaggtcggactaggtacggtactacgtagggaactaggtaactttacacttactacacctaatacgtaagtaatacgtacgaacgtaacggttagaaacgttactttaacgaacttaaacttttaattaacccggttattaaacccgtaaaccgtaagttaaaactttaaacggttaaagttttccgggtttttaaccgggaacccggttaaaaagggaaccccgtaaacggttaaaaccctaaaaccggttaaaaacgtttaaaacggtaaccggttaaggttaccgggtaaccgtacgtaaacccgtaaccgtaacttccggtttaaccttaaccgtttacttaaaacccgtttccccgttaaaccccgacccgtttattaacccgttaaggttaaacccg

SEQ ID NO: 139507 - DNA, 803 bp, Homo sapiens
  misc_feature: GYAE6OF01C1KIY.46.67.G01.1.454.CMB.1.raw
  modified_base (94)..(94): a, c, t, g, unknown or other
  misc_feature (94)..(94): n is a, c, g, or t
  modified_base (262)..(262): a, c, t, g, unknown or other
  misc_feature (262)..(262): n is a, c, g, or t
tcagactagcagtacacgaccggtgctcgatttagagtatacatattgggtttgggggacctcctgtgcaagaacatgaagcacctgtggtttntcctcctgctggtggcagcctcccagtagtcgggtcctgtccctggtgcaactgcgaggagtccgggacccagacgtgggtcgacgggtcccttcgggacgtacccgtgtcccctcaccgtgccgtctgtctcgtggtctcctcgatctagtcgttggtttcttcggngggtcgtcgggtcgactcgccgtaccggaaggggacgggtctaggtaactacgtaggttacggtagttcgtctcttacgaagttaggtacgggtacgtttaccttaactaaccgtcggtcccgttacgtcgtaacgtaacggtacgtacggtacctacctaaccgtacgttactcttaccggtacggtaacctaccggtaccgtaacgacgtaaacttcgttaccgttttaccgaggtaaacgttagtacgttcgtttaccgtcgtaccgtacccggtctcgttaacggtacggttacgggttacttttacgtactcggtaggacgtacggtaacggtctactttacgttagttagtttacggtttaggtaacggttttcgttaacctttccgaaaccgttcggtaacggttaccggtccgggggtaaccggggtacctccccggggtacgggtaccggggtaacggtaacggttaccttccgggtaaccggtttccctaaccccggttccgtttaaccctcccggttaccctaacccggg

SEQ ID NO: 139508 - DNA, 721 bp, Homo sapiens
  misc_feature: GYAE6OF01C6328.46.67.G01.1.454.CMB.1.raw
  modified_base (504)..(504): a, c, t, g, unknown or other
  misc_feature (504)..(504): n is a, c, g, or t
  modified_base (714)..(714): a, c, t, g, unknown or other
  misc_feature (714)..(714): n is a, c, g, or t
tcagactagcagtacacgaccggtgctcgatttagagtatacatattgggtttggggagtctcggtcaggacacagcatggacatgacgggtccccgctcagctccgtggggctcctgctactctggctccggaggtgccagatgtgacagtcgagctcgacccagtcctccactccctccctgtctcgaccgtaaccggtgggacacgtagtcgtccaccatcctacgttcggccggactaacggtacggaactatacgaacttaacttaatttaagtgtactaacaactagtaaccgaaaccggacggggacccgtacccgtaacgtacctacctaaactcgtagtcgtctcgactacgttacgttaggttagaaccggtaacgggttccggacccgtagtacggtacggtcgaagggtcggtaggtaggtcgtacgtcgggtacggtaacgtagttacttactaccgtcctaaccacgttaactcgtaagttactcgtaanaccggtaaagtggttaaatttacgtactaaccttaatttacggactaacgtaacaaacttaacgttaattacgttacggtttacccgggtaacgaaaccgggacggtaacctaacgtaaaaccttaaagtaaacctaacgtcgtggccgaccttgaaccctagtacttccgttcttacctacctcctttacccccgataccttggtaccnggttaac

SEQ ID NO: 139509 - DNA, 782 bp, Homo sapiens
  misc_feature: GYAE6OF01CV043.46.67.G01.1.454.CMB.1.raw
tcagactagcagtacacgaccggtgctcgatttagagtatacatattgggtttgggggagtctcggtcaggacacagcatggacatgagggtccccgctcagctcctgggggctcctgctactctggctccgaggtgccagatgtgacatcgagctagacccagtctccactccctccctgtctcgacgaaccggtgggacgacagtcgtcctaaccatccgtaccgttcgggacccggggtacgaaacggtaccggaaacctagtttacggaacctaacctttaagttttaaaagttaggtaactacgaaactataacgaaccgaaggggacccgaccctaagtccttacctaatcgtactgctagacctactacgtacgttggacgtaacgggttcgggtaccctagtacggtacggttacaggttcggacgtaaggtggtacgttcggtagggtaaactacggtacttttaccaccttacgtaccgtaactacgtacgtaacgttaacttaccggtaggtacctaaacggttcggtaaaacgttttacgtttacgaaaccgtttacgttttaacgtaccgttaaactaaaccgaaagttattaaacgttaacgtaacggttttacggggtttaacccgaaggtaaacggtaccctaaaccgtaattaaaaaccgtaaacgttaacggaccttagggtacccgacttacggaccctaaacttcgttacgtcgttacttcccgtaacttccccttaccgaccttaagtcgttaggtaaccc

SEQ ID NO: 139510 - DNA, 694 bp, Homo sapiens
  misc_feature: GYAE6OF01DPQII.46.67.G01.1.454.CMB.1.raw
  modified_base (162)..(162): a, c, t, g, unknown or other
  misc_feature (162)..(162): n is a, c, g, or t
  modified_base (643)..(643): a, c, t, g, unknown or other
  misc_feature (643)..(643): n is a, c, g, or t
tcagactagcagtacacgaccggtgctcgatttagagtatacatattgggtttggggagtctcggtcaggacacagcatggacatgagggtccccgctcagctccgtggggctcctgctactctggctccggaggtgccagatgtgacatcgagctgacccngtctccactccctccctgtctcgacgaaccggtgggagacagtcgtacaacatccacgttcggaccgggactaacggtaccggaactagttacgaacctaacctttaagttttaaaacgttggtaactacgaaacaagtaacgaaccggaacggggaccgtacccgtaagccttaccgtaatctaacgtgactgacctactaccgttaggtttacgaacgtaaacgggtcgggtaccctaggtccggtaggtttacgaggtcggacgtaggtacggtagtccggtaaggacgtaagttaccgtttacgacctacgtacctaacctagtacccgttaagtaactcaaggtaaccaagggttataagttactttagaacctttaattactttaagcgttaaacaagttaactaactttagtaacgtttcggtacgaacgacggactaacgtaactaaagttaaactacgattcggactactanacctgaattcggttcttactacgtacctcccttaccgatcttcgacttacg

SEQ ID NO: 139511 - DNA, 635 bp, Homo sapiens
  misc_feature: GYAE6OF01AYQYL.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaattggtatcaacatagaccaggacgccctaagctcctaatctatgctgcatccagtttgcaaagtggggtcccatcgaggttcagtggcagtggatcgtgggacagatttcgactctacaccatccagtaatctagacaacgtgaatagttttgactaacttattactagtacaaactagtaaacttactaatttcggttttaccggacccgtaaaggggtacctaaaccggtaaccttaaacgtaaaactttaaacccggtaaacgttaggttacgggtaccgttaagtacccgtaaaccctaagttacccgtttacggttaccctttacgtaaccgtttaccccgtttaccccccggtacccttaaacgtttacccgttcggttaaacccg

SEQ ID NO: 139512 - DNA, 728 bp, Homo sapiens
  misc_feature: GYAE6OF01AW2AZ.46.67.G01.1.454.CMB.1.raw
  modified_base (205)..(205): a, c, t, g, unknown or other
  misc_feature (205)..(205): n is a, c, g, or t
tcagactagcagtacacgaccggtgctcgatttagagtatacatattgggtttggggagtctcggtcaggacacagcatggacatggagggtccccgctcagctccgtgggggctcctgctactctggctccgaggtgccagatgtgacatcgagctcgacccacgtctccactccctccctgtctgccgaaccggtgggagacnggtacgtccaccactctacgttcggaccgggacgaacggtacggaactacgtagtaacctaaccgttaatttaagttaggtactacaacgtaatacggaaccggaacggggaccggtaccctaacgccttacctaacgtactactgtctcgacctacttaccgtacgttacgaacgtaacgggtccgggtacctagtacggtaggtgaacgggtcgtacgacggttaggtacgtcggtacggtacgtaagttacttccgactccgtaccacgtataacgtaattactcgtagtaacgtaacggttagtaacttacgtttacgaactttaacgtttacttagttacgtaacctaagtaacgttaactttaacgttacgtttaccgggtttaacgaaccggtaaacggtaacctaaccgtaattaaaaccgttaaacttaaaccggtagtacggtactaccgtctaacctaccttatcggtaaccttcgtacctaccgttacccgtacccctatctcgtcgtaac

SEQ ID NO: 139513 - DNA, 611 bp, Homo sapiens
  misc_feature: GYAE6OF01DOZ9X.46.67.G01.1.454.CMB.1.raw
tcagactagcagtacacgaccggtgctcgatttagagtatacatattgggtttggtcctcctgctggtggccagctcccagatgggtcctgtccctggtgcaactgcaggagtccgggcccacgactggtgaggccttcggagaccctgtccctcacctgcgctgtctctggtgcctccatcagtagttggtttctcgtggggctgggtccggcagcctccgaggggagggctaggaatacagttggaagtgtctctcataggtggtacggttcctattacagttccgtctctcaagagtcgagtcaccatactctcgtggaccacgtcagactaatctactttcccagaagatgtagttctgtcgaccgcgctagacgcgggtacgtttatacgtgtgacgagtacgacggtacttagttagtgttagttttggtaggtttggtttacttcgtaacctacccgtagtacggtccgggacgggtcccttccggacccgtggggaccgtaagggtaactacgtcggtcccgtacgttccttacctacgccctacgaacccgacggccctagtcccgtcccttccccgcgtcccaccctcaccagcgtacccg

SEQ ID NO: 139514 - DNA, 634 bp, Homo sapiens
  misc_feature: GYAE6OF01CUF4W.46.67.G01.1.454.CMB.1.raw
  modified_base (300)..(300): a, c, t, g, unknown or other
  misc_feature (300)..(300): n is a, c, g, or t
  modified_base (329)..(329): a, c, t, g, unknown or other
  misc_feature (329)..(329): n is a, c, g, or t
  modified_base (338)..(338): a, c, t, g, unknown or other
  misc_feature (338)..(338): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggcctttcggagacccttgtcccctcacctgcgctgtctctggtcgcctccatcagttagttggtttctcgtggggctggggtccgcagcctccgagggaagggctaggaatacagttggaagtgtctctnagtagtggtagttcctattacagtccgtntctacaagngtcgagtcaccatctctcgtcggacaccgtccagctaactctacgtttttcccagaagtagtgtacgtttcgtagttcgaccggtccgacgtcgaacgtacgggtactttattacgtgtcgacgacggtacgtacggacttagtttacgttgttagtttttcggagtttaggtttactttaccgactacccgttagtacgtcgggaccggggttcgtccggtaccccgtggggtaccgaacgggtacgttacgtcggtaccgttacccgttccttaccgtaccgtcccgtaacccg

SEQ ID NO: 139515 - DNA, 756 bp, Homo sapiens
  misc_feature: GYAE6OF01AJLW4.46.67.G01.1.454.CMB.1.raw
  modified_base (198)..(198): a, c, t, g, unknown or other
  misc_feature (198)..(198): n is a, c, g, or t
  modified_base (254)..(254): a, c, t, g, unknown or other
  misc_feature (254)..(254): n is a, c, g, or t
  modified_base (742)..(742): a, c, t, g, unknown or other
  misc_feature (742)..(742): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctcgacccagtcctccacttcctccctgtctcgacaccgtgggacnctagtcgtaccacctatcgtacgttcggacccgggtacaaacggtccgggaaactnttacggaccctaccttttaaagttttaaacttggtacttaccaaacgtacttagaccgaacgggacccggtaccccgtaaagtcctacccttaaagtcctaacgtcgactacgctaaccgtcctaggtttacaacgtaaacgggtcgggtaccctagttaccggtacggttaccgtaggttacggtactaggttacgggacttacggttacgggacgtaacggttactttacctaaccgttcgtaccctaacctacttacggtacttaacgttcgttacgaccgttaaaggtcgtaaagtttcgtttacgaacgtttaaacttcgttaacttcgttaaactacgtaagtaacttacgttaacgtttacgttaacccgtacgggaaaccgttacggaacctaacctaagtaaacgttaaccgtggtttacgaggtccctagtaaccctacaccgtttgtacctcttaaaccgctttcccgtccaccgtnttaagtcttaaccg

SEQ ID NO: 139516 - DNA, 731 bp, Homo sapiens
  misc_feature: GYAE6OF01BC6X6.46.67.G01.1.454.CMB.1.raw
  modified_base (386)..(386): a, c, t, g, unknown or other
  misc_feature (386)..(386): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtcctccatccctccctgtctgaccaacggtggacactagtcgtaccaccatccgacttcggaccggaactaacgtccggaaactagttcgaacctacctttaaattttaaagttcggtatacaaactagtacgaccgacgggaccggaccctaagcctacctatcctatcgctgctactccgtagtttgacgtaacggtcgggtacctagtcggtacggtttanaggtcggtacgtaggtacggtacgttacggtagggtaactaagtactttacctactcctactaacctagttactaagttaatccgtacgtaacgttaacgtagtaaacgtttgtttaacgaacttaactttacgtttacgacggtttaacaaagttaacgttaaacttaacgttacgtttacgggttaacccggaaccgttaacgggaactaaccgtaaacttaaactaaaacttaccggtaacgttaggtacctccggttaaccaacccttaacgtatttccggttacgttacctttaccctacgtttccccgtacccttaccctgtacccgttaacgttaccg

SEQ ID NO: 139517 - DNA, 721 bp, Homo sapiens
  misc_feature: GYAE6OF01DMUTP.46.67.G01.1.454.CMB.1.raw
  modified_base (264)..(264): a, c, t, g, unknown or other
  misc_feature (264)..(264): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgacggccttcggacgaccctgtccctcacctgcgctgtctcgtggtcgcctcatcagttagttcggtttctcgtggggctgggtccgcagcctaccggaggggagggctaggaatactagttaggacgtgtctctnagtaggtggtaacgtttcctagttactcgtccgttctctacgaagtgtcgagtcctaacatctcgtcgtcgaacaccgtcaacgtctaaagttcttacgtttccgagaagtcgttaggttacgttccgttacggtaccgacccggtcgtcgtacggaaccggtcgggttacttttacgtacgtgggtacggacggaagtacggtacgttacttaagtttagtagttttaggtttaggtaggtttacggtttactaccgaaccttaccgtagaccggttcggggaacgggcccttccggacccggtgggaaccgtagggtactaccggttcgtacctaccggttcccttaacgtccacccgtaaccgtaaacccggccgggtaccttaccggttccccgtttaccccgtcccccgtacggacccctaccccgttaccctaacggaacgtcccgtcccg

SEQ ID NO: 139518 - DNA, 796 bp, Homo sapiens
  misc_feature: GYAE6OF01DJMPB.46.67.G01.1.454.CMB.1.raw
  modified_base (224)..(224): a, c, t, g, unknown or other
  misc_feature (224)..(224): n is a, c, g, or t
  modified_base (248)..(248): a, c, t, g, unknown or other
  misc_feature (248)..(248): n is a, c, g, or t
  modified_base (392)..(392): a, c, t, g, unknown or other
  misc_feature (392)..(392): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgcaccatcacttgccggcagtcgaacntgacacctatttaatgtatcaacntagaccgaggaccgaccctaagctacctaatctatgctgctactcctaggtttcgacgtaacggtcggggtacccaagtcggtaggttacaggttggcgtaggtgggtatccggtagggactaagtacgtttaccacgttaccnctaacctataccgtaagttaacttccgtacggtaaccgtaacggttacggtaaacgtttattttaacggtaacctttaaaccgttttaatttaccgttaacgttaacccgtaaacgttaaacgttaaaacttttaacgttaaacgttttacgggtttttaacccgggaccggttaaaaccggggtaacctaacccgggttaaaacttaaacccgttaaaaaaccgttttaaaacccgggttaaacggttaacccgggtttaggtaacccgtttacggtacccctaaacccgtttaaagttttacccggtttccggttttaacccctttccctttaaacccggtttaccccccgtttaacccccgtttaccccggttaacctttccgtttaacggttaaaccccg

SEQ ID NO: 139519 - DNA, 844 bp, Homo sapiens
  misc_feature: GYAE6OF01BX6BS.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctcgacccagtcctccacttcctccctggtctcgaccaacggtgggacacgagttcgaccaccgatcacgttcggccgggactaacggtacggaactagttacgacctaacttaagtttaagttcggtaattactaaacgacgtaacggaaccgaacgggggaacccgtaacccgtaacgtaccttacctaaacttcgtacgtacgtccgttacgacctacgttacccgttaggtttaccgaacggttaaacgggttcccgggtaacccgaacggtttaccggtaacgggttttaccgacgggttaaggtaccgttaagggtacgggtaacgtttccgggtaacgggttaaaccgtacgggtttaactttacgtacccgtactacctaaccgtactacggttaattaacgtcgtacgaacgttaacggtagtaaacgttaacgttttgtaaacctttaagttaacttacgttacggtaacctaaaaggtaccttaaaacgttacgttaaacgtttccgggtttaacccggaaacgtaacgggtaacctaaacgtaaacgttaaacgtaaacccgttaacggtaaactggttaaccgttacggaccttaaaccgccctttaaagtccggtttaccttaaagttccccgtaccgttaccccgtacccggtatttacccttggttattaaccgg

SEQ ID NO: 139520 - DNA, 765 bp, Homo sapiens
  misc_feature: GYAE6OF01AB86F.46.67.G01.1.454.CMB.1.raw
  modified_base (180)..(180): a, c, t, g, unknown or other
  misc_feature (180)..(180): n is a, c, g, or t
  modified_base (201)..(201): a, c, t, g, unknown or other
  misc_feature (201)..(201): n is a, c, g, or t
  modified_base (215)..(215): a, c, t, g, unknown or other
  misc_feature (215)..(215): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactgggtgaggtccttcgggacgacccctgtcccctcacctgccgctgtctctggtcncctcatcagttgtgttctcgngggctcgggtccgncgcctccggaggggacgggtctaggtaatacgtaggttggaacgttcgtctacctagtagttaggtggttaccggttccttaagttaccgtacgttcccgtctactacgaagtcgtcgtacgtaccacctattactccgttacgtacggaacctaccgtccaagactaactcctttaccgtttccgagtaacgtcgttggtacgttcgtagtcccggaccgtccgtacgtacggtaacccggtacggtttactttaacgtcggtgtacggacggaaggtcggtacgttacttagttacgttaggttttaggttttgggtacgtttagggttaccttaccgaacctacccggttaggccggttaaccgggtcgggtcccttaccggggacccggtcgggacgtacggttaaccgttacggttccgtacccgtaccgtacccgttccgacccgtaccccaacggtacccgggccgttaccctaccgggtccccgttacccccgttccggaccctaacccccgtccccgactaacccggagtcccgtacccgg

SEQ ID NO: 139521 - DNA, 791 bp, Homo sapiens
  misc_feature: GYAE6OF01B2TUE.46.67.G01.1.454.CMB.1.raw
  modified_base (149)..(149): a, c, t, g, unknown or other
  misc_feature (149)..(149): n is a, c, g, or t
  modified_base (185)..(185): a, c, t, g, unknown or other
  misc_feature (185)..(185): n is a, c, g, or t
  modified_base (570)..(570): a, c, t, g, unknown or other
  misc_feature (570)..(570): n is a, c, g, or t
  modified_base (741)..(741): a, c, t, g, unknown or other
  misc_feature (741)..(741): n is a, c, g, or t
tcagactagcagtacacgaccggtgctcgatttagagtatacatattgggtttgtcctcctgctggtggcagctcccagatgggtcctgtccctggtgcaactgcagggacgtccgggacccacgactgggtgacgggtccttcggganacccctgtcccctcacctgcgtctgtctcgtggtcnccctacatcgagttaggttcggttttctcgggtgggggtcgttcgggggtacccggcacggtcccgtacccgggaaggggggtaaggggtctaagggtaaactaacgtaaggttaggggagtttcgttccgtacctagtacggttaagggttgggttaacgtttccttaagttaaccgtacggttcccgttaccttacgtaacgtaaaggtcgtacggtatacccaactataccttcgtacgtacggacctaccgtcaagactaactcgttaccgtttacgagtaacgtgttacgtacgttcgtacggtaccgacccggtcctacggtacgtaccgggtttacgggttacttttaatcggtgacggacggacggtagtacggttnttaagttagttaggtttacggttttgggtacgtttacggtttacttacccgacttaccggtagtaccgggtaccggggacgggtaccctacccggggcggtaccggggtaacgagggtactccggtacgtccctaccgtcttaccgtccaccgtacccgacgaccggtacnccgttccggtcccctcccggacaccccttcccaactaccgagccgtaccc

SEQ ID NO: 139522 - DNA, 725 bp, Homo sapiens
  misc_feature: GYAE6OF01DBHOQ.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtggagacagtcgtcacatcacttggccggganaacgtcggaactagttcgaacctaacctttaatttaaacgttggttactacaaacgtagtaacggaaccgtaacggggacccgacccttaaagccctaaccttaaatccttaaggtcgtacctcggactacttacctaggtttacgacgtaaacggtcgggttacccagtacggtaacgtttcgagggttcgacgtacggttagggattccggtaggggaactacggtaactttcgacctctacgacctagtacgtaagtaatcccgtagacgtaacgtgtaagttactttgaaccttaactttagttactacgtaactaaacgagttaaacttacgtaagtttcggtttaaccggaccggtaaacggacctaaccggtaacttaaaacgaaaacgtttaaccgaacgttcggtacggccttacggaacctaccctagtttccgttaaaccgttccttaccctacgtttaccccgttaccccacgttaccttacgtacggttaaaccg

SEQ ID NO: 139523 - DNA, 784 bp, Homo sapiens
  misc_feature: GYAE6OF01DJZOL.46.67.G01.1.454.CMB.1.raw
  modified_base (308)..(308): a, c, t, g, unknown or other
  misc_feature (308)..(308): n is a, c, g, or t
tcagactagcagtacacgaccggtgctcgatttagagtatacatattgggtttgtcctcctgctggtggcagctcccagatgggtcctgtccctggtgcaactgcaggagtccgggccccagactggtgaggccttcgggagaccctgtcccctcacctgcgctgtctctggtgcctccatcagttagttggttttcttcgtggggcgtgggtcccggcagcctcccgagggggaaggggcttaggaatacagttggaagtgtctctcagtaggtggtaggttcctagttacacgttccgttctcctnaagagtcgagtcaccatatctctggacacgtcagctaatctacgttttacccgagtaagactagtacgtttcgtgttcgacccggtccgctcggaaccgtacggggttacgttttaacttacgttggtggtacggaacggaggtaaccggttacttaacgtttaagttcgtttttaggtttttagggtaaggttttaggttttaacgtttaccgtaacccgttacccgtaacggtacgttacccggggtacgggggtcccgttaccgggtacccccggtacgggggtacccggtaacgggtaacgtaccggttacgggtacccgtacccggttcccgttacccgttacgtaccccttaccccgaacccgggtaaaccgggccccttaaccggtttccccgggttccccctttccccccgggtaccggtacccctaccccccttaccccgttacccccaaagggaccgttaccccgg

SEQ ID NO: 139524 - DNA, 608 bp, Homo sapiens
  misc_feature: GYAE6OF01CE9VZ.46.67.G01.1.454.CMB.1.raw
  modified_base (193)..(193): a, c, t, g, unknown or other
  misc_feature (193)..(193): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtcccctnacctgccgctgtctctggtcgcctccatcagtagtggtttctcgtggggctgggtccgcagcctccgagggaagggctggaatacattggaagtgtctctcatagtggaggttcctattacagtccgtctctcaagacgtcgagtcaccatatctctgacacgtcagcaatctacgttttcccagaacgtatcgagttctgtcgaccgccgctgacgtacggtctttattactgtgcgagacgtacgcttattagtgttagtttttggaggtttggtttactttacgtacctacccgtaagtacgtaccggacggggtaccgtccggtacccccggtggggacccggtaggggtaaccttccggtacggttcccgtacccgttccttacccgttccggtccccgttaacccccgg

SEQ ID NO: 139525 - DNA, 726 bp, Homo sapiens
  misc_feature: GYAE6OF01BRW9H.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtcccctaacctgcgctgtctctggtcgcctccatcagtagtggtttcttcgtgggctgggtccggcagcctcccgaggggaaggggctgggaatacgattggaatgtctcctcataggtggaggttcctattacagtccgtactctacaagtagtcgagtccacctatactctctggaccacgtcagctaatcgtacgtttttccccagtaacgtattaggtaactttcgtacggttacggacccggtccctcgtcggaccgacggggttcgttttaactttaccgtggtacgtacggacggaacggtaccggtacgtttaattacgtttaggttaagtttttacggggtagttttagggtttactttacccggtacctaacccgttagtacggtcgggaaccgggggtcctcccgggtacccggccgggaccgtaacgggtaacgtaccgtgtacccgtaccgtcccgttccgttacgccccttaccgaacccggtacccggccctaccgttacccggttcccgttcccccgcccgtccctaccccgtacccaccggaaccgtcgacccgtaccccggg

SEQ ID NO: 139526 - DNA, 715 bp, Homo sapiens
  misc_feature: GYAE6OF01CPXVP.46.67.G01.1.454.CMB.1.raw
tcagactagcagtacacgaccggtgctcgatttagagtatacatattgggtttgggggagtctcggtcaggacacagcatggacatgagggtccccgctcagctcctggggctcctgctactctggctccggaggtgccagatgtgacatcgagctcgacccagtctccatcctccctgtctcgaccaaccggtgggacacagtcgtaccacctatcacttggcccggggataacgggtacggaactagttacgacctaaccttaattttaaagtggtatacaaacatagaccgaagggaccgaccctaagcctacctatctatgcctgctatcctagtttagacgtaaggtcgggtacccagtcgaacggttcaggtcggtacgtaaggtcggtaacgtcgtaggggtaactaggtacttttacacctactacctaacatactaagtaacgtctagaaccgtaagtaaggtaacgtttacgtttagtaacctaaacttttagttaaccctaggtaacctaaacgtaacgtaaatttaaccgtaagtttcggtttaaccggaaccgtaaagggtaacccaacggttaaacttaaacgtaaaacgtttaaacgaacttcggggtacgtaccgttacgacccgtaaacctaccgtttacgttccgtttaactactaccgttacccgtttaaccccgcttaactccgttaggtaaacc

SEQ ID NO: 139527 - DNA, 896 bp, Homo sapiens
  misc_feature: GYAE6OF01B0XH7.46.67.G01.1.454.CMB.1.raw
  modified_base (255)..(255): a, c, t, g, unknown or other
  misc_feature (255)..(255): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctcgtccctggtgccaacgtggcgagggtacgtccggggacccacggacgtgggtaggacggtcccgttcgggaacgtacccccgttcgtccccctccacccgtgccgtcttcggtccttcgtgggtcnccctccattacgaggttagtttcggtttctcggtgggggtcgttcggggtcccggacgtacgcccgtaccgggaagggggaacggggtctaagggtaacttactaggtttacgggtaacgttcgtaccttactacgtaggttacggtagggtttaccggtttacccttaagttaccgtaccggttcccgttactaccgtagaagtacggtacgacgtaccaactattacgtccgtacgtacggacctacgacctagtactaacttcttaccggtttaccgtaaggtaacgttagtcggttacgtttaccgtcgggtaccgtaccccggtccgtacgttaccgggtaaccggttaccggggttttacttttaacgttcggttacggtacggtacggaacgggtaccggtacggtttacgtttaagttttaagtttgggtttttaacggttttagggtaacgggtttttagttaccgtttaacccgaaccgttaaccggtaggttaccggggtacccggggtaccgggttacccgtaccccgggtaccggggtacggggaccggtaaacggggttacctcccgggttacggttaccccgttaccggtttacccttaccccgttccggtaccctaacccccggg

SEQ ID NO: 139528 - DNA, 937 bp, Homo sapiens
  misc_feature: GYAE6OF01DYLNB.46.67.G01.1.454.CMB.1.raw
  modified_base (478)..(478): a, c, t, g, unknown or other
  misc_feature (478)..(478): n is a, c, g, or t
tcagactagcagtacacgaccggtgctcgatttagagtatacatattgggtttggggacctcctgtgcaagaacatgaagcaccgtgttggtttgtcctcctgctggtggcagcctccagtagtcgggtcctcgtcccgtggtcgacaacgtgcgaagggcggtccggaccctacgacgtgggtcggacgggtcccgttacgggacctcccttccgtcccctcgtacccgtggccgtctcggttcctcggttcggtacctccctacgacgttcgtaagggtttggttttcggtttcgttcgggcggggttaccggtccggggtaccggacgtacggtccccggtaccggggaagggggtaccggcgttaacgggtaacgttacgttagggttacggtaacggttcttaccttacgtacgtaaggttcgggttaacggttcgttttacctaaacggttcgaccggtttccctacggtanaacggtaggtctaccggtactaccacgtagttacctcgtaccggtacgaacccgtacgtctagtaccctaagttcccgtttaccgttaccgtaaaggtattacggttagggttacccgttacggtaacccggtccgggtaaccccgtcgtaaccggttaccgaccggggtttaacggtttactttacggtacgttacgggccgtaaggtacgggaacgttcggttaattttagtacggtttagggttttacggtttacggtaacggttttacggttaacccgttacggtaacccgtttacgggtaaccggtccgggtacccggggttacccggtaccccggttaccggggtccccggggtttaagacccggggttaaacggtacccggttaccggtttaacccgggtacccgtttccccgtaaacccgtttcggtacccccgtaacccgggtaacccgg

SEQ ID NO: 139529 - DNA, 625 bp, Homo sapiens
  misc_feature: GYAE6OF01DH2N1.46.67.G01.1.454.CMB.1.raw
  modified_base (229)..(229): a, c, t, g, unknown or other
  misc_feature (229)..(229): n is a, c, g, or t
  modified_base (255)..(255): a, c, t, g, unknown or other
  misc_feature (255)..(255): n is a, c, g, or t
  modified_base (274)..(274): a, c, t, g, unknown or other
  misc_feature (274)..(274): n is a, c, g, or t
  modified_base (619)..(619): a, c, t, g, unknown or other
  misc_feature (619)..(619): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgaccaaccgtgggagacagtgtcaccatcactggccggcaagtcgaacnttgactactattaaatgtatcaacanacgacagggaccgcctaanctacctaatctatgctgcactctagttgacaaggtcgggtcccagtcgagttcagtggcaggtgatcgtaggggactaggtactttacacctttactaccgtactatacgtaactaacgttcgtacgtaacgtaacgtaggtaaacgttattttacgaacttaaacgttttacttacttaggtactaaacgtaagtaaactttaacgtattacggttttaccgaacggtaaacggaactaacgtaaactaaccgtaaaagttaacgtaacgtacgtaggtcctaacgccgtacacgttacttacgttcttaccttaacgttcccttacccgtacctaacttcgtntaaacg

SEQ ID NO: 139530 - DNA, 652 bp, Homo sapiens
  misc_feature: GYAE6OF01EE5XR.46.67.G01.1.454.CMB.1.raw
  modified_base (392)..(392): a, c, t, g, unknown or other
  misc_feature (392)..(392): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtcgcctccatcagtagttggtttcttcgtggggtctggggtccggcacgcctcccgagggaagggctggaatacagttggaagtgtctctcagtgtggaggttcctattacacgtccgtctctcaagtagtcgatacacatatctcgtgacacgtcagcaatctacgttttccctaggaagtntagtagtttctgtaccgaccgccgtactacgaccgtacgggttacttttagttacgtggtacgcggtacggtaggtacggtctttaagttagttagtttaacggtttttagggagtttacggtttatttaccgaaccgtacccgtagtaccggtaccgggaaccggggtcctaccggtaccccggtagggggacccgaaggggtaaacgtccggtaggttacccgtaacccgttccttaccgttaccgcccgtaaccccg

SEQ ID NO: 139531 - DNA, 750 bp, Homo sapiens
  misc_feature: GYAE6OF01AQM8B.46.67.G01.1.454.CMB.1.raw
  modified_base (252)..(252): a, c, t, g, unknown or other
  misc_feature (252)..(252): n is a, c, g, or t
  modified_base (295)..(295): a, c, t, g, unknown or other
  misc_feature (295)..(295): n is a, c, g, or t
  modified_base (355)..(355): a, c, t, g, unknown or other
  misc_feature (355)..(355): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggacgaccctgtccctcacctgcgctgtctcgtggtcgcctcatcagtagttgtttctcgtgggctgggtccgcagcctccgaggggagggctaggaatacagttggatgtctctnagtggtggtacgttcctattacgacgttccgtctctacaaggngtcgagtccacctatactctcgtaggacctacgtcagactatctacgttttccagaagtntagtacgttctggtacgacccgccgtcgtacggaccgtacgggttcttttaagtacgtggtacgacggagacggtacggtacttagtttacgttagtttagttttagggtaggttttacggtttaactttaccggacccttaacccggttaggtaccgggttaccggggtaccggggtcccgttacccgggtaccccgggttcggggaacccggtaagggtaccgttaccggtcggttacccgtacccgttaccgttacccgttaccgccccgttaacccggaaccccggtacccgggtaccccttaccggttccccgggttcccccttaccccccggtacggtaccccccttacccccgttacccgaacccgtaaccggcccgttacccccggg

SEQ ID NO: 139532 - DNA, 808 bp, Homo sapiens
  misc_feature: GYAE6OF01CQ4U8.46.67.G01.1.454.CMB.1.raw
  modified_base (171)..(171): a, c, t, g, unknown or other
  misc_feature (171)..(171): n is a, c, g, or t
  modified_base (412)..(412): a, c, t, g, unknown or other
  misc_feature (412)..(412): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtncctccatcagtagttggtttctcgtggggctgggtccggcagcctcccgaaggggaaggggtctagggaaactacgtagttggggaaagttgtcctctagtaagttaggtaggggtaggttttacccttaagtttaaccaaggttcccgtccttcttacgaaagtacgtcgaagttccaaccctataacttctaccgtggaccacggttccaagacctaaatctacgttttcccagaagtntggagtttctggacgtacccgccgtcgtaggaaccgtacggggtactttttaagttaccgtggttaggaccgaaggtacggaacgggtccttaatttagtaggtttagtttttagggtaaggtttagtttaacgtttccgtaaccgtaacccgtaggtaccgtacgggtaacggggggcccttacccgggtaacccccggttacggggggacccgtaagggggtaaccttaacggttcgggtacccgtacccgggtttaccttcccgttaacggtccccgttacccgaaaccggtaaccccgggggtaccctaaccggttcccgggttacccctttcccccccggtacggcccctaccccgttacccctaacccgaacgggtaccgtaacccccgg

SEQ ID NO: 139533 - DNA, 717 bp, Homo sapiens
  misc_feature: GYAE6OF01CDWFU.46.67.G01.1.454.CMB.1.raw
  modified_base (225)..(225): a, c, t, g, unknown or other
  misc_feature (225)..(225): n is a, c, g, or t
  modified_base (253)..(253): a, c, t, g, unknown or other
  misc_feature (253)..(253): n is a, c, g, or t
tcagactagcagtacacgaccggtgctcgatttagagtatacatattgggtttggggacctcctgtgcaagaacatgaagcacctgtggtttgtcctcctgctggtggcagctcccagatgggtcctgtccctggtgcaactgcaggagtccgggcccagtacgtggtgacggtccttcggagtacccctgtcccctacacctgccgtctcgtctcgtgggtccncctccagtcgtagttgtggtttctcggnggggtcttcgggccgatgccgtaccgagggagggctaggaatacgagttggaagtgtctctctagtagtggtcgttactagttacgacgtcccgtctctacgagtagtcgacgtaccactatactctagtcgactacgtccagctaactcgttaccgtttttaccgagtaaacgtagtcgttagtttcctcggtacgtacccggtccttcgacggtaaccgtacggggttccttttaacgttacgttcggtacggtacggtacgaacggggtacttacgtttaagtttaagttggttttagttttaggtgggtttcgtttaacgtttaccgtaaccgtccctaaggtccggtacgggtaacccggggtcctacccggtccccgggttagggacggtaacgggtaacttcccgggtcggttaacccgtcccgtttaacctcccgttcccggcccgttaaccccgg

SEQ ID NO: 139534 - DNA, 721 bp, Homo sapiens
  misc_feature: GYAE6OF01DZUN8.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctacgacccagtcctcctactccctccctgtctcgcaaccggtgggacacagtcgtccaccatcctacgttcgggccggacgaaggtaccggaaactagttcgaacctaacctttaattttaaagttggtaactacaaactaagtaaccggaaccggaacggggacccgtacccgtaagaccttaccgtaatctatcgctgacctactcgtacgtacgacgaaaggtccgggtacaggtcggtaggttcgaggtggacgtaggtagtacgtcggaggactagttacttcactctacacatactaagtactcgacgacgtaagtagtaagttgttaacgacttaacgttatacgtagtacctaaactagttaacttaacgttacgtttcgggtttaaccggaaccgtaacggtaacctaaccgttaaacgttaaaaccgttaaagtaaaaccgggtacttaacgggtacgttaccgtaaacgtccgttaaaccgtcgttttaacgttccgttttaaccgtacctacgtttccccccgtaaccgttacctaacgtttcgaacgttaaccg

SEQ ID NO: 139535 - DNA, 829 bp, Homo sapiens
  misc_feature: GYAE6OF01EHSM0.46.67.G01.1.454.CMB.1.raw
  modified_base (207)..(207): a, c, t, g, unknown or other
  misc_feature (207)..(207): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtgtttctcgtgggctgggtccgnagcctccgaggggagggctaggaatacgagttaggaagtgtctctcagttaggtggtaggttcctattacacgttccgtctactcaagtagtcgacgttccaccgtatactctcgtaggaccaccgtccacgactaagtcctacgttttcccctaggaaagtacgttaggtacgtttcgtcggtaccggtaccggtcccgtacgtacggaccggtaccggggtttacgtttttaacgttaccgtgggtacggtacggaacggtaacgggtaccgggtactttaagtttagtttaggtttagttttttacgggtaaggtttacggttttagtttacccgtaacccgttaacccgttaaggtaccggttccggggaccgggggtacccgtacccggtacccggggtacggggacccggtaaggggtaaccttaccgggttcgggtacccgtaccccggttacccgttacccgttacccggtaccccgtaccccgtaacccgggtaaacccgggtaccccgttacggttcccccggtttacccccgttcccccccggttacccgggtaccccctaacccccggttacccccttaacccggtaaaccggacccggtaacccccggg

SEQ ID NO: 139536 - DNA, 653 bp, Homo sapiens
  misc_feature: GYAE6OF01D4F0K.46.67.G01.1.454.CMB.1.raw
  modified_base (173)..(173): a, c, t, g, unknown or other
  misc_feature (173)..(173): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactgggtgaggccttcggagaccctgtccctcacctgcgctgtctctggtncctcatcagtagttggtttcttcgggtgggctgggtccggcagctccgaggggagggctggaatacgagttggaagtgtctctcagtaggtggaggttcctattacagtccgtctctcaagagtcgagtcaccatatctctggacacgtccagcaatctacgttttcccagaagatgtagttctgtcgaccgccgctgacgtaccgggtcgttttacttacgtgtcgacggaggaacggtacggtacttaagtttagttaggtttagtttttagggtagtttggtttacgtttcgaacctacccgtagtacgtcgggacgggggcctaccggacccgtcggggtaccgagggtaacttacgttcggtaccgtaccgttcctcccgttacgccctacccgaaccggaccggtccctacggttcccggttccccttcccccgtacggtcccctaccccgtccctcccgtaagccgtaccccg

SEQ ID NO: 139537 - DNA, 601 bp, Homo sapiens
  misc_feature: GYAE6OF01EW48X.46.67.G01.1.454.CMB.1.raw
  modified_base (253)..(253): a, c, t, g, unknown or other
  misc_feature (253)..(253): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaattgtatcaanatagaccagggacgccctaagctcctaatctatgctgcatccagtttgcaaagtgggccatcgagttcagtggcagtggatcgtgggacagtactttcacgtctacaccatcagtaatctgctaacgtgaagtacttttgactaacgttattactcgttacaaactacgtaaatttaactaattcggttttaccggaccgtaaaggggtaacctaacgaaccttaaactaaacgttaaaaccgtaactaggttcggtacgtacggtacctaacccgtaattacccttggttacctttactaacctttcccgttacccccggttaaccctacgtttccgtagttaaccg

SEQ ID NO: 139538 - DNA, 878 bp, Homo sapiens
  misc_feature: GYAE6OF01DC2C1.46.67.G01.1.454.CMB.1.raw
tcagactagcagtacacgaccggtgctcgatttagagtatacatatttgggtttggggagtctcggtcaggacacagcatggacatgagggtccccgctcagctcctggggctcctgctactctggctccgaggtcgccagatgtgacatcgagctgacccagtctccatcctcctgtctgacaacccggtgggaagacgagtcgtaccaccatacctaacgtttcgggacccgggactaaacgggttccggaaacctagtttaccggtaacccgtaaccctttaaagttttttaaaagttacgggttaacttacctaaaaccgaacgttaacggaaaccccggaacgggggtaaccccggtaccccttaaaaggcccttaaccgtaaacttcctttagtacgaccttagaccctacttacccgttaaggtttacggaacgtaaacgggttccggggtaaccctaacgttaccggtaaagggtttaccgaggttacggaccgtaaggtagggtaacgtaccggttaaggggtaacctaaggtaaccttttccacccgtttacaacccgtacctaagtacttaacgttaactaccgtacggtaccgtaacggttaggtaaacgtttactttaaggtacctttaaaccttttaacgttaacgttacgttaaaccgtaaaacgtacgtttaaaacttacgttaaagttttaccgggtttaaccgggaccggttaaaaccggaccttaaaccggtaaccttaaaacggtaaactttaaaccgggaccgttaggtacggacgttacgacccctaacgacgttttacgtcgtttccccttaggacctttccccgttaccctacgtacttccgttaaggtaaccc

SEQ ID NO: 139539 - DNA, 696 bp, Homo sapiens
  misc_feature: GYAE6OF01B0CMH.46.67.G01.1.454.CMB.1.raw
  modified_base (207)..(207): a, c, t, g, unknown or other
  misc_feature (207)..(207): n is a, c, g, or t
  modified_base (244)..(244): a, c, t, g, unknown or other
  misc_feature (244)..(244): n is a, c, g, or t
  modified_base (369)..(369): a, c, t, g, unknown or other
  misc_feature (369)..(369): n is a, c, g, or t
  modified_base (437)..(437): a, c, t, g, unknown or other
  misc_feature (437)..(437): n is a, c, g, or t
  modified_base (656)..(656): a, c, t, g, unknown or other
  misc_feature (656)..(656): n is a, c, g, or t
tcagactagcagtacacgaccggtgctcgatttagagtatacatattggggtttgggggagtctcggtcaggacacagcatggacatgagggtccccgctccagcctccgtgggggcctccgtgctactctggctccgaggtcgccagatcgtgacagtcgacgctcgacccagtcctccatccctcctgtctgccaacggtggaanacgaggtcgtacaccatctacgttcggacccgggtanaacggtccggaaactgttacgaacctaaccgttaattttaaaagttcggtaatacctaaacgtaactacggacccgtaacggggacccggacccctaaaggtcctaccgtaatcctatcgcttanactacttccgtagttgacgtaaacgggtcgggtacccagtcggtagtcgaggaggcaggtgatacggnggtactgtaattcctacgtctaccacctatacgaacttactcgtacgacgtaacgttaggtaaaggtttatttacggaacctttaaacttttacgtaacctttacggtaactaaacgttaattaaactttaaccgttagttttacgttacggaacccgtaagggtacctaacgtaactaaaccgtaaagttaacgacttggacgtcagtacctaacgtntcgtcgttactacaccttctaccccatccttagtcgtaac

SEQ ID NO: 139540 - DNA, 668 bp, Homo sapiens
  misc_feature: GYAE6OF01C6MHE.46.67.G01.1.454.CMB.1.raw
  modified_base (249)..(249): a, c, t, g, unknown or other
  misc_feature (249)..(249): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtcccctcacctgccgctgtctcgtggtcgcctcatcagtgtgtttctcgtgggctgggtccgnagcctccgagggagggctaggaatacagttggaagtgtctctcagttaggtggtacggttctagttacagttccgtctctacgaagtcgtcgacgtaccacctatactctcgtacgggactaccgtaccagactaattcctacgtttttacccaggtaacgtagtacggttaagttcgtacggtaccggtacccggccgtcgtacgtaccggtaccgggttacgttttaacgttcgtcgtcggacggagtacggtacgtacttaagttacgttgtttaagttttcggtagtttgtttacgttacgtaccgtaccgtagtaccgtacgggaccggggtacctcccggtacccgggtggggaaccctaggggtaaccttcggacggtacctacccgttcttacccgtcgtccctaccccgg

SEQ ID NO: 139541 - DNA, 545 bp, Homo sapiens
  misc_feature: GYAE6OF01EESHB.46.67.G01.1.454.CMB.1.raw
  modified_base (221)..(221): a, c, t, g, unknown or other
  misc_feature (221)..(221): n is a, c, g, or t
  modified_base (257)..(257): a, c, t, g, unknown or other
  misc_feature (257)..(257): n is a, c, g, or t
  modified_base (416)..(416): a, c, t, g, unknown or other
  misc_feature (416)..(416): n is a, c, g, or t
  modified_base (439)..(439): a, c, t, g, unknown or other
  misc_feature (439)..(439): n is a, c, g, or t
  modified_base (536)..(536): a, c, t, g, unknown or other
  misc_feature (536)..(536): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccggtgggagacagtgtcaccatcacttcggccgggnaagtcgaactattgactacttattaatggtatcaanatagaccagggaccgccctaagctcctaatctatgctgctatccgtagtttagctaaaggtcgggtacccagtcgtaggttcaggtggacaggtggatcgtaggggactaggtatttccacgtctacacatcaatactctgacgaagtgtaagtatttnaacttaattattacgtgtacaanataattactattagttcgaacgaggacaacgtaactaacaaattaacgataggtgctagcctactatctcttactctaccttccttcccgactactnttcgtaacg

SEQ ID NO: 139542 - DNA, 696 bp, Homo sapiens
  misc_feature: GYAE6OF01B8XDQ.46.67.G01.1.454.CMB.1.raw
  modified_base (142)..(142): a, c, t, g, unknown or other
  misc_feature (142)..(142): n is a, c, g, or t
  modified_base (240)..(240): a, c, t, g, unknown or other
  misc_feature (240)..(240): n is a, c, g, or t
  modified_base (657)..(657): a, c, t, g, unknown or other
  misc_feature (657)..(657): n is a, c, g, or t
tcagactagcagtacacgaccggtgctcgatttagagtatacatattggggtttggggagtctcggtcaggacacagcatggacatgagggtccccgctcagctcctggggctcctgctactctggctccgaggtgccaggntgtgacatcgagctgacccagtcctccatccctcctgtcgtgccaaccggtgggagacagtcgtcacctatcacgttcggccggacaagtcggaactnttagacctaccttatttaaatggtactacaactagtacggaaccgacgggaccgtaccctaaggtcctacctaatctatcgtactgaccacgtccgtagtttacgacgtaaacggtcgggtaccagtcggtacggttcagggtcggtactaggtcggtaactcggtagggacgtacgtacgtttaccaccgttacctaccgtaaccctaagttacgtaacgtaacgttcccgtaacgtaaccggttaaaccgggttaagttaaaacggtttacttttaaccgaacttttaaacgttttaacttaaccggttacgtaaacctaaacgtagttaaactttacgtaatttacggtttaccgacgtaaacgcgtaacctaacgtaactaaagttaccgaagtcgtacgacgtcgacacgtntcgtagttcctacgtactcccttccgatcttcgtgtacc

SEQ ID NO: 139543 - DNA, 797 bp, Homo sapiens
  misc_feature: GYAE6OF01C8L88.46.67.G01.1.454.CMB.1.raw
  modified_base (209)..(209): a, c, t, g, unknown or other
  misc_feature (209)..(209): n is a, c, g, or t
  modified_base (787)..(787): a, c, t, g, unknown or other
  misc_feature (787)..(787): n is a, c, g, or t
tcagactagcagtacacgaccggtgctcgatttagagtatacatattgggtttgggggagtctcggtcaggacacagcatggacatggacgggtccccgctcagctccgtggggctcctgctactctggctcgaggtgccagatgtgacatcgagctcgacccagtcctacctacttccctcctgtctacgaccgtaaccggtgggacncgtagtcgaccacctatcctacggttcggaccgggactagtaccggaatacttcgaacctaaccgtttaattaaagttcggtaactactaaacgtacgtacggaacccggtacgggggacccgtaacccgtaagtccttaccgtaacgttcttaacgtcgtccgtacgacctacgttaccgttaggtttaacggaaaccggtaagggttccggggtaccctaggttaccggtaggtacgagtgggagtagtggtacgtcgtagggacctagtcttaccgactctacacgtctaacgtaacttgtcgagtacgtaactaggtaatttccgtagttaaccttacgtttagtacctacgtaaacgtaacgttaaagttacgttaactaaccgggttttaccggttaacccgggaaacggtaacgggttaaaacccctacggttaaaaccttaaaacccttaaaacggggttccggttaaaacgtttcgggaccggttacccgtaagtacccttcgttaaccgtttcctcgtttaaccgtacctacccgtttacccgacccggttacctttaacttacggtnttaaacccgg

SEQ ID NO: 139544 - DNA, 898 bp, Homo sapiens
  misc_feature: GYAE6OF01CXTKX.46.67.G01.1.454.CMB.1.raw
  modified_base (163)..(163): a, c, t, g, unknown or other
  misc_feature (163)..(163): n is a, c, g, or t
  modified_base (229)..(229): a, c, t, g, unknown or other
  misc_feature (229)..(229): n is a, c, g, or t
tcagactagcagtacacgaccggtgctcgatttagagtatacatattgggtttgtcctcctgctggtggcagctcccagatgggtcctgtccctggtgcaactgcgaggacgtccgggcccacgacgtgggtcgaggccttcgggacgacccttgtcccgtcncctgcgctcgtctcgtggtcgcctcatcagtacgttggtttcttcggtgggtcgttcggggccgcncgtccgtaccgggaagggggtaacgggtcgtaggtaaacgtacgttacggtttagggtaacgttcggttcctaccgtacgtaaggttacgggttagggtttaccggtttaaccgttaacgtttaccgtaacggttccccggttcgtacctaacgtaaacggtaaccggttacgtaaacctacccgtaaaccttaacttaaccgttccgtttaccggtaccggtaacctaacccggttaaccgacggtaaacttaacgttaccggtttaacccgtttttacccggaaagttaaaggtacgtttacggttaacgttccggttaaccgtaccggtaacccggcccgttacgtacggtaacccgggttaacgggttttacgttacgttaacggtcggtacggacgtaacggtacggtaccgggttaacttaaggtttagtttacggttttaaggttttacgggttaggtttacgttacgttaccggtacgtcgtaaacgtccgggtaaccgggcggtaccccgtacggcccggttacgggaacgtacgtaacgtccgtcgttaccgccttaccgtacctccgtacccgttaacccgaccggtaccggtccctaccgtccggttccccgtacccgaccctccctaccgttacccgacgaccgttcgtaccccgg

SEQ ID NO: 139545 - DNA, 831 bp, Homo sapiens
  misc_feature: GYAE6OF01BC259.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgccgaaccggtgggagacagtgtaccaccatccacgttcggacccggggactaaggttaccgggaaactagtttcgaaccctaacctttaaatttttaaaagttttcggtaacttaccaaactaacgttaacggaacccgtaacgggggtaacccggtaccccgttaaaaggtaccttaaccccgttaattaccttaacgttggtacctggcctaacttacccgttaggtttttacggaccgtaaaacgggttccgggggttacccctaaggttaccgggtacgggttttaccgaacgggtttaggggccgttaacgggttggggtaacgtttaccgggtacgggggtaaaccgtaagggttactttttacccgacccgtttaccttacccgtaaccctaacttacgtaaacgtttaactcgtacggtaccgtaacgttacgtaaaggtttacgttttaacgtaactttaacgtttacgttaacgtacgtaactaacgtaagtaacttaacgtaagtttacgggttttacggaaccggtaacgggaacctaacggtaacttaaactaaacgttaaacgtacgtaggtacggtactcgaccgtactacgttcttcgtacgttctacttccctaccctctacttcgtagtacg

SEQ ID NO: 139546 - DNA, 667 bp, Homo sapiens
  misc_feature: GYAE6OF01AR2YE.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtcgcctccatcgagtagtggtttctcgtggggctgggtccgcagcctccgaggggagggctaggaatacgtagttggaacgtgtctctcataggtgggacggttcctattacacggtccgtctctacgaagtcgtacgagtccaccatatctcgtcggacctaccgtccagactaatcctacgtttttcccgagtaagtagtgtacgttcgttgtccggacccgtcgacgtacggtaacggtaccggggttacttttacttacgtcggtacggcggaagtacggacgggtacttagtttacgtaggtttagttttgggtaggtttgtttacttacggaacccttaccgtaggtacgtaccggggcgggtccgttaacccggcccgggtgggaccggtgggtaaccttccgggtcggttacccgtaccgttaccttccgttacccgccgtaacccccgg

SEQ ID NO: 139547 - DNA, 716 bp, Homo sapiens
  misc_feature: GYAE6OF01DL6BO.46.67.G01.1.454.CMB.1.raw
  modified_base (200)..(200): a, c, t, g, unknown or other
  misc_feature (200)..(200): n is a, c, g, or t
  modified_base (247)..(247): a, c, t, g, unknown or other
  misc_feature (247)..(247): n is a, c, g, or t
tcagactagcagtacacgaccggtgctcgatttagagtatacatattgggtttgggggacctcctgtgcaagaacatgaagcaccctgtggtttagtcctcctgctggtggcagctcccagatgggtcctgtccctggtgcaactgcaggagtcgggcccagctggtgaggccttcggagaccctgtccctcacctgccnctgtctctggtcgcctcatcagtagtgtttctgtgggctgggtcgcngcctccgaggagggctggaatacagttaggaagtgtctctctagtaggtggtacggttcctacttacgtagtccgtcgttctacaagtacgtaccgacgttcaaccgtatactcgtcgtggtaaccacgtaccagcctaactccgtacgttttccccgaggtaaacgtagttacggtagttcgttagtccggtacccgtccgtaccgtacggtaccggacgggttaccgtttagttaacgtcggtacgacggtaacggtacgggtccgggtacttaacgttttaacgtaggtttacgtttttacggggtagtttgggtttaacctttcggaccgttaccgtaacgtacggttaccgggacccggggtcccgttacccggtacccggttaggggtacccgtaagggtaaccgttacgttccgggttaaccgtcccggttaccttcccgttaccgtccccgttaaccccgg

SEQ ID NO: 139548 - DNA, 713 bp, Homo sapiens
  misc_feature: GYAE6OF01BURVT.46.67.G01.1.454.CMB.1.raw
  modified_base (98)..(98): a, c, t, g, unknown or other
  misc_feature (98)..(98): n is a, c, g, or t
  modified_base (403)..(403): a, c, t, g, unknown or other
  misc_feature (403)..(403): n is a, c, g, or t
  modified_base (446)..(446): a, c, t, g, unknown or other
  misc_feature (446)..(446): n is a, c, g, or t
  modified_base (697)..(697): a, c, t, g, unknown or other
  misc_feature (697)..(697): n is a, c, g, or t
tcagactagcagtacacgaccggtgctcgatttagagtatacatattgggtttggggagtctcggtcaggacacagcatggacatggagggtccccgntcagctcctggggctcctgctactctggctccgaggtcgccagatgtgacatcgagctcgacccagtcctccactcctccctgtctgccaaccggtgggactacgagttcgaccaccattaccgacgttcgggcccgggactaacggtccggaaactagttacgacctaaccttattttaaagtcggtataccaaactagtaccgaccgacgggaccctaccctaagcctacctaatctagtcgctcgactatccgtagttacgagtaacggtcggtaccagtcgtagtcgtagcggacgtaggngtagtcggtaggactagttcttaccgacgtcctaaccgaaccngttaccaagttacctccgagtaccgtaacggttagtaagtttacgttacgaacctttaaacggtttacttaccgtaacgtaaaccttaagacgttaacgtttaactcggtttacggtaccggaacgtaacggtaccctaaaggtacctttaaacgaaaccgttacgtagttccgggtagaccttaaccacggttaaccttccggttacgttccgttaccgttaacccttacgtaccccgttacccgtaatnttaaccggtacgtacc

SEQ ID NO: 139549 - DNA, 926 bp, Homo sapiens
  misc_feature: GYAE6OF01ENDCU.46.67.G01.1.454.CMB.1.raw
tcagactagcagtacacgaccggtgctcgatttagagtatacatattgggtttgggggagtctcggtcaggacacagcatggacatgagggtcccgctcagctcctggggctcctgctactctggctccgaggtgccagatgtgacatcgagctcgacccagtctccatcctccctgtctgacaaccggtgggacacagtgtaccaccgtatccacgttggccgggtacaaacggtccgggaaactattacggaacctaaccttaattttaaaagttggtaacttacgaaacgtaagttacgaacccgtacgggggtaacccggtacccccttaaaggaccttacccttaaacgttaccttaacgttacggtccgttacgaccttaacttacccgttacggttttaacggaccggtaaaacgggttccggggggttacccctaaggttaccggtacggggtttaccgtacgggttacggggtaccggtaagggttacgggtaacggttaccggttccgggggtaaacctaacgggtttaaccttttaccgtaacccgttacccgttaaccccgtaaccggttaaacttaccggttaaacgtttaacgttaccgtttacggaaccgttaaacggttacggttaaacgtttacgttttacggtaactttaaacctttacgtttaaccgtaacgttaactaaccgtaagtaaaccttttaacgtaagtttcggtttaaccggtaaccgaaacgggttacccgtaaaccgttaccgtaaaaccgttaaacgttaaaacccgtcggtaagttaccggggtaacccttacggtaaccccgtaccttacgttacccggttacgtttaaccccgtttacgttacccttaccccgtttaccccgtaacctacccgtttcgaacgtttaaacccgg

SEQ ID NO: 139550 - DNA, 637 bp, Homo sapiens
  misc_feature: GYAE6OF01E049D.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccactcctccctgtctgcaaccggtgggagacagtcgtcacctatctacgttcggccgggactaaaggtccggaactagttacgaacctaaccgtttaattttaaaagttggtaatacaaacagtaacgaaccgaacggggaccgaccctaagcctacctaatctatcgcgtgactactccgtaggttacgacgtaaacggttcgggtaccctagtcggtaggttcgaggtcggcgtaggtcggtagttcggtaggactagtacttcacctctacactatacgtagtactctagacgtagtagtaagttacttacgacttaacttattactataacaagtaataattactagttcgttacgaacgaacggtactaacgtaactaaactaaataacgtacgtaggtcgtacgtacgtactaacttctacgttcttacctacttaccttcctacccgtatacgttctaacgtacg

SEQ ID NO: 139551 - DNA, 701 bp, Homo sapiens
  misc_feature: GYAE6OF01C1N4T.46.67.G01.1.454.CMB.1.raw
tcagactagcagtacacgaccggtgctcgatttagagtatacatattgggtttggggagtctcggtcaggacacagcatggacatgagggtccccgctcagctccgtggggctcctgctactctggctcgaggtgcagatgtgacatcgagctcgaccagtctccatccctcctgtctgaccgaaccggtgggaagacgagtcgtaccaacctatcgtacgttggaccgggactaacggtacggaactagtttacgaacctaacctttaaagttttaaagttggtaactacaaactagtaacggaaccggaacgggacccgtaccctaagccttacctaagttactaactcggactacgactacttaccgtaggttacgacgtaaacgggtcggtaccagtacggtagttacaggtcggactaggtgactcgaggactagtcttacgactcacactatacgtaagtactcacgtaacgtaacgtaagttaagttactttaacgtaacttaaagtttacgttagtacgtaaacctaagtaacgttaaactttaacgtaacggtttacggtttaacggaaccggaaacggtacctaaacgtaaaccttaaacgtaaaaacgttaaccgaagttcggtaccgtacgtcaaccgtacgtattcgtagttacccttactacgtaccctaccgtatctgtactaacg

SEQ ID NO: 139552 - DNA, 872 bp, Homo sapiens
  misc_feature: GYAE6OF01BSOEN.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtccgggcccacgactggtgaggccttcggagacccctgtcccctcacctgcgctgtctcgtggtcgcctccatcagtagttggtttcttcgtggggctgggtccggcagcctccggaggggaacgggctaggaatactagttggaagtgtctctatagtaggtggtacggttccttaattacgtagttccgttactcctacgaaggtacggtacgacgtaccacctattacttctcgtacggactaccgtccagtacctaacttccgtttacgttttcccgtaagtaacgtagttaggtacgtttcgtaggtacccgtacccggtccgtacgtacggaccggtaaccggggtttacgtttttaacgttaccgttggtacgggtacggtaacggtaacggtacccgttagtttagtttaagtttggttttaaggttttgggttaaggttttacggtttacgttaaccggtaccctaccggttacgggtaaccggtaccggggttacccggggtccgttacccccgggacccgggtaaccgggggtaccggtaacggggttaacccgttacgggttaccggttaaccccggttacccgtttacccgtttacccggtaaccccgttccccgtaaacccccgggaaacccggtaaccccgggttaccccgttaaccccggttcccgggtttaccccccgttcccccgtccccggttacccctacccccctttaccccggaccgtaaacccggtacgtaacccccgg

SEQ ID NO: 139553 - DNA, 876 bp, Homo sapiens
  misc_feature: GYAE6OF01CMQ0Q.46.67.G01.1.454.CMB.1.raw
  modified_base (185)..(185): a, c, t, g, unknown or other
  misc_feature (185)..(185): n is a, c, g, or t
  modified_base (832)..(832): a, c, t, g, unknown or other
  misc_feature (832)..(832): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactgggtgaggtccttcgggacgacccctcgtcccctacaccgtgccgtctgtctcgtgggtcncctccatcgtaagttagttcggttttcttcggtcggggcgttcggggccgacgtacggccctccgggagggggaacgggtctagggtaaactacgtaggttaggaacggttcgtcctactacgtaaggttacggttaggttacggttaccttagttaccgtacgttccgtctactacgaaggtcgttaccggactaccgaacctacgttacttcgtacgtacgaaccgtaccggttacccaagtacttaacccggtactttaccccgtttttacgaaacggtaagttacgttacggttacgtttacggtccgggtaccggtaccccggttaccggtacccggttaacggtaacgggttaccgggtttaacgtttttaaacgttcgtacggtacggaacggaacgggtaacggtacccgtagtttttaagaagtttggttttaaacggtttgggtaaaggttttcgttaacgttacccgtaacccgttaccggtaaagtccggggttccgggaagggggtccccctaccggtaccccgggtaagggtccggtaaacgtacgttcccggttacggtacccgtcccgtaccgttacctaccccgtccggacctaaacccgggccgtacccctaggttcccgttacccccncgggttacctccccggacccttaaccgacgagtcccggtacccg

SEQ ID NO: 139554 - DNA, 861 bp, Homo sapiens
  misc_feature: GYAE6OF01EM0AD.46.67.G01.1.454.CMB.1.raw
  modified_base (215)..(215): a, c, t, g, unknown or other
  misc_feature (215)..(215): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcgaggagtcgggcccacgactggtgaggtccttcggagaccctgtccctcactgcgtctgtctcgtggtcncctcatcagtagttgtttcttcgtggggctgggtccggcacggcctcccggaggggaacgggtctaggaatacgagttagggaacgttgtacctcgtcgtaacgttaggtgggtacggttttcctaagtttaccgacggttccgtaccttacgtacgtaaggtacgtaccggtaacgttccaaaccctagttacttccttaccggtaggaaccctacccggttacccaaggtaacctaaactcccgtttaaacccggtttttcccgtaggtaaaaacggttacgtttagggttaaccggtttccgttacgggttcccggaaccccggtccggtaaccgttacgggtaaacccggttaaccggggttacgtttttaacgtttaccggttaggttaccgggtaccggtaaacgggtaaccggtaaccgggtactttaacgtttaagtttacggttttaagtttttagggttacggttttacgggttttaacgtttaccgggtaacccttaccgtacggtaacgttccggggtaaaccggggtcccgtacccgggtacccccgggttaggggacccgtaaacgggtacgttaccggttacggtacccgtacccggttacctttcccgttacggtccccttaaccccggg

SEQ ID NO: 139555 - DNA, 908 bp, Homo sapiens
  misc_feature: GYAE6OF01BKNO7.46.67.G01.1.454.CMB.1.raw
  modified_base (175)..(175): a, c, t, g, unknown or other
  misc_feature (175)..(175): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggccttcggacgaccctcgtccctcacctgcgctgtctctggtcncctccatcagtagtggtttctcgtgggctgggtccgcacgctcccgaggggaagggtctaggaactacgagttggaagttgtccttctacgtagttacggtgggtaacggttaccctttaagttaccgacggttccgttacctacgtaccgtaaaggtacggttcgtaacgtaccaacctagttactcgtccgtacggaacctaccgtccaaggacctaaacttccgttaacggttttcccgaagaaacgtcgtagttaacgttcgtcggtaccggacccgccgtcgtaaccgacggttaccgggttacttttaacgttacgtcgggttagacggtaacggtacgggtaaacccgttagtttaagtttagttaacggttttaacgtttttagggggtaaagtttttccgggtttaacgtttccgaaaccctttaaacccggttaaaggtcccgggttaccgggggtaacccgggggtaacccgttacccggttaccccgggttacgggggtaacccggaaccggggtttaaacttaacccgggtccgggtttaaccccccgtaacccgtttcccggtttaacccggttacccgttaccccccgtaaccggtaaacccggttaacccggggttccccctaaaccgggttttccccccggttacccgttacccccccgtacggttaccccccttaccccccgtaaccgtacccctaaacggccccgttaccccgg

SEQ ID NO: 139556 - DNA, 656 bp, Homo sapiens
  misc_feature: GYAE6OF01DWPSD.46.67.G01.1.454.CMB.1.raw
tcagactagcagtacacgaccggtgctcgatttagagtatacatattggggtttggggagtctcggtcaggacacagcatggacatgagggtccccgctcagctcctggggctcctgctactctggctccggaggtgccagatgtgacatcgagctgacccagtctccatcctccctgtctgcaaccggtgggaagacaggtcgtaccaccatcacttcggccggggacaagtcggaactattcgactaccttaattttaaagtggtatacaaacatacgaccgacggggtaccggaccctaagccttactaactctatagctgctatccgtagtttgacgtaaggtcggggtacccagtacggtagttcgaggtggcgagtggatcgtagggactagtactttcactcctcaacgtatactaacgttaatcgtacgtactaacggtagtaaggttattttacggaacttaacttttaattaccgttagtaaccctaagtaacgttaaacttacttaacgtttcggtttaaccggaaccggtaaacgggtactaacgtaaacttaaacgtaaacttacggtaactgggtacgctagtaccgtactaagttcctcgttacttctaaccttcccgttacccgattactccgttagtac

SEQ ID NO: 139557 - DNA, 725 bp, Homo sapiens
  misc_feature: GYAE6OF01ET2BM.46.67.G01.1.454.CMB.1.raw
  modified_base (218)..(218): a, c, t, g, unknown or other
  misc_feature (218)..(218): n is a, c, g, or t
  modified_base (263)..(263): a, c, t, g, unknown or other
  misc_feature (263)..(263): n is a, c, g, or t
  modified_base (313)..(313): a, c, t, g, unknown or other
  misc_feature (313)..(313): n is a, c, g, or t
  modified_base (712)..(712): a, c, t, g, unknown or other
  misc_feature (712)..(712): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgacgtggtgacggccttcggacgacccttgtccctcacctgcgctgtctcgtggtcncctccatcacgttgttggtttcttcgtcggggctcggggtccgcncgcctcccgagggaggggctaggaatacgtagttaggaagttgtctcctnagttggtaggtacggttcctagttaccgacgttccggtctctacgaagtacggtcgacgttacaacctacttactctccgtacggaactaccgtccaaggtacctaatcgttaccgttttcccgtagtaacgtagtacggtagtttccgtcggttacgacccgccggtcctacggtaaccggtaccggtttactttaacgtttacgtggtacggacggtaacggtaaggtacggtactttagttagttacggtttagtttttggacgttttagtttaacgtttcctaccgtaccgttagcggttaacgggtccgggtacccgtaccggtcccgggtaggggtacccgtaaggggtacttaccggtacggttacccgacccgttccctttaccggttccncccgttaacccgg

SEQ ID NO: 139558 - DNA, 943 bp, Homo sapiens
  misc_feature: GYAE6OF01BYC8Y.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatccctccctgtctgacaaccggtgggagactagtcgtcaccatcacgttcggccgggtacaaggttccggaaactagtttacgaacctaaccgttttaatttttaaaagttcgggttaactaccctaaaacgtaaacgttaaaccggaaccggaacggggaacccgggtacccccttaaacggacccttaacccttaaacggtttacctaacgttaccggtaccttacggacctaacttacccgttaagggttttacggaaccgtaaaaacggggtttccggggggtaaccccctaaagggttcccgggtaagggttttaccggaaacgggtcgggtacggtaaagggttcgggtaacggttacggtacggggtaaaccgttacggtttaacgtttaccccgtaacccgtttaccgttaaacccgtaaacccgttaacgttaaccgttaaacggtttaaacgtttacccgttaacggtaaaccccgttaaacgggtttaaccgttaaaacgtttacgttttaaccggttaaaccttaaaaccgttttaacgtttaacttacggttaaaccgtaaaacgtaacgtttaaacgtttaactaaagggttttacggtttaccggaaaccggtaaacgtacccgttaaacggtaaaccttaaacgttaaaacgttaacgtaaccggttaggtacgaacggtaccaccgttaacctacttaccttacggtaccttacccgttacgttaccccttaccgtaccttaactccgttagtaaccc

SEQ ID NO: 139559 - DNA, 628 bp, Homo sapiens
  misc_feature: GYAE6OF01C9WOW.46.67.G01.1.454.CMB.1.raw
  modified_base (171)..(171): a, c, t, g, unknown or other
  misc_feature (171)..(171): n is a, c, g, or t
  modified_base (290)..(290): a, c, t, g, unknown or other
  misc_feature (290)..(290): n is a, c, g, or t
  modified_base (294)..(294): a, c, t, g, unknown or other
  misc_feature (294)..(294): n is a, c, g, or t
  modified_base (312)..(312): a, c, t, g, unknown or other
  misc_feature (312)..(312): n is a, c, g, or t
  modified_base (373)..(373): a, c, t, g, unknown or other
  misc_feature (373)..(373): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggttttctcgtggggctgggtccggcagctcccgaaggggaagggctggaatacagttggaagttgtctctcagtagtggaggttcctattacagtccgtctctnaagngtcgagtcaccatatctntggacacgtccagcaatctacgtttccctgaacgatgtagttctgtgaccgccgctcgacncgggtctttatacgtgtcgcgtagacggacgtacttattatgttatttttgggtagttggtttactttacgtacctaccgtagtacgttcggacggggtctccggaccccgttggggaccgtagggtaactacgttcggtaccgtaccgttcctaccgttacgccctaccgaacccgaacgggtccctaacggttcccggtcccgtttacccccgtcggtaccctaccccgtcccttacccaaggtcgtaccccg

SEQ ID NO: 139560 - DNA, 661 bp, Homo sapiens
  misc_feature: GYAE6OF01DN9VR.46.67.G01.1.454.CMB.1.raw
  modified_base (313)..(313): a, c, t, g, unknown or other
  misc_feature (313)..(313): n is a, c, g, or t
  modified_base (364)..(364): a, c, t, g, unknown or other
  misc_feature (364)..(364): n is a, c, g, or t
  modified_base (392)..(392): a, c, t, g, unknown or other
  misc_feature (392)..(392): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgacgtggtgacggccttcggacgccctgtccctcacctgcgctgtctcgtggtgccctccatcgtagttagttcgttttcttcgtggggtcgtcgggtccggcagccgtaccgagggacgggtcgtagaatacgagttaggaagttcgtctntacgtagttaggtggtacgttccttagttacacgttccgtctctagaacgngtcgagtaccactatatcgtctgaaccnccgtcagacctaacttcgtaccgttttccaggtaactgtcgtagttcgtgcgaccgtcgcgtgtaacgtcggttatttacttcgtggtacgagagacggtcgtacttattcgttcgtttaggttttaggaggtttacgttttactttaccgaacctaccgtaggtaaccgtcgggtaccgggtaccttcccgggtacccggtggaccggtaacggaagtttaccgcggtacccgtaccggttaccttcccgtccgtccctaaccccggg

SEQ ID NO: 139561 - DNA, 681 bp, Homo sapiens
  misc_feature: GYAE6OF01C128C.46.67.G01.1.454.CMB.1.raw
  modified_base (190)..(190): a, c, t, g, unknown or other
  misc_feature (190)..(190): n is a, c, g, or t
  modified_base (214)..(214): a, c, t, g, unknown or other
  misc_feature (214)..(214): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaccggtgganacagtgtcaccatcacttgccggnaagtcgaacatgacactattaatgtatacaacatagaccgacgggacgaccctaagctacctaatctatgctgctatccgtagtttcgacgtaaggtcgggtacccagtcggtaggttcaggtgacgaggtgtatcgtagggaactagtactttcgactcactacctatactaagtaactcgtacgacgtaacgtagtaaagttagtttacgaacttaactttacttaacgtacgttaaccaaacgtaacttaaacttaacgttaacgtttacggttttaccggaaccggtaaacgggtaaccctaaacgtaaaccttaaacgttaaaaacgttaaacggtaacgttacgggttacggtacgttacgtaacccgttaacctagtttaccgttacgttacccgtttaaccttaccgtttaccccgttaaccccggttaccttaaccgttccgttaacgttaaacccgg

SEQ ID NO: 139562 - DNA, 728 bp, Homo sapiens
  misc_feature: GYAE6OF01AK4NE.46.67.G01.1.454.CMB.1.raw
  modified_base (172)..(172): a, c, t, g, unknown or other
  misc_feature (172)..(172): n is a, c, g, or t
  modified_base (210)..(210): a, c, t, g, unknown or other
  misc_feature (210)..(210): n is a, c, g, or t
tcagactagcagtacacgaccggtgctcgatttagagtatacatattgggtttgtcctcctgctggtggcagctcccagatgggtcctgtccctggtgcaactgcaggagtcgggccccacgactggtgaggccttcggagaccctgtccctaacctgcgctgtctctggtncctcatcagtagtggtttcttcgtgggctgggtccggnagctccgagggagggctaggaatacagttggaagtgtctctcataggtggagttcctattacacgttccgttctctacaagtagtcgagtaccacctatatctcgtcggactccgtccagacctaatccttacgttttcccagtaacgtataggtacgtttcgttacgtccgtaccggcccgtcgtacggtacggtaccgggtttaccggtttattaacggttgtaggtaccggaggaacggtacggtactttaagttttacggtagttttagttttacgggtagtttacggttttaccttaccgtaacccgttaccgtaggtacgtccggggacggtccgtacccggacccggtcgggaaccgaagggtaccttacggttccggacgttaccgtccggttactacccgtccctaccgtacccgggaccggtccccgttagtccccggttccccgtcccccggtccgtaccccgttacccccgttcccgaacccgtaacgtcccgtacctaccccggg

SEQ ID NO: 139563 - DNA, 830 bp, Homo sapiens
  misc_feature: GYAE6OF01CFXS7.46.67.G01.1.454.CMB.1.raw
  modified_base (237)..(237): a, c, t, g, unknown or other
  misc_feature (237)..(237): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtcctggtgacaactgcagggacgtccgggcccagacgtgggtgacggtcccttacgggacgtaccccttggtccccctcaccctggccgtcttggtcctcgtgggtcnccctcatcagttgttcggtttctcggtcggggtctcgggtaccgcacgccgtaccggaggggaacgggtcgtaggtaacttacgtagttagggaagttcgttctctactaagttacggtagggtacgtttaccttattaccgtacgtccgttctactacgtaagtacggtccgtagtaccaacctattatactcgtacggtaccaccggtacacgtactaacgttcttaccgttttacccgaggtaagtacgttagtacgtttcgtacggtaccggaccccgtaccggtcgtacggtaaccggttacgggtttacggtttaactttacgtacgggtacggaccggtaacggacggtaccggttactttacgtttagtttcggttttaagttttaggggtaggttttaacgggttttaacgtttacccgtaacccgttaacccggttagggtacccggttaccggggggtaacccggggtccgtaaccccgggtaccccgggtacggggacccgggtaaagggttaccgtacggttaccggtcccggttacccgttacccgttacccggttacccgtcccggtaaaccccccgg

SEQ ID NO: 139564 - DNA, 810 bp, Homo sapiens
  misc_feature: GYAE6OF01CDPWM.46.67.G01.1.454.CMB.1.raw
  modified_base (270)..(270): a, c, t, g, unknown or other
  misc_feature (270)..(270): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactgggtgaggccttcggacgaccctgtcccctcacctgcgctgtcctcgtggtcgcctccatcagttagtcgttttctcgtggggctcggggtccgcagcctcccggaggggaacgggctaggaatacgagttggaagtgtctctanagtaggtggtacggttacctattacgtacgttccgtctactacaaggtcgtacggtacgtacaacctatacttcctacgtacggaccctccgtaccagtacctaatccgttacgttttaccgaagtaagtactggttacgttcgtacggtccgaacccggtcgtccgtacggtacggtaccgggtttactttacgttacgtgtacggtacggtaaggtacggtaccggttatttaagtttgtttagtttaggttttaggtacggtttcgtttaacgttacggtaacccgttaccggtaaggtaccgggttaccggggacccggggttaccgtaaccccggggttaccccgggtacgggtaaccgggaacgggttaaaccgttacccgggttacgtacccggtacccgtttcccgttaccgtaccccggtacccgtaacccgaacccggtacccggggtaacccccttcggtccccggtttccccctaccccggtaccgtaccccctaccccgtaacctacccggacgtcccgtaccccgg

SEQ ID NO: 139565 - DNA, 787 bp, Homo sapiens
  misc_feature: GYAE6OF01EJYYY.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgactggtgaggccttcggagacccctgtcccctcacctgcgctgtctcgtggtcgcctccatcagtagttggtttctcgtggggcgtggggtccgcagcctccgaggggaaggggctaggaatacgtattaggaagtgtctctacagttaggtggtacggttccttattacgtacggttcccgtctcctacgaagacgtcgtagtccaactatactcctcgtacggactaccggtaccacgactaacgtacttaccgttttacccgaggtaacgtagttcggtacgtttctacggtacccggtacccggtcccgtacgttacggaacggtacccggggtttacgtttttaacgttacggtttcggtcggacggtacggaacggtaccgttatttaagtttacgttaggttttagtttttacggggaagggttttacggttttaacgttttacccgaacccgttaacccgttaaggtaccggtacccggggtacccgggggtaccttacccccggggtaccccggggttacggggtaacccgggtaaagggtaacctttacccgggtcgggtttacccgtaccccggttcccgtttaacccgttcccggtaccccgtaacccccggg

SEQ ID NO: 139566 - DNA, 693 bp, Homo sapiens
  misc_feature: GYAE6OF01A3O8G.46.67.G01.1.454.CMB.1.raw
  modified_base (398)..(398): a, c, t, g, unknown or other
  misc_feature (398)..(398): n is a, c, g, or t
  modified_base (471)..(471): a, c, t, g, unknown or other
  misc_feature (471)..(471): n is a, c, g, or t
tcagactagcagtacacgaccggtgctcgatttagagtatacatattgggtttggggagtctcggtcaggacacagcatggacatgacgggtccccgctcagctccgtggggctcctgctactctggctccggaggtgccagatgtgacagtcgagctcgacccagtcctccactcccgtcctgtcctagccgaacggtgggaacgacagtcgtccaacctatcctacgttcggaccgggtacaacggtaccggaactattacggaaccttaaccttaagttttaaagttacggtaactacgaactaagtacggaaccggtaccgggacccgtaccctaagcctactaactctagtcgctcgacacgtacgtagtttgacgtaacggtcgggtacccngtacggtacgtcgaggtcgacggtaggtgacgtggtacgggaacttagtacttacctactccgaccgtaaccncgttataacgtactacgtacgtaacgtacgttaagtacgttagttacgtaacgttacttacgtacgtacgtactaacgtaagtaattacgtagttacgttacgtaccgtaacggactaaccgtataaacgtaaagttacggaacttcgggtactcgtacgtaacgccttaagtcttacgttcttaacgaccgtttccctaccgtacctaccgtgttcgtacg

SEQ ID NO: 139567 - DNA, 617 bp, Homo sapiens
  misc_feature: GYAE6OF01AOUGZ.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccactcctccctgtctgcaaccgtgggagacagtgtcaccatcacttggccgggcaagtcgaacattgacactatttaaatggtatcaacatacgaccagggacgccctaagctacctaatctatcgctgcatcctagtttgacaaaggtcgggtcccagttcggaggttcgaggtggcagtggatcgtgggacagtacttcgactctaccactatacaagttatcgtagactaacgtgaagttatttagacttaacttatacgttagtacaactagtaacttacgtaatttacggttttaccgaacgtaacggtaactaaccgtaaacttaaactaaacgttaaaccgtaacgttcgtaacggtcctacgtaccaaccgttagttccgttcgttaccctttaccttaccgttaccccgttaccccggtaccttaccgtcccttacgttaacg

SEQ ID NO: 139568 - DNA, 742 bp, Homo sapiens
  misc_feature: GYAE6OF01D5IWU.46.67.G01.1.454.CMB.1.raw
  modified_base (138)..(138): a, c, t, g, unknown or other
  misc_feature (138)..(138): n is a, c, g, or t
  modified_base (201)..(201): a, c, t, g, unknown or other
  misc_feature (201)..(201): n is a, c, g, or t
  modified_base (296)..(296): a, c, t, g, unknown or other
  misc_feature (296)..(296): n is a, c, g, or t
  modified_base (479)..(479): a, c, t, g, unknown or other
  misc_feature (479)..(479): n is a, c, g, or t
tcagactagcagtacacgaccggtgctcgatttagagtatacatattgggtttggggacctcctgtgcaagaacatgaagcacctgtggtttgtcctcctgctggtggcagctccagtgtcggtcctcgtccgtggtnaccaatgcgaggcgtcggacccagacgtggtcgacgtccgttacggactccctcgtcccctanacctggcctcgttcgtacttcgtcggacgtcccttacgattcgtacggttacggtttcggtttaccttcgggtaggggtccttacggggtcccgngtaaccgtccggttacccgggaaggggaccggtacgtaaggtaaccgttaagtggttaggtaacgttcgtcttccgtataggttagggtcgacggttaccctagttacggctccgtcacgtaagacgtacgtcgtactacgaaccttaggtacctcgtacgttaccggaaccttccggaaacngtaacctcgtacgtttaaacgttcgaaacgtattcgtaggtttactcgtacggtacgacccgtcgtacgtcggtaccttacgggttacctttaagtccgtgggtaccgagtaccgggttagacgttacttagtacgttgtttaagtggtacgttgtaccgttaccacgcggttaagtccggttacgggccgtaccgacccgggtccgaaggcccggttagacgttaccgcgttacccgttctacggtactcggccctaaccgg

SEQ ID NO: 139569 - DNA, 720 bp, Homo sapiens
  misc_feature: GYAE6OF01D1ZUO.46.67.G01.1.454.CMB.1.raw
  modified_base (176)..(176): a, c, t, g, unknown or other
  misc_feature (176)..(176): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactgggtgaggcccttcgggagaccctgtccctcacctgcgctgtctctggtcncctccatcagttagttggtttcttcgtggggtcttggggtccgcagccgtcccgagggggaacggggtctaggaaatacgtagttaggaagttgtctctacagtagtgggagtttcctattaacagttcccgttctctacaaaggtgtcgagttccaacctatacttctcgtggaacctaccgttccgagacctaaattcgttacgtttttcccagaacgtatggtacgtttctggtcggacccgtccggtctcggaaccgtacggggttacgtttttaattaccgtggtacggacgaaggtacgacgggtacttaagtttacgttaggtttagtttttagggtaggtttcggtttaactttccggaaccctacccgtaggtacgtcgggtaccggggtctccggaaccccgtcgggaccgtagggtactacgttcgtaccgtaccgttcctccgttacgcctacccgaccgaaccggtccctacgttcccggttcccttcccccgtacggtccctaaccccgttcccaccgtaagcgtacccg

SEQ ID NO: 139570 - DNA, 658 bp, Homo sapiens
  misc_feature: GYAE6OF01DZ03C.46.67.G01.1.454.CMB.1.raw
  modified_base (201)..(201): a, c, t, g, unknown or other
  misc_feature (201)..(201): n is a, c, g, or t
  modified_base (223)..(223): a, c, t, g, unknown or other
  misc_feature (223)..(223): n is a, c, g, or t
  modified_base (460)..(460): a, c, t, g, unknown or other
  misc_feature (460)..(460): n is a, c, g, or t
  modified_base (472)..(472): a, c, t, g, unknown or other
  misc_feature (472)..(472): n is a, c, g, or t
  modified_base (479)..(479): a, c, t, g, unknown or other
  misc_feature (479)..(479): n is a, c, g, or t
  modified_base (485)..(485): a, c, t, g, unknown or other
  misc_feature (485)..(485): n is a, c, g, or t
  modified_base (500)..(500): a, c, t, g, unknown or other
  misc_feature (500)..(500): n is a, c, g, or t
  modified_base (509)..(509): a, c, t, g, unknown or other
  misc_feature (509)..(509): n is a, c, g, or t
  modified_base (538)..(538): a, c, t, g, unknown or other
  misc_feature (538)..(538): n is a, c, g, or t
  modified_base (587)..(587): a, c, t, g, unknown or other
  misc_feature (587)..(587): n is a, c, g, or t
  modified_base (594)..(594): a, c, t, g, unknown or other
  misc_feature (594)..(594): n is a, c, g, or t
  modified_base (597)..(597): a, c, t, g, unknown or other
  misc_feature (597)..(597): n is a, c, g, or t
  modified_base (628)..(628): a, c, t, g, unknown or other
  misc_feature (628)..(628): n is a, c, g, or t
  modified_base (651)..(651): a, c, t, g, unknown or other
  misc_feature (651)..(651): n is a, c, g, or t
tcagactagcagtacacgaccggtgctcgatttagagtatacatagttgggtttggggagtctcggtcaggacacagcagtggacatggacgggtccccgctcagctccgtggggctcctgctactcgtggcctccggaggtcgccagtatgtgactagtcggagctacgaccagttcctcctactcccttccgtgtcganaccgtaacgggtaggagaacgnggttccgaccaactactaccgtcgttaccggaccgggacaaaacggtccggaaaccttagttaccggtaaaccttaaccgttaaagttttaaaacgttcggtaacttacaaacgtagtaaaccggaccgggaaaccgggacccggtaacccttaactacccttacctagtaccttagcgtacgtacgactacgtacctagttacgaacgtaagggtccggtacagtaggtagtacgngtgacagggtangtacggngaactnttactactacgctanaacagttanaacggtatcgaagtagtagtgtaaacttntacgactaattacgtcgaataccgaatactactatacgtagtcaagacngaactanaanaagtacgactgacactcgatgttactctctnaccttaccgactacggtaatgtntaacccg

SEQ ID NO: 139571 - DNA, 615 bp, Homo sapiens
  misc_feature: GYAE6OF01BZF43.46.67.G01.1.454.CMB.1.raw
  modified_base (337)..(337): a, c, t, g, unknown or other
  misc_feature (337)..(337): n is a, c, g, or t
  modified_base (431)..(431): a, c, t, g, unknown or other
  misc_feature (431)..(431): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctaacctgcgctgtctctggtgcctccatcagtagtggtttcttctggggctggggtccggcagctcccgagggaaggggctggaatacattggaagtgtctctcatagtggaggttccattaacagtccgtctctcaagagtcgagtcaaccatatctctggacacggtccagcaatcagttttccngaagatgagttctgtgacccgcgctgacacgggtctttattactgtgcgagaggacgctattatgtattttggagtgttatttcgacacctagntcgacggggctccgaccccgtggggaccagggaatacgtcggtcaccggttcctaccgttagcccgttacccaccgtaaacgggccccgtaagttcccgggttcccgtttacccccccgttacggggaccccctacccccgttccccttaacccccgaaaggtaaccgcccgttaaacccccgg

SEQ ID NO: 139572 - DNA, 572 bp, Homo sapiens
  misc_feature: GYAE6OF01AW931.46.67.G01.1.454.CMB.1.raw
  modified_base (287)..(287): a, c, t, g, unknown or other
  misc_feature (287)..(287): n is a, c, g, or t
  modified_base (299)..(299): a, c, t, g, unknown or other
  misc_feature (299)..(299): n is a, c, g, or t
  modified_base (333)..(333): a, c, t, g, unknown or other
  misc_feature (333)..(333): n is a, c, g, or t
  modified_base (339)..(339): a, c, t, g, unknown or other
  misc_feature (339)..(339): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtgtggtttctctggggctgggtccggcagctcccaggggaaggggctggaatacattggaagtgtctctcatagtggaggttcctattacagtccgtctctcaagngtcgagtcaccntatctctggacacgtccagcaatcagttttcccngaacgntgagttctgtcgaccgcgctgacacgggtctttatacgtgtgcgaggagacggtctattagtgtatttttgggagtttggtttatttcgactaccctagacgtcggacggggctccgaccccgtggggccagggtatacgtcggtctaccgtctccgttacgccctaccgaccgtacgggcccagtcccgtcccttcccccgtcggccctaccctaccctccaagtcgtaccg

SEQ ID NO: 139573 - DNA, 857 bp, Homo sapiens
  misc_feature: GYAE6OF01DCK8T.46.67.G01.1.454.CMB.1.raw
  modified_base (433)..(433): a, c, t, g, unknown or other
  misc_feature (433)..(433): n is a, c, g, or t
tcagactagcagtacacgaccggtgctcgatttagagtatacatattgggtttgtcctcctgctggtggcagctcccagatgggtcctgtccctggtgcaactgcaggacgtcgggcccacgactggtgaggtccttcggacgtaccctgtcccctcacctgcgtctcgtctcgtggtcgccctccatctagttaggttcggtttcgttcggtgggggtcgtcggggtccggacgacgtcccgtacccggaagggggtaacgggggtccgtaagggtaaattaccgtaaggtttaggggtaaacggttcgttaccgtccgtacgtaaggttaagggttgggttaaccggtttaccttaacgttaaccgtacggttcccgttcttaccgtaacgaaaggtacgtcgtaacgtcctaacctattactccgttacnccgggtaaccaccgtaccgacgtactaacgttacgtttaccgtttaccgtaagtaagtcgttggttacgtttcgtacggttcgaccgtcccggtctacggttaaccggtacggggttttctttaacgtttcgtacggtacggacggtaggtaacggtacgttacgtttaagtacgttagttttaggtttaggtaaggtttcgtttacgttaccgaaccttaccgggtacgtacgggttaccgggaccgggtacccgtttaccgggaccccggtaggggtacccgaagggttacgttaccggttccgttaccgtcccgttacgtacccgttacggcccctaacccggaacggtcccggtacccgttcggttccccgttccccgtacccgcgtacccctacccgtaccacccggagcccggtaccg

SEQ ID NO: 139574 - DNA, 654 bp, Homo sapiens
  misc_feature: GYAE6OF01CAHWJ.46.67.G01.1.454.CMB.1.raw
  modified_base (191)..(191): a, c, t, g, unknown or other
  misc_feature (191)..(191): n is a, c, g, or t
  modified_base (218)..(218): a, c, t, g, unknown or other
  misc_feature (218)..(218): n is a, c, g, or t
  modified_base (589)..(589): a, c, t, g, unknown or other
  misc_feature (589)..(589): n is a, c, g, or t
tcagactagcagtacacgaccggtgctcgatttagagtatacatattggggtttggggagtctcggtcaggacacagcatggacatgagggtccccgctcagctcctggggctcctgctactctggctccgaggtgccagatgtgacatcgagctcgacccagtctccatcctcctgtctgcacggtgganacagtgtcacatcacgttcggccgganagtcgaactattcgacctacttatttaaagttggtatacaacagtacgaccgagggaccgaccctaagcctacctaatctatacgctcgctactcctagtttcgacgtaacggtcgggtacccagttcgtaggttcgagtcggcgtaggtaggtagtcggtgggaactagttacgtttacaccgtctaccgacctattacgtaagttactcgtacgtaccgtaaacgtagtaaagttagttttacgaactttaaactttagttaaccgttacgtaactaactaagttaacttaacgttacgtttcggttaccgaacgtaacgggactaacgaacttaaactaaacgtaacgtacgtaggtacgtacgtacnccgtactagttcttacgttccttaaccttcgtttaccccgtaccgtactacttccgtattaaccg

SEQ ID NO: 139575 - DNA, 691 bp, Homo sapiens
  misc_feature: GYAE6OF01A3V19.46.67.G01.1.454.CMB.1.raw
  modified_base (136)..(136): a, c, t, g, unknown or other
  misc_feature (136)..(136): n is a, c, g, or t
  modified_base (224)..(224): a, c, t, g, unknown or other
  misc_feature (224)..(224): n is a, c, g, or t
  modified_base (251)..(251): a, c, t, g, unknown or other
  misc_feature (251)..(251): n is a, c, g, or t
  modified_base (263)..(263): a, c, t, g, unknown or other
  misc_feature (263)..(263): n is a, c, g, or t
  modified_base (496)..(496): a, c, t, g, unknown or other
  misc_feature (496)..(496): n is a, c, g, or t
  modified_base (569)..(569): a, c, t, g, unknown or other
  misc_feature (569)..(569): n is a, c, g, or t
tcagactagcagtacacgaccggtgctcgatttagagtatacatattgggtttgggggacctcctgtgcaagaacatgaagcacctgtggtttgtcctctgctggtgcagctcccagatgggtcctgtccctggtncaactgacaggacgtcgggcccagacgtggtgacggtccttcgggacacccctgtcccctcgaccgtgccgtctgtcctcgtgggtcnccctccatcgtagttgtcgtttctcgnggggctgggccncgtgctccggagggtagggctaggatacgtagttaggagtcgtctcgtcagttcggtggtacgttacctagtaccgtacgttcccggtacttcgtaacgacggtacgtcgtacggtaccaccgtattactccgtacgtacggtaacctacggtacacgtaactacttaccgttaccgttttccgagaacgttgtagtcgtttcgtacggtacggacccgtcctagtaaccggngtaccgggtttatttacgtaccgtggacggtagacggtacgtcgtattagtttagtacgtttggttttacggnggtttagttaccgtctaacggtcctaaggccgggtcggtaccggcctaacggggcccgttgggaccggtaaaggtcccttacggtcggtacccgtaccgttccagttcccgacccgtcccgg

SEQ ID NO: 139576 - DNA, 822 bp, Homo sapiens
  misc_feature: GYAE6OF01AOZGO.46.67.G01.1.454.CMB.1.raw
  modified_base (513)..(513): a, c, t, g, unknown or other
  misc_feature (513)..(513): n is a, c, g, or t
  modified_base (805)..(805): a, c, t, g, unknown or other
  misc_feature (805)..(805): n is a, c, g, or t
tcagactagcagtacacgaccggtgctcgatttagagtatacatattggggtttgggggagtctcggtcaggacacagcatggacactggacgggtccccgctcacgctccgtcggggcctcctagctactcgtggctccgaggtcgccagagtcgtagacagtcgacgctcgacccagtcctcctactcctccgtgtcctcgaccgaacggtgggacgacgtagtacgtaccacctacgtaccgtacgtttcggaccgggactaacggtaccggtaactacgttacgaacttaaaccgttaagttttaaacggttcggttaactaaccgaaacgtaacggtaaccggaaccggtaacgggggaaccccgtacccgttaaagtcccgttaaaccggttaactacgttacgtacggtaccgtagtacctaaacgttccggtaggtttaaccggaccgttaacggggtccgtaaccctaggttcccggtaggttagacgtcggtagttaacgggngtaccgtggaacgggaccttaaggttcctactaccgtacctaccggtaaccttaaggttcgtaacgtagtccgtaaacggtacgtacgttagtaacttagttacgtaacttacgtttaacgtacgtacgtaaacttaacgtacgtttaaattaccgttaaagttccggtttaaggaaacccgtaacggtaccgtaaaccgtaacgtttaaaacggtaagttaacggtcggttaccgggaacgtaccgtaacgtaccgtaaccgttcgttcgtacgttcctaacgcttacccncgtatcgtaactcgtac

SEQ ID NO: 139577 - DNA, 800 bp, Homo sapiens
  misc_feature: GYAE6OF01CV0D1.46.67.G01.1.454.CMB.1.raw
  modified_base (357)..(357): a, c, t, g, unknown or other
  misc_feature (357)..(357): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagaccctgtccctcacctgcgctgtctcgtggtcgcctccatcgaggttagttcggttttccttcggtggggtcgtcggggtcccggcgacgccgtacccggagggggaacgggtccgtaggaaattacgaagtttagggaagttcgtcctactctagtaggtagggtacgttcttaattacgagtccgttctctacaagagtacgagtacactaatntctcgtcgaacctaccgtccacgactaatcgtacgtttccagaatagtgtagttcgttgaccgccgccgtcgtacgtaccgtacgggtttctttaacgtacgtggtacgtacggaaggtacgtacggtactttaagttacgttaggttttaaggtttttacgggtaaggtttagggttttactttacccggtaacctacccgttaagggtaccgttaccggggccggggtacccttaccccggggacccggtcggggaacccgtaagggttaaccgttaccggttcggtacccgtacccgtttcccgttacccgttaccggtacccccgttaacccgaaccggtaaccccgggaccccttaccggttccccggtttacccccgtttccccggtacggtaccccctaaccccgttccgtaaacccgaacggtccgtaaccccgg

SEQ ID NO: 139578 - DNA, 811 bp, Homo sapiens
  misc_feature: GYAE6OF01B0TQU.46.67.G01.1.454.CMB.1.raw
  modified_base (174)..(174): a, c, t, g, unknown or other
  misc_feature (174)..(174): n is a, c, g, or t
  modified_base (252)..(252): a, c, t, g, unknown or other
  misc_feature (252)..(252): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggccttcggaacgccctgtccctcacctgcgctgtctctggtcncctcatcagtgtgtttctcgtgggctgggtccgcacgcctccggaggggacgggctaggaatacgtagttggaagttntcgtctctaagtaggtggttaggttaccttaagttaccgtacggttccgttcctacgtacgaacggtacgttaccgtacgtaccaaccgtacttaacttcgttaccgtacggaaccgtaccgtaccgaacgtactaacgttaccgttaccgtttttaccccgtagtaaacggtactaggtacgtttacgtcggttaccggaccgtacccgtcgtacggtaaccggttaccgggttacttttaacgtttacgtcgtttacggacggtaacggtaacgtaccgggtactttaagtttaagttacggttttaaaggttttcgggttaaagggtttacggttttacgttaaccggtaaccctaacgttacggtaccgggtaaccgggtacccgggtccgtacccgtacccgggtcgggaaccgggtacgggtaaccttacggtccgtacgtacccttccgttcctaacgtccccgtaccgaacccggtaccggtccctaccggttccccgttccccgtacccggctacccctacccgtacctaaccggacgtcccgtaaccgg

SEQ ID NO: 139579 - DNA, 826 bp, Homo sapiens
  misc_feature: GYAE6OF01EL6YN.46.67.G01.1.454.CMB.1.raw
  modified_base (174)..(174): a, c, t, g, unknown or other
  misc_feature (174)..(174): n is a, c, g, or t
  modified_base (194)..(194): a, c, t, g, unknown or other
  misc_feature (194)..(194): n is a, c, g, or t
  modified_base (206)..(206): a, c, t, g, unknown or other
  misc_feature (206)..(206): n is a, c, g, or t
  modified_base (371)..(371): a, c, t, g, unknown or other
  misc_feature (371)..(371): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggccttcggacgaccctgtccctcacctgcgctgtctcgtgtcncctcatcagtgtgttctcgngggctgggccgnagcctccgaggggacgggctaggaatcagttggaactgtctctacagtaggtggtacgttcctaattacgacgttccgtctctcaagtacgtcgaactcacctatatccgtcgtacggacctacggtccaagactaacttcccgttacttttacccaaggtaaancgttaggtacttcgtggaccgacccgtccggctacgggaaccgtacgggttttaacgttttacgtaacgttgggcgtacgggaacgaacggtacggtactttaagtttagttagtttaagggtttttcggaggtttacggtttagtttaacccggtaaccttaacccgtaaggtacccggttacggggaccccggggttccgttaccccgggtaccccgggtaaccggggaaccggtaacgggttaaacgttacccggttaccgggttacctaccccggttaccccggttacttaaccccggtacccccgtaacccggaaccccggtaaacccgggtcccccttaacccgggtttcccccgggttaccccccgttccccccggtaacccggttaccccccgtaaccccccgttaacccccggtaaccgtaaacccggtaccggtaaccccccggg

SEQ ID NO: 139580 - DNA, 851 bp, Homo sapiens
  misc_feature: GYAE6OF01AFBVZ.46.67.G01.1.454.CMB.1.raw
  modified_base (186)..(186): a, c, t, g, unknown or other
  misc_feature (186)..(186): n is a, c, g, or t
tcagactagcagtacacgaccggtgctcgatttagagtatacatattgggtttgtcctcctgctggtggcagctcccagatgggtcctgtccctggtgcaactgcaggacgtcgggcccacggactgggtgaggtccttcgggacgacccctgtcccctcgaccgtgccgtctggtctcgtggtcnccctccatcgaggttaggttcggtttccgtcggtcgggggtccgttacgggggtcccgcgtacggtcccgtacccgggaaggggggtaacggggtctaagggtaaacttaccgtaggttacgggaacgttcggtccttcgtacgtaggttagggtcggttaccgttacttaacgtaccgtcgttccgttccgtacgtacggaacgtcgtacgtactaccacgtagtacgtccgtacgtacggtacctaccgtacgacgtactaacgttccgttaccgttaccgaggaacgtacgtacggttacgttcgtacggtaccgtaccggtcgtaccgtacggtacccggttacgggtttactttacggtcgtacggtacggaacggtacggtacggtacgttagttagttacggttagtttacggttaggtacggtttacgttaccgtaccgtaaccggtacgtacggtaccgggtccgggtaccggtacccgtaccgggtaccgggtacgggtaccggtaacgttaccgtaccggtccgtacccgtaccgttaccgtacccgtcccggtacccgtaccggacccggtccggtacccgttcccggttccccggttaccccgtcccgtacccggtaccctacccgtacggaccgtaacggtcccgtcccgg

SEQ ID NO: 139581 - DNA, 953 bp, Homo sapiens
  misc_feature: GYAE6OF01DSZ1W.46.67.G01.1.454.CMB.1.raw
tcagactagcagtacacgaccggtgctcgatttagagtatacatattgggtttgtcctcctgctggtggcagctcccagatgggtcctgtccctggtgcaactgcgaggacgtccgggcccacgacgtgggtgacggtccgttcggacgaccctcgtccctcacctgcgctgtctcgtggtcgcctcatcgtagttaggttcggtttcgtcggtgggtcgtcggggtccggcacgtccgtaccggaaggggaacggggtcgtaaggtaacttacgtaaggtttagggaacgttcgttacgttacgtacgtaagttaggttacggttacggtttaccttaacgttacgtaccggttcccgttactaccgttaacgtaaggtacggtaccgtacgtacctaacctacttacgttaccgtacgttaacggaccctaaccggtaccaacgtaacttaacgttccgttttaaccgttttaccgtaaggtaacgttagttacggttacgtttcggttaccggtaccggtacccgtccggtaccgttaaccggtaaccgggtttaccggtttacgttttaacgtttcggttaggtaccgggaaggttacggtaaccggttacggtttacttttaaggttttaaggtttacgggtttttaaggtttttaggggtaacgggtttttactttaacccgggttaacctaaccccggtaacggttacggggtacggtaaccccggggtacgggggtcccccttaacccggggtccccggggtaagggtacccggtaaagggtttaaccccttcgggttacccgtaccggttacccgttacgtttacccgtacccgtacccccgtaaccggtaacccgggtacccgggtaccctttaccgggttcccccgtttccccctacccgtacgtaccccctaccctaccggtaccacgtccggtaaccccg

SEQ ID NO: 139582 - DNA, 795 bp, Homo sapiens
  misc_feature: GYAE6OF01CSCOI.46.67.G01.1.454.CMB.1.raw
  modified_base (567)..(567): a, c, t, g, unknown or other
  misc_feature (567)..(567): n is a, c, g, or t
tcagactagcagtacacgaccggtgctcgatttagagtatacatattgggtttggggagtctcggtcaggacacagcatggacatgacgggtccccgctcagctcctggggctcctgctactctggctccgaggtgccagatgtgacatcgagctcgacccagtcctcctactcctccctgtctcgaccgaaccggtgggacgacgagtcgtaccaccactccgtacgttcggacccgggtacaacggtaccggaactagtttacgaacctaacctttaattttaaacgttggttaactaccaaactaagtaacggaacccggtaacggggaacccggtacccctaacggtcccttaaccgtaacttaccttaagtcgtcctacgtaccttacgttaccgttaggtttacgaacggttaaacgggtccgggtaccctagtacggtacggttacgacgggtaggcgtaggtcggtacgtcggtaacgggaacgtagttacgtttaccaccttcctaaccactatactaagtactcgtacgaacgtaacggtcgttaagttacgtttanaaccgtttaatttactacgttacgtaaacgaattaattaaacgttacttaaggttttaccggttaaccggtaaccggaaacggtacctaacgtaaacgttaaaaccttaaaccgttaacggaacggttccgggtacgacctcgtaaacccgtaccttacgttcgtttacccgttaaccttccgttacccttaccccggttcccttaacttcgttacctagggttaacc

SEQ ID NO: 139583 - DNA, 843 bp, Homo sapiens
  misc_feature: GYAE6OF01CULML.46.67.G01.1.454.CMB.1.raw
  modified_base (185)..(185): a, c, t, g, unknown or other
  misc_feature (185)..(185): n is a, c, g, or t
  modified_base (288)..(288): a, c, t, g, unknown or other
  misc_feature (288)..(288): n is a, c, g, or t
tcagactagcagtacacgaccggtgctcgatttagagtatacatattgggtttgtccctcctgctggtggcagctcccagatgggtcctgtccctggtgcaactgcagggagtccgggccccagacgtgggtgaggtcccttcgggacgacccctgtcccctcaccgtgcgctgtctcgtggtcncctcatcagtagttggtttctcggtggggctggggtcccgcacgtccgtcccggaagggggaacgggtctaggtaatacgtagttaggaagttgtcctcgtanagtaggtggtacggttaccttattacacggttcccgttctactacgaagtagtcgagtccaactatactcgtcgtcggacctaccgtacgagtactaacttacctacgttttacccagtaacagttagtacgttcgtgtaccggaccgtccgtacgtacggtaaccggtaccgggtttagttttaacgttacgttggtacggtcggaaacggtaacggtaaccgggttacctttaaggtttaagttaggtttttaacggttttttagggttaacggttttacgggtttttaacgtttacccggtaacccgttaacccggttaaagggtaccgggttacccggggttaacgggggtccccgttacccgggtaaccccggggttacggggtaacccggaaaggggttaccttaaccggttccggttaccgtaccccgtacgttcccgttaacgccccttacgaaccccggtaacgggtacccctacggtttccccgtaccccgttccccgtaccggtacccctaccccgttacccgtaacgtaccgccgtaccccgg

SEQ ID NO: 139584 - DNA, 714 bp, Homo sapiens
  misc_feature: GYAE6OF01ETGDZ.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgacgtggtgaggccttcggacgtaccctcgtccctcgacctgcgctgtctcgtggtcgcctcatcgagttagttggtttctcggtcggggcgtcgggtccgcacgcctaccggaggggaacgggcgtaggaactacgtagttggaagtcgtctctcgtagtaggtggtacggttcctaagttacgacggttcccgtacgtctacgtaagcgtacgtagtaccgaactatactctacgtcggaactaccgtacacgactaactcgttacgtttcccgagtaacgtgtagtacgttcgtcgtaccgcccgtcgtcgtacggaccgtacgggttacgttttactacgtcgtacggtacgaggacgtacgtactttagttacgttagtttagttttagggagttttacgttagttacccgaaccttaccggtagtacccgggtacggggtaccggggtacctcccgggtacccgggtacggggaccggtaagggttaaaccttcggtacggtacccgttacccgttcccgttaccgttaccgtccccggtaaccccgg

SEQ ID NO: 139585 - DNA, 837 bp, Homo sapiens
  misc_feature: GYAE6OF01B65Y7.46.67.G01.1.454.CMB.1.raw
  modified_base (227)..(227): a, c, t, g, unknown or other
  misc_feature (227)..(227): n is a, c, g, or t
  modified_base (266)..(266): a, c, t, g, unknown or other
  misc_feature (266)..(266): n is a, c, g, or t
tcagactagcagtacacgaccggtgctcgatttagagtatacatattgggtttgggggacctcctgtgcaagaacatgaagcacctgtggtttgtcctcctgctggtggcagcctcccagatgggtcctgtccctggtgcaactgcagggacgtccgggcccacgacgtgggtgaggtcccttcgggacgacccctgtcccctcacctgccgctgtcctcgtggtcnccctcatcgagtgttggtttctcgtggggctgggtccgnacgccgtaccggaggggaagggctaggaactactagttaggagtcgtctactctagtacggtggtacgtttaccttacgttacgtacgttcctctactaccgaagtcggtcgtacgtaccaactacttactcgtacgtacggacctaccgtccaacgtactaacgttaccgtttaccgttttacccgaggtaaacgtagttacggttacgttttccgtacggttacccggaacccccggtcggtaccggttacggtaaacccgggttacgggtttaccgttttaacgtttcggttcggtacggacggtacggtaacggttaccggtattttaaacgtttgtttacggttttaagggtttttagggtaacgggttttacggttttaacgttaccccggtaacctttaccccggtaagggtacccgggttccggggtacccggggtacccgtaccccccggggttacccggggtcgggggaacccgtaaaggggttacccgttacgggttcccgggttaacccttacccggtttacccgttacccgttacccggtcccccgtaaacccccggg

SEQ ID NO: 139586 - DNA, 867 bp, Homo sapiens
  misc_feature: GYAE6OF01EN530.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctggtctgcgaaccggtgggacacgagtgtccaccatccacgttggccgggacaaggtcggaaactattacggaacctaaccgtttaatttaaattcggtaattaccgaaaccaattaacggaccgaacggggtaaccggacccctaaagaccttacctaaacttcctaagtcggtacttcggcctacgtacctaggttttcggaacgtaaacggttcggggtaccctagttaccggtaagggttttccaagggtcggtacgtaaggtcgggtaactcggttaacggggaacttaacgggtaacttttaccgtaccgttcccgttaaccaaccgttacttaacgtaaccggtttaataccgttaacggaaccaaaggttacggttaaacgtttattttaccggaactttaaacccgtttaatttaacccgttagtaaccctaaataacgttaaactttacgttaaacttttacgggttttaccggaaacccggtaaacgggtaacttaaacccggtaaacgtttaaaacctaaaaacggtttaaacccgtaacggtttaacggtaccgggtacgttaaaccggaccccttaaaccggttaacctttcgtttaacccggttaccctttaacgttaacccccgttacccgtttaccccccgacctttaaaaccgttcccgttaaacccgttaaccg

SEQ ID NO: 139587 - DNA, 611 bp, Homo sapiens
  misc_feature: GYAE6OF01BAM9M.46.67.G01.1.454.CMB.1.raw
  modified_base (365)..(365): a, c, t, g, unknown or other
  misc_feature (365)..(365): n is a, c, g, or t
tcagactagcagtacacgaccggtgctcgatttagagtatacatattgggtttgggggagtctcggtcaggacacagcatggacatgagggtccccgctcagctcctgggggctcctgctactctggctccgaggtgccagatgtgacatcgagctgacccagtctccatcctccctgtctgcaaccggtgggagacagtgtcaccatcacttggccgggacaaggtcggaacattgactactatttaaatggtatcaacatacgaccgagggaccggaccctaagctacctaatctatgctgcatcctagtttgactaaaggtcgggtcccagtcggtagttcgaggtcggctaggtggatcgngggacagtattcactctacacatacgtagtaactctagactaacggtataagttactttagactaatttacttactagtaacaactaagtaactttaactaagtttacggtttaccggaaccgtaagggtaaccaacgtaaaccttaaactaaacgttaaacgaacgttaggtacgaccgtagacctaaccgttatccgttacgttacttacctactccccgtttacccgactacgttctagtaac

SEQ ID NO: 139588 - DNA, 826 bp, Homo sapiens
  misc_feature: GYAE6OF01EKG4A.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggacgacccttgtccctcacctgcgtctgtctcgtggtcgcctcatcagttagttcggtttcttcgtggggctcgggtccgcacgccgtcccggaggggagggctaggaactacagttgaagtgtctctctagtggtggtacgttacttagtacgtacgtccgtctctacgaagtacgtcgtacgtccactatactcgtacgtacggacctacgtaccgacgactaattcgttaccgttttaccgaggtaaacgtacgttacggttacgtttcgtacgtaccggtacccggtccggtacgtaccggtaacggtaccggggtttaacgttttaacgttacgttcgggtacggtacggtaacgggaacggtaaccggttattttaagtttaaggtttcggttttaaggttttttaccggggtaaggtttttacgggtttaaccgtttaccgtaaacccgttaaccccggtttaagggtacccggttacgggggtacccggggtacccttaccccggggtaccccgggtacggggaccggtaacgggtaaccgttaccgggttcgtacccggtccgttcccgttaccggtaccccgtcccgtaaccctaacccgggaccggttcccctaccggttccccgttacccgttcccccggtacgtcccctacccgccctaaccgcggtacgtacccg

SEQ ID NO: 139589 - DNA, 729 bp, Homo sapiens
  misc_feature: GYAE6OF01CJMYP.46.67.G01.1.454.CMB.1.raw
  modified_base (214)..(214): a, c, t, g, unknown or other
  misc_feature (214)..(214): n is a, c, g, or t
  modified_base (239)..(239): a, c, t, g, unknown or other
  misc_feature (239)..(239): n is a, c, g, or t
  modified_base (254)..(254): a, c, t, g, unknown or other
  misc_feature (254)..(254): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccagactggtgaggtcccttgggagaccctgtccctcacctgcgctgtctcgtggtcncctcatcgagttgttggtttctcgnggggcttcgggccgnacgcctcgaggggaagggtctaggaatactagttaggatgtctcgtctagtcggtggtacgtttcctaagttaaccgcggttcccgtacttctacgaaaggtacgtcgtagtccaacctatacgttctcgaacggaccaccggtacacgtactaatcccgttacgttttacccaggtaaagcgttgtaacgtttcgtacgttaccggacccgtccggtacgtcggaccggttaccgggttccttttaagttccgtgggtacgagtaacggacggtacgttactttagttaacgtgtttacggttttgggtaacgtttggttacctttcggaaccctacggttagaccggttccggggtaccggggtaccgtaccccggtaccggggtaccgggtaccggtaaagggtaacctttaccggttaccgggtacccttacccgggtcccttttacccggtggtaaccccccgtaccggg

SEQ ID NO: 139590 - DNA, 842 bp, Homo sapiens
  misc_feature: GYAE6OF01AK3AL.46.67.G01.1.454.CMB.1.raw
  modified_base (143)..(143): a, c, t, g, unknown or other
  misc_feature (143)..(143): n is a, c, g, or t
  modified_base (206)..(206): a, c, t, g, unknown or other
  misc_feature (206)..(206): n is a, c, g, or t
  modified_base (834)..(834): a, c, t, g, unknown or other
  misc_feature (834)..(834): n is a, c, g, or t
tcagactagcagtacacgaccggtgctcgatttagagtatacatattgggtttggggtagtcgtcggtcgaggacacagcatggacatgagggtcccgctcagctcctggggctcctgctactctggctccggaggtgccagntgtgacatcgagctgacccagtcctccatccctccctgtccgtcgaccaacccggttgggganaccgtaggtcgtccaacccattccaccgtttcggccgggtcaacgttccggaactagttcgacctaccttaagtttaattcggtattacgaactactaacgaccgtaacgggaccggtacccgtaaagtccgtaccttaacgttaccttactacggtcttacggctaaccgttccgtagtttacgaccgtaaacggtcggggtacccaagtcggtacggttaccgtaacggttcggggacttacggtaacgggtctaccgggttagggaacctgggttaactttccggtaaccgttaccgttaccgtaaccccgtaggtttaccgaacggtttaaacgttccggtttaccgaaccggttaaaccggtttaggttaaacggtttacgttttacgtaacggtttaaaacccttaagttttaccgttacggttaaaccttaacgtaaacggtttaaatttaacgtaacgtttaccggttttaccggaaaccggtaacgggtaacgtaaccgttaaaccgtaacgttaaaaccggtaactaacggtagttacggggttactaccaacgtacccgttattaacccgttgttaccccttagtaaccttaccgtacccgtaacttcttaaaccgnttaaaccg

SEQ ID NO: 139591 - DNA, 989 bp, Homo sapiens
  misc_feature: GYAE6OF01DGCJD.46.67.G01.1.454.CMB.1.raw
tcagactagcagtacacgaccggtgctcgatttagagtatacatattgggtttggggagtctcggtcaggacacagcatggacatgacgggtccccgctcagctccgtggggctcctgctactctggctcgaggtgccagatgtgacatcgagctcgacccagtcctaccactccctccctgtccgtcgaccgtaaccggtgggaagaccgtaggtcgtaccaaccacttccgacgttcggaccgggtactaacggtaccggaactagtttacggaaccttaacttaaattttaaacgttggtaacttaccgaaaactacgtaacggaaccgtaacggggtaacccgtaccctaaacggtccttaacctaaacttaccgtaacgtcggtacctacggtacctaacgttacccgttagggttttacgaaacccggttaaaacggggtttcccggggttaacccctaagggtttaccccgggttaacggggttttaaccgaacggggtttccgggggaaccgttaaagggggtttaccgggttaacggttacccggggttaacgggggtaaacccctaagttttaaaccggttttccccaacccggtttaacccttaaaccccgtaccgttaaacggttaacccttaaaggttaaaccgttaccggttaacggtaaaccccggttaaagggtttaaacgttaaaccgggtttaacttttaccggtaaacgttttaaacccgtttttaacgttaaccgtttaccgttaaaccgttaaaccgttaaacggtttaaaccgtttaaacgtttaaaccggttttaacgggtttaaccccgggtaaacggtaaaccggggtaacctaaaccgttaaaccgtaaaacttaaaaccgttaaaccggtaacggttacggtaccgtactacgtaccgtacctgttacttcggttacctacgttaccgttacccgttacccgacttactcgttacgtaaccg

SEQ ID NO: 139592 - DNA, 820 bp, Homo sapiens
  misc_feature: GYAE6OF01EHNTN.46.67.G01.1.454.CMB.1.raw
  modified_base (389)..(389): a, c, t, g, unknown or other
  misc_feature (389)..(389): n is a, c, g, or t
  modified_base (429)..(429): a, c, t, g, unknown or other
  misc_feature (429)..(429): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccagactggtgacggccttcggagaccctgtccctcacctgcgctgtctcgtggtcgcctcatcagtagtgtttctcgtggggctgggtccgcacgccgtcccggagggacgggctaggaatacgagttaggaagtcgtctcgtcagttaggtggtacggtttcctaagtttaccgacgttcccgtctcgtacgaagtacgtcgacgtccaacctatactcctcgtaggaccnccgtaccagacctaacgtcttacgttttcccagtaaagtnttcgtaacgttcttggtccgacccgtccgtgtacggaccggtacgggttacttttaatacggttgtacggacgtagaacgggtacccgtagtttattaggttacgttttaacggtttttacggggaggtttttacgggtttaaccgttttcccgggaaacccgtttacccggttaaacgggtaccgggttaacccgggggtaccccgggggtttacccttacccccggggtaaaccccccgggggttgggggggaaacccccggtaaaacgggggttaaacccgtttaccccggggtttacccggggtttaacccgttaacccccccgggtttttaccgtttaaccccccgggtttaaacccgggtccccccgtttaaaacccccccgggg

SEQ ID NO: 139593 - DNA, 690 bp, Homo sapiens
  misc_feature: GYAE6OF01DPEJG.46.67.G01.1.454.CMB.1.raw
  modified_base (225)..(225): a, c, t, g, unknown or other
  misc_feature (225)..(225): n is a, c, g, or t
  modified_base (363)..(363): a, c, t, g, unknown or other
  misc_feature (363)..(363): n is a, c, g, or t
  modified_base (384)..(384): a, c, t, g, unknown or other
  misc_feature (384)..(384): n is a, c, g, or t
  modified_base (439)..(439): a, c, t, g, unknown or other
  misc_feature (439)..(439): n is a, c, g, or t
  modified_base (446)..(446): a, c, t, g, unknown or other
  misc_feature (446)..(446): n is a, c, g, or t
  modified_base (456)..(456): a, c, t, g, unknown or other
  misc_feature (456)..(456): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaacgtgcaggaggtccgggcccacggactggtgacggccttcggacgccctcgtcccctcaccgtgccgtcttcgtctcgtggtcnccctcatacgagttgttggtttcttcggtgggtccgtcgggtccgcgacgccgtaccggaaggggacggctaggaatacgtagttaggaagttctctctacgtagtaggtcggtacgttctataccgtcgttcccgtnttacgtacgaagtcgtacgtntaccaacctattcgtcctgtacggacccactcgactacttactctttcgttaccnggaagtnttgtcttcgngtaccgccgcgtcgtacgtacgtacggttcgttacttacgtcggtacgacgtaggtaccggtacgtattagttagttggtttaagttttgggtagtttacggttaacctttaccggaaccttaccggtagtaccgggttacccgggaccggggtccctcccgggtacccggtgggaacccggtaagtacgtacggtccggttccctaccggttccctacgtccgcccctaacgg

SEQ ID NO: 139594 - DNA, 793 bp, Homo sapiens
  misc_feature: GYAE6OF01B8LQS.46.67.G01.1.454.CMB.1.raw
  modified_base (178)..(178): a, c, t, g, unknown or other
  misc_feature (178)..(178): n is a, c, g, or t
  modified_base (204)..(204): a, c, t, g, unknown or other
  misc_feature (204)..(204): n is a, c, g, or t
  modified_base (220)..(220): a, c, t, g, unknown or other
  misc_feature (220)..(220): n is a, c, g, or t
  modified_base (404)..(404): a, c, t, g, unknown or other
  misc_feature (404)..(404): n is a, c, g, or t
tcagactagcagtacacgaccggtgctcgatttagagtatacatattgggtttgtcctcctgctggtggcagctcccagatgggtcctgtccctggtgcaactgcaggacgtcgggcccacgactggtcgaggcctttcggagacccgtgtccctcacctgcgtactgtctctggtcncctacatcagttagtggtttctcggnggggtctggggtccgnacgcctccggaggggaacggggctaggtaactacgtagttacgggaagttcgtcttctcaagtacggtggtacgttacctagttacgacgttccgtcgtactacgaaggtacgttcggacgtacaccgtaatcgtctcgtacggaactccgtccagtactaacttcgttacgtttccgaagtanacgttgtacgttagcggtcgacccgtccgtcgtacggtaccgtaccggggtttaccttttaacggttactcggggttacgaccgggtaacgtaacgggtaccggttagttaagtttacgttaggtttaacggttttagggttacggtttaacggttttacgttaacccgtaccgtaacccgtacgtaacggtccggggtaccgggtccgttacccggtacccgggtaacgggacccggtaggtaaccggttaccgtcggtacccgttacccgttcgtaacccgttaccccgtaccgtaaccccgtaccgggaacccgccgttaaccgtccccgttacccctcccggtccgtaccccttacccgtcccgtaccgaacgtccggtacccgg

SEQ ID NO: 139595 - DNA, 689 bp, Homo sapiens
  misc_feature: GYAE6OF01DKVFA.46.67.G01.1.454.CMB.1.raw
  modified_base (177)..(177): a, c, t, g, unknown or other
  misc_feature (177)..(177): n is a, c, g, or t
  modified_base (200)..(200): a, c, t, g, unknown or other
  misc_feature (200)..(200): n is a, c, g, or t
  modified_base (213)..(214): a, c, t, g, unknown or other
  misc_feature (213)..(214): n is a, c, g, or t
  modified_base (257)..(257): a, c, t, g, unknown or other
  misc_feature (257)..(257): n is a, c, g, or t
  modified_base (327)..(327): a, c, t, g, unknown or other
  misc_feature (327)..(327): n is a, c, g, or t
tcagactagcagtacacgaccggtgctcgatttagagtatacatattgggtttgtcctcctgctggtggcagctcccagatgggtcctgtccctggtgcaactgcaggagtcgggccccagactggtgaggcccttcgggagacccctgtcccctcacctgccgctgtctctggtcncctccatcagtagtgtttctcgngggctgggtccgnngcctccgagggaaggggctaggaatacagttggagtgtctctnagtagtggagttcctattacgacgtcccgttactctacaaaggagtcgtagtccaccgattactcttacncggacctacgtcagacctatacgtacttttccagatatgtagttctgtacgaccgccgtcgtacgaaccggtcggggttacttttaacttcgtggttacggaccggtaaggacggtaccgggtatttaattacgtttaggtttagtttttaggtaggtttaggttttacgttaccgtaacctacccgtaagtacggtacgggtaccggggtccctacggaccccggtgggacccggtaagggtaacttacgtcggtaccgtccgttcgtccgttacgcccttaccgaacccgtaacgggtccctacggttcccgtcccgtttcccccgcgtcccctacccctcccacgtacgaccgtacccg

SEQ ID NO: 139596 - DNA, 735 bp, Homo sapiens
  misc_feature: GYAE6OF01EMPS6.46.67.G01.1.454.CMB.1.raw
  modified_base (194)..(194): a, c, t, g, unknown or other
  misc_feature (194)..(194): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtcctcatccctccctgtctgcaacggtggganacagtgtccacatccacgttcggccgggacaaggtcggaacagttcgactaaccttaatttaaagttggtactacaactataacgaccgagggaccggtaccctaagcctacctaatctatcgctgacactaccgtagtttagactaagggttcgggacctagtcggtagttcgaggttggcgtaggtggtattcggtagggactacggttatttccgacttcctacctaaccgaacttacgtaaagtttaactcgttacgaaccgtaacggttaacggtaagtttaactttacgtaccttaaactttacttaaccgttacgtaacgtaaactaagttaattaggtacgtttaaacggtttccgggttttaacggaacccggtaaagggtaacccgtaacgttaaacccgttaaaacgttaaaaacgttaaaaccggtaaacgttacgggtccggtaaccgttacgaacctaaccgttacttccgttacgttacccttacccgttacccgttaccctaccgttaacttccgtagttaaacc

SEQ ID NO: 139597 - DNA, 722 bp, Homo sapiens
  misc_feature: GYAE6OF01DRTZ9.46.67.G01.1.454.CMB.1.raw
  modified_base (227)..(227): a, c, t, g, unknown or other
  misc_feature (227)..(227): n is a, c, g, or t
  modified_base (440)..(440): a, c, t, g, unknown or other
  misc_feature (440)..(440): n is a, c, g, or t
  modified_base (494)..(494): a, c, t, g, unknown or other
  misc_feature (494)..(494): n is a, c, g, or t
  modified_base (605)..(605): a, c, t, g, unknown or other
  misc_feature (605)..(605): n is a, c, g, or t
  modified_base (659)..(659): a, c, t, g, unknown or other
  misc_feature (659)..(659): n is a, c, g, or t
  modified_base (713)..(713): a, c, t, g, unknown or other
  misc_feature (713)..(713): n is a, c, g, or t
tcagactagcagtacacgaccggtgctcgatttagagtatacatattgggtttggggagtctcggtcaggacacagcatggacatgacgggtccccgctcagcctccgtggggctcctgctactctggcctccggaggtcgccagtatgtagacatcgacgctcgacccagtcctcctactccctcctgtctcgaccaaccggtgggacgactaggttcgaccaccnctaccgtacgttcgggccggaactaacggtaccggaactagttcgaacctacttaaatttaagtagtactacaacgtagaacggaccggaagggacccggtaaccctaagcccttaactaacttactacgtcgtctacgactaacctccgtagttacggaacgtaacgggtcgggtaccctaggttaccgtaggtacagggtcgtagtaggtntacggtccggaggactacgtatttaccacgccttaacgactagtaccaaacgtntccggtagtaaccgaaggtttataaacgtttctttacgaaaccttaagttttacctagtacctaagtaaacttagtaaccgtttaaacgttcggttaacggttcgggtaanaaccgggtactaaacgttaactaaccgttaaaagttaccgtcgttacgacggtnacctaacgactttcgatccgtttaaccgtaaccgttacccacggtacgatttcnggttaaccc

SEQ ID NO: 139598 - DNA, 804 bp, Homo sapiens
  misc_feature: GYAE6OF01AG7CL.46.67.G01.1.454.CMB.1.raw
  modified_base (196)..(196): a, c, t, g, unknown or other
  misc_feature (196)..(196): n is a, c, g, or t
  modified_base (230)..(230): a, c, t, g, unknown or other
  misc_feature (230)..(230): n is a, c, g, or t
  modified_base (506)..(506): a, c, t, g, unknown or other
  misc_feature (506)..(506): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctcgacccagtctccatccctccctgtctgaccaacggtggganacgagtgtcaacctatcctacgttcggccggganaacggtacggaatgttacgaacctaacctttaagtttaaacgtttggtaacttaccgaactaagtaaccggtaacccgaacgggggacccggtacccctaaaggtcccttaccccgttaaagtctaacgttcgaccgtcggacctacttacgttaagtttacgacggttaaagggttccgggtaccctaagtcggtaagttcgaggtacggactagggtagacgttggacgggtaatagtacgtttcactcttaccaactacgtctaaacgttacnccgtagacgttaaacgtggtaaaccttagtttacgtaacctttaaatttcgttaacgttaccgtaactaacgttaacgtaactttacccttaagggttttaccggtttaaccgggaacggttaaaccggtacgtaaacggttaaaccttaaaacggttaaaacgttaaacgacggttaggtttacggcccttaaaggacgttaacctatttaaccgggttcctttaaacggttttccccgtttaacgttaccccgtttacccggtttaaccccgctttaaaccgggtgttaaacccgg

SEQ ID NO: 139599 - DNA, 785 bp, Homo sapiens
  misc_feature: GYAE6OF01AL9E8.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggacgacagtcgtacacctatccaccgttcggcccggggtacaaggtccggaaactatttcggaaccttaaccgttaaattttaaaacgttggtaactaccgaaacctagtaacgaaccgagggaccggaccctaagcctactaatccgtatcgctagtaccacttacgtaggtttagaaccggtaaaggttccgggtaacccaggttacgtaggtttaccaggtcggtaccaggttacggattaccgagggtaacaaggttactttaccgaaccttctacccgtaactacgttactaacgttaaatccgtacgaacgtaacgtagtaaacgtttactttacgaacttaaactttacgtacgttacgtaacctaaacgtaagttaacttacggaacgtttaagtttacccgggttttaaccgggaacccggtaaaccgggttaaccgtaaaccgtaaaacgtttaaaccgttaaaaacgttaaaacccggtaagttacggttaccgggtacttaaccgggaccttaacccgtagttccgttaccgttaacgttacctaccgtttaccccttacccgacctaccgttacgttaacgg

SEQ ID NO: 139600 - DNA, 695 bp, Homo sapiens
  misc_feature: GYAE6OF01C7OLV.46.67.G01.1.454.CMB.1.raw
  modified_base (286)..(286): a, c, t, g, unknown or other
  misc_feature (286)..(286): n is a, c, g, or t
  modified_base (290)..(290): a, c, t, g, unknown or other
  misc_feature (290)..(290): n is a, c, g, or t
  modified_base (351)..(351): a, c, t, g, unknown or other
  misc_feature (351)..(351): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagttggtttctcgtggggctgggtccgcagctcccgagggaggggctaggaatacagttggaagtgtctctacatagtggagttcctattacagtccgtctctnaagngtcgagtcaccatatctctgacacgtcagacaagtctacgtttcccagaacgatgacgttntagtcgaccgcccgctacgacgtacgggttacgtttattacgtgtcggacgagacggacgtcgttaattacgtagtttagttttaggtagttggttacgttacgttaccgtacctacgtacggtacggtaccggggaccggtccgtacccggtaccggggtaccggtacgggtaaacggtacggttacgttaccgggtacccgttccggttacccgttaccgtacccgtacccgacccggtaacccggtaacccggtacccggttaccggttcccccgtttacccccgtcccggttaccccgtaccccctaccccgtttaacccgaaccggtccgtaacccggg

SEQ ID NO: 139601 - DNA, 922 bp, Homo sapiens
  misc_feature: GYAE6OF01BF3S6.46.67.G01.1.454.CMB.1.raw
  modified_base (175)..(175): a, c, t, g, unknown or other
  misc_feature (175)..(175): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggacgaccctgtcccctcacctgcgctgtctctggtcncctcatcagtgttggtttctcgtgggtctcgggtccgcacgccgtaccggaggggacggggctaggaatacgagttaggaagttcgtcttctactagtaggtggtacggtttacctaagttacgtacgttccgtctcgtacgaaggtagtcgacgtacaacctatacgttcctcgtacggacctaccgtccaacgacctaattccgttaccgttttcccgaagaacgtagttacggtacgtttcgtacggtaccggaccccgtcccgtacggttacggtaaccgggttaccggggttttaccttttaacgtttaccggttacggtccgggtacggaacgggtaacggtaccggttatttaaggtttagttacgttttaggtttttaggggtaacggttttacggttttaaccgtttaccgtaaaccccgttaaccggtttaaggaacccggggtttaccccggggtaacccgggggttaccccttacccccggggtaacccggggttacccggggggaacccggtaaaggggttaacccgtttaccggttccgggtttaaccccggttacccgttacccgtttaccccggttacccgtacccccgtaaaccccggttaaacccgggaacccccggggttacccttaacccgggtttccccgggtttaccccccgttcccccgggttaccgaccccccctttaccccggttaccccaacccggtaaaccgtcccggtaaacccccggg

SEQ ID NO: 139602 - DNA, 841 bp, Homo sapiens
  misc_feature: GYAE6OF01D7LF8.46.67.G01.1.454.CMB.1.raw
  modified_base (178)..(178): a, c, t, g, unknown or other
  misc_feature (178)..(178): n is a, c, g, or t
  modified_base (201)..(201): a, c, t, g, unknown or other
  misc_feature (201)..(201): n is a, c, g, or t
  modified_base (214)..(214): a, c, t, g, unknown or other
  misc_feature (214)..(214): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggcccttcggacgacccctgtcccctacacctgcgctgtctctggtcncctcatcagtagttgtttctcgngggctgggtccgnacgcctccgaggggagggctaggaatacgtagttagggaagttcgtccttctatagttaggtggtacggttaccttatttaccgacgttcccgttcttacctacgaaagtacggtcgacggtaccaacctatacttccgttacgtacggaaccctaccgtacccgaagtacctaaacgttccttaccgtttttaccccgagaagtacgtagttacgtttcgttcggtaccgacccggtccgtacgtaccggtaaccgtaaccgggtttaaccgttttaacttacgttggtacggtacggaaggtacgggtacgttacgtttaagtttagtttagttttaacgggttttaggtttaaggtttacgggtttttaacctttacggtaacccgttaacccggttaaggtaccgggttaccggggtacccggggttaccccgtaccccgggtaccccgggtaccggggacccggtaaaggggtaccttaccgggttcggtacccgtacccgttccttacccgttaccgaccccttacccgaacccggtaacccggtccctaccggtttcccggttaccccctccccggtaccgtcccctaccccgttacccaacccgtagcccgtaccccgg

SEQ ID NO: 139603 - DNA, 628 bp, Homo sapiens
  misc_feature: GYAE6OF01C5ICE.46.67.G01.1.454.CMB.1.raw
  modified_base (381)..(381): a, c, t, g, unknown or other
  misc_feature (381)..(381): n is a, c, g, or t
  modified_base (419)..(419): a, c, t, g, unknown or other
  misc_feature (419)..(419): n is a, c, g, or t
  modified_base (439)..(439): a, c, t, g, unknown or other
  misc_feature (439)..(439): n is a, c, g, or t
  modified_base (447)..(447): a, c, t, g, unknown or other
  misc_feature (447)..(447): n is a, c, g, or t
  modified_base (451)..(451): a, c, t, g, unknown or other
  misc_feature (451)..(451): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtggagacagtgtcaccatcacttggccgggacaagtcggaactagttacgactaccttaattttaaacgttggtaactacgaaacaagtaacgacccgaagggacccggaccccttaagccttacctaatcctaatcggtctgctacgtccgtagtttcgaactaaggtcgggtcccagtcggaggttcaggtcgngaggtgatcggtggtacagtatttcacttctacactantacgtatcgcgaactaagtntaaagttntttnaacctactttattacctgtaaccaataacgttaattactaagtttaccggttcggaaccgaaggaccgtactaaacttaaacctaaaagttaccgaacgttagacgtacgtagacctaacgtagttccgtttcgactttaccgacttccccgttaccgtactaccttgtacgtaacc

SEQ ID NO: 139604 - DNA, 865 bp, Homo sapiens
  misc_feature: GYAE6OF01A8BMG.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtccgggcccacgactggtgaggccttcggagaccctgtccctcacctgcgctgtctctggtcgcctccatcgagtgttggtttctcgtggggctgggtccgcagcctccgagggacgggctaggaatacagttgggaattcgtctctacagttaggtggtacggttcctaattacgacgtccgtctctacgaagagtcgagtcaccatacttctcgtcggacctaccgtccagctaactcgtacgttttccccgagaacgtctagtaacgtttctacggtcgtaacccgcccggacgttacggaccggtaaccggggttacttttaacgtttacgtcggtcgggaccgtaagggtacggtacccgggtactttaagtttacgtttagggtttaaccgttttttaggggtaacgggttttaacggttttacgttttaaccggtaacccgttaacccgttaacggtaccggtacccggggtaaccggggggtcccttacccggggtaaccccccgggttcggggggtaaccccgtaacgggggttaaccgtttaaccggttaccgggtaccgttaaccccggtttccgttaaccccggtttacccgtaccccgttaaccccggaaacccggtacccggggtacccccgttaacccggttcccggtttcccccccgttacccccgggttaccggtaccccccgtaaccccccgtttaccccggtaaacccgtacccggtacccggttaaccccccggg

SEQ ID NO: 139605 - DNA, 821 bp, Homo sapiens
  misc_feature: GYAE6OF01D5M9V.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtccgggcccacgactgggtgagggtcccttacgggacgtacccctcgtcccctcacccgtgccgtcttcgttcctcgttggtcgtcccttaccatcgaaggttaggtttcggttttccttcggtgggggtccttcgggggtcccggcgacggtccgtacccggaaggggggaacgggtctaagggtaattaacgaggtttaggaacgttcgtctctacgaagttacggtggttacggttcctaagttacgtacgttccgtctcgtacgagtacgtcgtacgtacctaacgtatacgttccgtacgtacggtacctaccgtccgaagtactaacgttaccgttacgttttacccgaggtaacgtagtcggtaacgtttcgtcgtccgacccggtcgtacgtacggacggtacggttacgtttacgttacgtggtacggacgaggtacggtacggttctttaagttagtttaggtttaggttttagggtcgttttaggtttacgtaccgtaaccgtacgtaggtaccggtaccgggtcgggtaccctaccgggtcccggtacgggaacgtacggtacgtcgtccggtacctccgttacctaccgttaccgcccgtaacccgtaccggaacccggttccgtaccggtttccccgttccccgtaccccggtccgtaaccccttccccgtaccgtacgaaccggtcgtaccccggg

SEQ ID NO: 139606 - DNA, 618 bp, Homo sapiens
  misc_feature: GYAE6OF01AHAEK.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctcatcagtagtgtttctcgtggggctgggtccgcagctccgagggacgggctggaatacgattggaagtgtctctcagtagtggtagttcctattaccgagtccgtctctacaagtcgtcgagtccacatatcctcgtgacacgtcagtcaactctacgtttccagaagtatcgtagttcgtggtacgacccgtccgtacgtcggaaccggtacgggttactttttaacgttaccttggtacgtacggaggacggtacggtctttaagttacgttgtttaggtttttgggagtttagtttaacttcgaacctaccgtaagtcggtcgggtaccgggctccggacccggtgggaccctagggtaacttcggtcgtacctaccgtcctccgttacgtccccgtaccg

SEQ ID NO: 139607 - DNA, 858 bp, Homo sapiens
  misc_feature: GYAE6OF01D8STF.46.67.G01.1.454.CMB.1.raw
  modified_base (234)..(234): a, c, t, g, unknown or other
  misc_feature (234)..(234): n is a, c, g, or t
  modified_base (577)..(577): a, c, t, g, unknown or other
  misc_feature (577)..(577): n is a, c, g, or t
tcagactagcagtacacgaccggtgctcgatttagagtatacatattgggtttgggggacctcctgtgcaagaacatgaagcacctgtggtttgtcctcctgctggtggcagcctcccagatgggtcctgtcccgtggtgcaactgcgaggacgtccgggccccacgacgtgggtgacggtcctttcggacgtaccccttcgtcccctcaccgtgccgtctgtcctcgtggtcncctccatcgtagttgttcgtttctcggtggggtcgtcggggtccgctacggtccgtacccggaggggaacgggtcgtaggtaactacgtaggttagggaagttcgtcctactacgtagttacgggtaggttacggtttaccttacgttaccgtacggtttcccgttctacgtacgaagtcgtacgtacgtacctaacgtattacgttcctaccgttacggaactaccgtaccgacgtacctaacgtttccgtttaaccgttttacccgaagtaaagttacgttacggttacgtttcggtcgtacccgtacccggccgtcgtacggtaaccggttaccggtttnttttaacgtcgttcgggtacggaacggtacggacgttaccgtagttttaattaggtttcgttttaaggttttacgggtaggtttttacggtttaaccgtttacccggtaaccttaaccggttagggtacccggttaccggggtaccccggggtacccgttacccccgggtacccggggtacgggaacccggtaacgggttaaccgttcccgggttacccggttaccccgttacccggtttacccttaccccgggttacccgtcccccccggtaaacccggg

SEQ ID NO: 139608 - DNA, 716 bp, Homo sapiens
  misc_feature: GYAE6OF01E2RDL.46.67.G01.1.454.CMB.1.raw
  modified_base (198)..(198): a, c, t, g, unknown or other
  misc_feature (198)..(198): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatccctccctgtctgcaaccggtgggagacngtgtcaccatcacttcgccgggacaagtcggaacattgactaccttatttaaatgtatcaacatagaccgagggaccgaccctaagcctacctaatctatcgctcgctactccgtagtttcgacgtaaacggttcgggtaccctagtcgtaggttacaggtcggacgtagtggatcgtagggactagtacttacactctacacctatactaagttaactctacgacgtaacgttagtaagtttacttttacgaaccttaacgtttacttacgttacgttaacctaaacgtaagttaaactttaaccgttaaggttttaccggttttaaccgggaacccgttaaaacgggaaccctaaaccggttaaacccttaaaacgttaaaacgttaaacccgtaacgttacggtacggtaaccgtacgtaacccgtaacccttaagttcccgtttaggttacccctttaccgtaaccgtttcccccgtttaccccggtaacctttacgttcccgtagttaaaccg

SEQ ID NO: 139609 - DNA, 786 bp, Homo sapiens
  misc_feature: GYAE6OF01CNJWU.46.67.G01.1.454.CMB.1.raw
  modified_base (223)..(223): a, c, t, g, unknown or other
  misc_feature (223)..(223): n is a, c, g, or t
tcagactagcagtacacgaccggtgctcgatttagagtatacatattgggtttggggagtctcggtcaggacacagcatggacatgagggtccccgctcagctccgtggggctcctgctactctggctccgaggtgccagatgtgacatcgagctgacccagtctccatcctcctgtctgacaaccgtggagacaggtgtcaccatcgacttggaccgggtanaaaggtcggaaacatttcgaaccaccgttaattttaaagttggtaactacgaacatacgaaccagggaccgaccctaagactcctaatctaattgctgctactcctagtttcgataaaacggtcgggtacccaagtcgagtttacaggtcggctaaggtggactcgtgggaactaggtactttcaaccgttcctacaaccctataacggtaacttaaacgtcctacgtaccgtaaaccgttagtaaacgttaagttttttaacggaaaacttttattaacggttacgtaaaccgtaaaccgtaaagtaaaaccttttaaacggtaaacgttttcgggtttttaacccgggaaacgttaaaaccggggtaacccgtaaaacgggtaaccttaaaaccgtaaaaaacgttttaaaacccggtaactaacggggttaccggtaaacttcggtaaaccccgtaaccgttaaacgtttaccggtaccgtttaccgtttaacccttaaccgtttccccgtttaaccccgtaaccctaacgtttaccgttaaccggtaacgtttaaaccg

SEQ ID NO: 139610 - DNA, 989 bp, Homo sapiens
  misc_feature: GYAE6OF01AFOT1.46.67.G01.1.454.CMB.1.raw
  modified_base (219)..(219): a, c, t, g, unknown or other
  misc_feature (219)..(219): n is a, c, g, or t
tcagactagcagtacacgaccggtgctcgatttagagtatacatattgggtttgtcctcctgctggtggcagctccagatgggtcctgtccctggtcgcaactgcgaggagtcgggcccagacgtggtcgaggccttcgggacgacccctgtccctcacctgccgctgtctcgtggtcgcctcatcgaggttgtggtttctcgtggggtctgggtccgnacgccgtaccggaaggggtacggggtcctaggaaatacgagtttacgggaagttcgtaccttctacgaagttacgggtacgggttacgttttaccgttaacgttaccgtaccggttcccgttcttacgttaccgaaaggttccggttaccgaaccggttacctaacccctaagtttaccgttacccgttccggttaagggtaacccgttaaacccggttcccgaaggttaccctaaaccggtttccgttaaacccggtttttttccccggaagggtaaaacggttacgttcgggttaaccgttttaccggttacgggttcccgggtaaacccccgggtccgtcggtttaacccggtacgggtaaccggggttttttacttttaaaggttccgttcgggtacggtaccggaacggtaaccgggtaccggttacgttaagtttacggttaggtttaacgggtttttaggtacgggttttacggtttacccttttaccggaaccgttaacccggttacgtaccgggtttcccggggaaccggggttaccccttacccgggtaaccccggtgggggtaaacccggtacggggttaaacctttaccgggttaccgggttacccgtaaccccggttttccgtacccggtacccgttaccccggtaccgtaacgggttacccggaaccccgggtcttaccccgggttcccggttacccccgtttaccggtacccggttaccctaacccccgtccgttaaaccggacggttaccccgg

SEQ ID NO: 139611 - DNA, 731 bp, Homo sapiens
  misc_feature: GYAE6OF01A0YAP.46.67.G01.1.454.CMB.1.raw
  modified_base (216)..(216): a, c, t, g, unknown or other
  misc_feature (216)..(216): n is a, c, g, or t
  modified_base (262)..(262): a, c, t, g, unknown or other
  misc_feature (262)..(262): n is a, c, g, or t
  modified_base (359)..(359): a, c, t, g, unknown or other
  misc_feature (359)..(359): n is a, c, g, or t
  modified_base (431)..(431): a, c, t, g, unknown or other
  misc_feature (431)..(431): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgacggccttcggagtaccctgtcccctcacctgcgcctgtctctggtcnccctcatcgagttagttcggttttcttcgtggggctcgggtccggnacgccgtcccgaggggaaggggcctaggaatacagttacggaagttgtacttctcgaatagggtggtacggttccttaattaacgcgttccgtcttntacaaagcgtcggtactccaccattactctgtacggactaccgtcaagccaattccgtttacgttttacccnggaaacttgtaggtacgtttcgtggttacgacccggtaccgtctgggtaaaccgtcgggttacgtttttacttaaggtggtccggtacgacggaacggtaacggtctttaagtttagttagtttaggttttttacgggaagggtttttcggttttaaccgtttccgaacccgttacccgttaaggttcggttaacccgggggccgggtccccgtaccgggtaccccgggttcgggaccggtaaggggtaaccttaccgttggtccctaccgttcgttccctaccggtcccctaaacccgg

SEQ ID NO: 139612 - DNA, 664 bp, Homo sapiens
  misc_feature: GYAE6OF01BA5MH.46.67.G01.1.454.CMB.1.raw
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacgttcggccgggcaaggtcggaactattgactaccttatttaaatggtatacaacatagaccagggaccgccctaagctcctaatctatgctgcactcctagtttcgacgtaaaggtcgggtacccagtacggaggtttacaggtggctaggtggatcgtagggactagtactttcacttctaccacctatacgtaagttatcgtagacgtaacgtagtaagttagttttacgacttaaactttacgttaaccttacggtaacctaaacgtaagtaaactttaacgtaaacgtttcgggttttaccggaaccgtaaacggggaacctaaccggtaaacttaaacgtaaaacgttaaaccgtaacgttacggtacggtacgtaccgacctaaccgtacttacgttcgttaccttactacctttacccgttaccccgacttactccgttagtaaccg

SEQ ID NO: 139613 - DNA, 666 bp, Homo sapiens
  misc_feature: GYAE6OF01B9CE4.46.67.G01.1.454.CMB.1.raw
  modified_base (204)..(204): a, c, t, g, unknown or other
  misc_feature (204)..(204): n is a, c, g, or t
  modified_base (217)..(217): a, c, t, g, unknown or other
  misc_feature (217)..(217): n is a, c, g, or t
  modified_base (232)..(232): a, c, t, g, unknown or other
  misc_feature (232)..(232): n is a, c, g, or t
  modified_base (435)..(435): a, c, t, g, unknown or other
  misc_feature (435)..(435): n is a, c, g, or t
  modified_base (451)..(451): a, c, t, g, unknown or other
  misc_feature (451)..(451): n is a, c, g, or t
  modified_base (622)..(622): a, c, t, g, unknown or other
  misc_feature (622)..(622): n is a, c, g, or t
  modified_base (631)..(631): a, c, t, g, unknown or other
  misc_feature (631)..(631): n is a, c, g, or t
tcagactagcagtacacgaccggtgctcgatttagagtatacatattgggtttggggagtctcggtcaggacacagcatggacatgagggtccccgctcagctccgtggggctcctgctactctggctccgaggtgccagtatgtgacatcgagctcgaccctagtcctccatccctccctgtcctgccgtaaccggtgggacnctagtcgccaccntcacgttcgccgganaaggtacggaactagtacgacctacttatttaaatcgtatacaactacgtacgaccgacgggtccgaccgtaacgccttcctaagttctagtcgtcgtacgactactcgtagttcgacgtaacggtcgggtaccaggttacgaggttcaggttcggctaggtcggtactggtaggaactacgttcttacgacctactaccgtntaagtactagttaacncgtactacggaacgtcgttaaggttacttagtaacttacgttattacgtactacgaaacgttataaaccttagttaagtttacccgttaacgggaaccgtaaggtaccgtaccgtaaacttaaactaacttaacggaccttgaccggtactacgacctacgttactacgtnttacccgtntacccgttacctcccgtaatcgttaaccgtgtacc

SEQ ID NO: 139614 - DNA, 753 bp, Homo sapiens
  misc_feature: GYAE6OF01DAIR9.46.67.G01.1.454.CMB.1.raw
tcagactagcagtacacgaccggtgctcgatttagagtatacatattgggtttgggggagtctcggtcaggacacagcatggacatgagggtccccgctcagctcctgggggctcctgctactctggctccggaggtgccagatgtgacatcgagctgacccagtctccatccctcctgtctgcgaaccggtgggacacagtcgtaccaacctatccacgttcggcccgggactaacggtaccggaaactagtttacgaacctaaacctttattttaaaagttggttaactacaaactaagtacgaaccgacggggacccggtaccctaagtaccttacctaacttctagtcgctacgacctacgttcctaaggtttcgaacgtaaacggggtccgggtaccctagttacggtacggtttacgacgggtcggagtaacgggttaggtacgttaccggtagggaacctaagttactttaccgacttcctaccaactacgtacgtaagttacttacgtagaaccgttaacggtagtaagtttacttacgtaacttaacttttactactacgtacaaagtacgttaacttaattacgtttacgttaccggaaccggtaacgggtaactaaccgttaactaaaaccgttaaaagttaccggaacgttcggtacggtacctcggaacccctaacgttactacgttcgttaccttacacccgtttccccgttaccccgtattaacgtcgttaacttacg

SEQ ID NO: 139615 - DNA, 810 bp, Homo sapiens
  misc_feature: GYAE6OF01C1656.46.67.G01.1.454.CMB.1.raw
  modified_base (175)..(175): a, c, t, g, unknown or other
  misc_feature (175)..(175): n is a, c, g, or t
  modified_base (216)..(216): a, c, t, g, unknown or other
  misc_feature (216)..(216): n is a, c, g, or t
  modified_base (268)..(268): a, c, t, g, unknown or other
  misc_feature (268)..(268): n is a, c, g, or t
tcagactagcagtacacgaccggtgctcgatttagagtatacatattgggtttgtcctcctgctggtggcagctcccagatgggtcctgtccctggtgcaactgcagggagtcgggccacgactgggtgaggccttcggacgacccctgtccctcacctgcgctgtctcgtggtncctccatcagttagtcggtttctcgtggggctcgggtccgnacgccgtccggaggggaacgggctaggaatagtagtagggaagtgtctctanagttaggtggtaggttacctattacgcgtccgtctctacgaagacgtcgacgtcaacctatactccttcgcggaactaccgtaccgagtacctaaacgtccgtttacgttttaccccgaggtaaacgtacgttaggtaagtttccgtaggttaccgacccggtaccgtccggtaggtacccggtaacggggtttacttttaaacgtttccgttagggttacggacggtaggaacggtacgggttacttaagttagttagtttagttttagggtacggtttaggttttacgttacgtaacctaccgtagtaccggtcggtacgggggtccctaccggttaccccgggacggggtaccgtaacgggttaacgtaccggttacggtacccgtacccgttaccgttacccgttaccggcccccttaacccgaacccgggtaaccggtccccgtacccgggtttccccggttacccccgttaccccgttaccccgggaccccttacccccgttaccccgttaaccccgaaacgtcggtaacccccgg

SEQ ID NO: 139616 - DNA, 797 bp, Homo sapiens
  misc_feature: GYAE6OF01ELZVX.46.67.G01.1.454.CMB.1.raw
  modified_base (193)..(193): a, c, t, g, unknown or other
  misc_feature (193)..(193): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtcctccactcctccctgtctgcaccggtggganacagtgtcacctatcacgttcggccgggacaacggtaccggaactattagaacctaacctttaattttaaagttggtaatacaaactagtaacggaccgtacggggaccgtaccctaagtccttacctaattctagtcgtcctagactactaccgtagtttacggaccgtaagggttcgggtaccctagtccggtacgggttcgacggtggtacgtaggtacggtattacggtagggtaactaggtactttaccgaccttacgtacctaaccgtacttacgtaagttaacgttcctacggtaaaccgtaacggttaagttaagtttacgtttacgtaacctttaaacgttttacttaaccgttacgtaaaccgtaaacgttaaacgtttaaactttaaccgtttaacgttttaccgggttacccgggtaaccgggtaaacgggtaacccgtaaaccggttaaaccttaaaacgttaaaaccgttaaaccggttaacgtttcggggaaccggttataacccggaccctaaccgttattacgtttccgttacctttacccgtacctttccccgttaacccgtacttacgttaccgttagttaaccg

SEQ ID NO: 139617 - DNA, 698 bp, Homo sapiens
  misc_feature: GYAE6OF01BBBSS.46.67.G01.1.454.CMB.1.raw
  modified_base (294)..(294): a, c, t, g, unknown or other
  misc_feature (294)..(294): n is a, c, g, or t
  modified_base (352)..(352): a, c, t, g, unknown or other
  misc_feature (352)..(352): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactgggtgaggccttcggagaccctgtccctcacctgcgctgtctctggtgcctccatcagtagtggtttctcgtggggctgggtccgcagcctcccgaggggagggctaggaatacattggaagttgtctctcagtagtggtaggttcctattacagtccgtctctacaagngtcgagtccacctatactctctggactacgtccagcaatctacgttttcccagaagtntcgtagttctggtcgacccgccgcgtgaccgtacgggttcttttaagtaccgtggtagacggaggacggtacggtcttaagtttacgttagtttaaggtttttgggaaggttttaggtttacgtttaccgtaaccgtacccgtaaggtaccgtacggggtaccgggggtcctaccgggtaccccggtcggggaacccgtaggggtaacttacggtacggttccgacccggttccgtccgttaccgtcccgtacccgacccgtaacgggccccctacggttccccggttccccttcccccggccgtaccctacccccgttaccctaacccgacgtaccgtaccccgg

SEQ ID NO: 139618 - DNA, 643 bp, Homo sapiens
  misc_feature: GYAE6OF01A6J99.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctcatcagtagtggtttcttcgtggggctgggtccgcagctccgagggagggctggaatcattggatgtctctcatagtggaggttcctattacagtccgtctctcaagtagtcgagtcacctatactctctgacacgtccagcaatctacgttttccagtaagtctgtagttctggtcgaccgccgctagaccgtacgggtcttttatacgttggcgtacgaggtacgacggtctattagtgttaagttttgggagtttggttactttacgaccgtaccgtaggtacgtacgggtaccgggggtcctacccgggtaccccggttaggggccggtaaacggggtacttacggtcggtaccgtacccgttctacccgttacgtccctacccgtaacccgaacgggtccctacgtcccggttccccttccccggtcggtccctaccgtacccttcccgtacccgtagtacccg

SEQ ID NO: 139619 - DNA, 767 bp, Homo sapiens
  misc_feature: GYAE6OF01EBD67.46.67.G01.1.454.CMB.1.raw
  modified_base (191)..(191): a, c, t, g, unknown or other
  misc_feature (191)..(191): n is a, c, g, or t
  modified_base (227)..(227): a, c, t, g, unknown or other
  misc_feature (227)..(227): n is a, c, g, or t
tcagactagcagtacacgaccggtgctcgatttagagtatacatattgggtttggggagtctcggtcaggacacagcatggacatgagggtcccgctcagctcctggggctcctgctactctggctccgaggtgccagatgtgacatcgagctgacccagtctccactcctcctgtctgcacgtggagacngtgtcactatcacgttcgaccggcaagtccgaactnttacgactaacttaattaaagttgtactacgaaacagtaacgaccgaacggggtaccgtaaccctaagtaccttacgtaaattccgtaatggcttcggacctacgtaccgttaaggtttcggaaccgtaaacgggttccgggtaccctaagtccggttaaggttacgagggtacggtaccgtagggttacgtacgttccggtaggaacttaacggttactttacccgtacctactccaaacctacgttaacgtaacgttacgtacgtacgaacgtaacggttagttaaacgttcgtttaacggaacttaacctttattaccgtacgtaacgtaaacgtacgtaaacgtttaacctacggtttaacgttaccggtaaacggtaaacggaacttaaccgggtaaaactaaaccgttaaaagtaaccgttaacggttgtaaaggttccctaacgaccttaaacccgtattttcccgtcggtttaaacttcccggttaaccttcccggttaaccccctaggtaaccctttgcgtttaaaacccg

SEQ ID NO: 139620 - DNA, 693 bp, Homo sapiens
  misc_feature: GYAE6OF01EI0QM.46.67.G01.1.454.CMB.1.raw
  modified_base (422)..(422): a, c, t, g, unknown or other
  misc_feature (422)..(422): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccactcctcctgtctgacaaccggtgggacacgtagtgtccaccgatcacttcggccggacaaggtcggaactagttcgactaccttaatttaagttgtactacaacgagtaacgaccgagggtacccgaccctaagcctacctaatcctatcgcgtgactactccgttagttagacgtaaggtcgggtacccagtcgtaggttcagtggtcaggtgacttcggtacgggactaagttacttcgtactctacacctanacgtagtaactcgaacgtactaacgtagttaacgttatttaaccgactttaaccgtttattaccgtagtaaacccgtaagtaacgtttaaagttaccgttaaggtttaccggttaacggaaccggtaacgaacccgtaaacctaaacgttaaactaaacggtaacggtacgtcggttaccgaccggttaacaacccgttacgtcctttccgtaacggttcccttaggtaaccccttcccgttaccccgacttacgttacccgtataaccgg

SEQ ID NO: 139621 - DNA, 643 bp, Homo sapiens
  misc_feature: GYAE6OF01AX8X2.46.67.G01.1.454.CMB.1.raw
  modified_base (226)..(226): a, c, t, g, unknown or other
  misc_feature (226)..(226): n is a, c, g, or t
  modified_base (427)..(427): a, c, t, g, unknown or other
  misc_feature (427)..(427): n is a, c, g, or t
tcagactagcagtacacgaccggtgctcgatttagagtatacatattgggtttgggggagtctcggtcaggacacagcatggacatgagggtccccgctcagctcctgggggctcctgctactctggctccgaggtgccagatgtgacatcgagctgacccagtcctccatccctccctgtctgcaaccggtgggacgacagtgtccaccatcacttggccggganaacggtccggaaacagtttacgaacctaaccttaattttaaaagttggtaactacaactatacgaccgaaggggtaccgaccctaagctacctaatctatggctgctatccagtttgactaaggtcgggtccagtcggaggttacaggtgacagtggatcggaggactagtattccactctacactatctagtaactcganacgtagtagtaagttacgtttcaccttaacttaacttacgtacgttaaccaaagtagtaaactttaactaaggtttacggttttaccggaaccgtaaacggaactaacgtaaacttaaacgttaaaacgtaacgtaaacgtgtaccgtacgtacgaacctactacttcgtcgttacccttactacttaccccttccgaccttacttcgtacgtaac

SEQ ID NO: 139622 - DNA, 751 bp, Homo sapiens
  misc_feature: GYAE6OF01DFFXC.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtctccatcctcctgtctgcacggtggagacagtgcacatctacttcggccgggacaacggtccggaactagttacgacctaaccttaattttaaagttggtaactacaacagtaacggaccgacgggaccgtaccctaagtcctactaatctagtgctcgactactaccgtaggttcgacgtaagggttccgggtaccagtcggtacggttcgagggtggacgtaggtggtactcggtagggaactagtactttaccgacttaccgtacctaacctagtacgtaacgttaacttccgtacggtaacgttaacgggtaagtttaaacgtttacgttttaacgtaacctttaaaaccgtttttagttaacccgttacgtaaaccgtaaaccgttaagtttaaacctttaacggtttaaacgttttcggttaaccgggaaccgtaaacgggtacctaaccgttaaacttaaaacttaaaacggttaaacggaacttacgggtacgtaccgtacgtaaccgtaccttacggttcttaccgtttacttacccgttacctttcccgttacccgactttaatccgttaacgttacg

SEQ ID NO: 139623 - DNA, 828 bp, Homo sapiens
  misc_feature: GYAE6OF01CBAIJ.46.67.G01.1.454.CMB.1.raw
  modified_base (194)..(194): a, c, t, g, unknown or other
  misc_feature (194)..(194): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtctccatccctcctgtctgcaaccggtggganacgtagtcgtaccaccatcaacgttcggacccgggactaaacggtaccggaactagttacgaacctaacctttaattttaaaagttggttaataccaaactaagtaacggaacccgaacggggtaacccggaccctaaggccttaccgtaattctatagtccgtgacctacgtaccgttaggtttacgaacgtaaaacgggttccggggtacccctaaggttccgggttaacggtttaccgacgggttacggacgtaacgggttacggaagttaccggtaacggggtaactaacggttacgttttaccacccttacctaaccctaacctaacgtacgtaacgttaaaccttcgtacggtaaccgtaacggttaaggtaaactttacgtttacgaaccgtttaaacttttagttaaccttaagtaaccgtaaaacgtaagttaaacgtttaagtaacggtttacgttttaacccgggaacgtaaacggaaccgtaacgtaaaccttaaaacttaaacggttaaacctaacggttacggtaccggtaacctacggaacctaccgttagttaccgtttgttacccttacgtaacccgtttccctaccccgtaaccttacttacgttaaccgttaccg

SEQ ID NO: 139624 - DNA, 803 bp, Homo sapiens
  misc_feature: GYAE6OF01EFDC7.46.67.G01.1.454.CMB.1.raw
tcagactagcagtacacgaccggtgctcgatttagagtatacatattgggtttgtcctcctgctggtggcagctcccagatgggtcctgtccctggtgcaactgcgaggagtccgggcccacgacgtggtgacgggtccttcgggacgtaccctcgtccctcaccgtgccgctgtctcgtggtcgcctcatctagttagttcggtttctcggtgggcgtcgggtccgcacgccgtaccggaaggggacgggctaggaacttacgtagttaggtaagtcttccgttacgtacgtaaggttaggtcgggttaacggtttaccttaagttaccgtacggttcccgttctaccgtacgtaaggtcgtacggtacgtacccaacgtacttacgtcctcggtacggaccgtaccgtaccagtactaacttcgtttaccgtttccgaagtaacgtagtacgtacgttcgtcgtaacgcccgtcgtacgtcggtaacggtaccgggtttactttactacggtggtacggacggtaaggtacgtacggttatttaacgttagtttagtttaggtttagggtacggtttagtttaccgttaccgtacctaaccggttaggtaccggtccggggtaaccgggtcgtaccccggtaccgggtacccggggtaacgtaaggttacccggttacgtccgtacccgtaccgttccgttaccgtacgtaccccctagggaacccgtaccggtccgttaacccggttcccgtcccggttccccgaccggtccctacccgtacctaaccgcgcgtacccgg

SEQ ID NO: 139625 - DNA, 542 bp, Homo sapiens
  misc_feature: GYAE6OF01EY5RB.46.67.G01.1.454.CMB.1.raw
  modified_base (193)..(193): a, c, t, g, unknown or other
  misc_feature (193)..(193): n is a, c, g, or t
  modified_base (229)..(229): a, c, t, g, unknown or other
  misc_feature (229)..(229): n is a, c, g, or t
  modified_base (428)..(428): a, c, t, g, unknown or other
  misc_feature (428)..(428): n is a, c, g, or t
  modified_base (532)..(532): a, c, t, g, unknown or other
  misc_feature (532)..(532): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgtcaccatcacttgccgggacaagtcgaacnttgatactatttaaattgtatcaacatagaccagggacgaccctaagctcctaatctatcggctgcactcctagtttgacgtaaacggtcgggtccctaagtccggtaggttcgtaggtggacaggtcggatccgtgggatagtatttcactctacactatcataatctgacatagagttatttagactaattacttanagtacaagataattacagttgttacgaactaaggactacgtaacttaacaaataacgtactggtagctagactacattactgtacttcacttccctacctactntccgtgtacc

SEQ ID NO: 139626 - DNA, 801 bp, Homo sapiens
  misc_feature: GYAE6OF01CUVU7.46.67.G01.1.454.CMB.1.raw
  modified_base (181)..(181): a, c, t, g, unknown or other
  misc_feature (181)..(181): n is a, c, g, or t
tcagactagcagtacacgaccggtgctcgatttagagtatacatattgggtttgtcctcctgctggtggcagctcccagatgggtcctgtccctggtgcaactgcagggagtccgggcccacggactgggtgacggccttcgggacgccctgtcccctcacctgcgtctgtctcgtggtcncctcagtcagttgttggtttcctcggtggggctcggggtccgcacgtccgtcccggaagggggtaacggggctagggaaactacgtaggttaggaagttcgtctcgtcaagttggtaggtacggttaccttacgttacgtacggttccctctcgtacaagacggtcgacgtcaaccgatactctacgtgaccaccgtccagtactaattactcgtttaccaagaacgtattcgtagtttacgtcggtacgacccgcccggtacgtcggtaacccggtacggggtttacgttttacgttaacgtcggttacgggacgtaaggtacggtaccggttaatttaacgtttaggttaagttttcgggttttaggttaaggtttggtttaacttaccggtaaccgtaacccgtaggtaccgtacggggtaccggggtaccgtacccgggacccgtacgggggaccgtaacggggtactaccggtcggtaccgtccgtaccgttccgtaccgtccctacccgtaaccggacccgggtacctttacccgtccggggtttacccccttcccccggttcggtaaccccctaccccgttacccgtaacccggtaacgtaccggtaccccgg

SEQ ID NO: 139627 - DNA, 666 bp, Homo sapiens
  misc_feature: GYAE6OF01ANJMA.46.67.G01.1.454.CMB.1.raw
  modified_base (229)..(229): a, c, t, g, unknown or other
  misc_feature (229)..(229): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctcctgtctgcaaccgtgggagacagtgtacaccatcacttggccggcaagtcggaacnttgacacttattaaatgtatacaacatacgaccgaggaccgccctaagcctactaagtctatcgctgctactcctaggttacgacgtaaggtcgggtccctagtcggtaggttcaggtggcgtaggtcggtagtcgtaggactagtacttacactacgtactaaccgtattacgtaagttaacttcgtacggtactaagtttacggaaagtttactttacggaacctttaacgtttacttttaaccgtaggttaaaccctaaacgtaagttaaactttaacgtaagttttaccgggtttacccggaaacggtaaacgggaccttaaacggtaaccttaaactaaacgttaaacgaccgttagtaccgtcgacgtaccgtacttatccgttacttaccttacctaccgttcccttacccctatacttcgtagttaacc

SEQ ID NO: 139628 - DNA, 716 bp, Homo sapiens
  misc_feature: GYAE6OF01D0KO7.46.67.G01.1.454.CMB.1.raw
  modified_base (154)..(154): a, c, t, g, unknown or other
  misc_feature (154)..(154): n is a, c, g, or t
  modified_base (207)..(207): a, c, t, g, unknown or other
  misc_feature (207)..(207): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggccttcggagaccctgtcccctnacctgcgctgtctctgtcgcctcatcgagtagtgttctcgtgggctgggccgnagcctccgagggacgggctaggaactacagttgggaatgtactcgtcagtagtggagttaccgtatacgacgtccgtctctacgaagagtacgcgacacctatatcgtcgtaggaccacgtcgacgtactaacgtactacgttttacccgagaagtacgtagtacgttcgtagtccggtaccgcccggtacgtacgtacggtacgggttacgtttaacgttcgtacgtagccggaagacggtaccggtacttagttagttaggtttagtttagggtacgtaggtttaacgttctaacccgtaccgtagtaccggtacgggtacggggtcctaccgggacccgttggggaccgtaaggggtactttaaccgggcgttaccgcccgtttctacccggttaacgtcccttaacccgaacccggtaaccggggtaccccacggttccctacccccggttacccccgtcggtacccctaacccccgttacccgaaccaacgggtcccgtaccgg

SEQ ID NO: 139629 - DNA, 943 bp, Homo sapiens
  misc_feature: GYAE6OF01EQ3E0.46.67.G01.1.454.CMB.1.raw
tcagactagcagtacacgaccggtgctcgatttagagtatacatattgggtttgggggacctcctgtgcaagaacatgaagcacctgtggtttgtcctcctgcgtggtggccagcctcccagatgggtcctgtccctggtgcaactgcagggtacggccgggcccacgacgtgggtgaggtccgttcggacgtacccttcgtccctcaccctggccgctgtccgtgtcggtctccctccagttcaggtttggttcggttttccttcgggtcgggggtcgttcgggggtccccgcgacggtcccgtacccgggaggggggtaacggggtcctaagggtaactaacgttaggttggaagtcgttctcctagtagttaggtcggtacggtttcctttaagtccgtaccggttcccgttcctacgtaccgtaaaggtcggtaccgtacgttaccccaaacccgtagtttaaccttcccgtaccggttacgggtaaccccgtacccggtaaacccgtacggtaaaccctaaaccggttttcccgttttaaacccggtttttacccggtaaaaggttaaagggtaccgttttacgggttaacggttttccgtaccgggttcccgtaaccccgggttcccggtaacgttccggggaacccggttaccgggttttacgtttttaagtttacccggttaggtaccgggtaacggtacgggtaacccggttacggttacttttaaagtttcggtttaggttttaacgggtttttggtaacggttttacggttttacccgtacgttaacccgacccgggtttaaagcccgggtccggggtacgggtcccccgttacgggtcccccggagggggaacccggtaacggtaccggtttaccgcccgggttcccttacccggttaccctttaacccgttccccgacccgtaaccccgg

SEQ ID NO: 139630 - DNA, 770 bp, Homo sapiens
  misc_feature: GYAE6OF01AQ7UF.46.67.G01.1.454.CMB.1.raw
  modified_base (212)..(212): a, c, t, g, unknown or other
  misc_feature (212)..(212): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgactgggtgaggccttggagaccctgtccctcacctgcgctgtctctggtncctcatcagtgtggtttctcgtggggctgggtccgcagccgtacccgaggggtaagggctggaatactagttggaagtgtactctctagtagtggtacggttcctattaccgagttccgtctctcaagtcgtcgagtccaacatactctcgtcggactacgtcaggtacaacttcgtacgtttttcccaaggtaacgtagttacggtacgtttcgttacggtacggaaccccggtccggtacgttacggtaaccggttaccggggttccgtttttaaacgttaccgttcgggttacggaccgggtaacggtaacgggtaaccggttaccgtttaagtttaaggtttacggtttaacggtttttttaggggacgttttacgggttttaatttacccgggtaacctaacccgggttaaggtaacgttccgggggtaacccgggggttccttaacccgggtacccccgggttagggggaaccccgttaaggggtaaccttaccgggttacggtaccgttacccgttacccgtttacccgttacggtccccttaaccccggg

SEQ ID NO: 139631 - DNA, 681 bp, Homo sapiens
  misc_feature: GYAE6OF01C02RJ.46.67.G01.1.454.CMB.1.raw
  modified_base (542)..(542): a, c, t, g, unknown or other
  misc_feature (542)..(542): n is a, c, g, or t
  modified_base (587)..(587): a, c, t, g, unknown or other
  misc_feature (587)..(587): n is a, c, g, or t
tcagactagcagtacacgaccggtgctcgatttagagtatacatattgggtttgggggacctcctgtgcaagaacatgaagcacctgtggtttgtcctctgctggtggcagctcccagatgggtcctgtccctggtgacaactgcaggagtccgggcccacgactggtgacggtccttcggagccctgtcccctcaccgtgcgctcgtctcgtggctcctccagtcagttaggttggttttctcggtggggcttcggggtccgcagcctaccggaggggaacggggtctagggaactacgagtttaggaagtcggtctctcgagttagtacggtacgttacctacgttacacgttccggtcttctacgaaagtcgtacgtacgtactaacctattactctcgtacggacctacgtacaacggctaactactttacgtttttacccgagtaaacgttagtagtacgtttcgttagaccggttaccgccgtcctacggtacgtacgggttagtttacgttcgtcgttgaccgagtgaaccggtnttactatgttagtttgtaggtttgttacgttctaaccttcgtacncggttacgggacgggtcctaccggccggttcggggcgtaaaggaccggttcgacggttacgtacccgttacgttaccgtacgccccgtacccgg

SEQ ID NO: 139632 - DNA, 727 bp, Homo sapiens
  misc_feature: GYAE6OF01B5N4M.46.67.G01.1.454.CMB.1.raw
  modified_base (194)..(194): a, c, t, g, unknown or other
  misc_feature (194)..(194): n is a, c, g, or t
tcagactagcagtacacgaccggtgctcgatttagagtatacatattgggtttggggagtctcggtcaggacacagcatggacatgagggtccccgctcagctcctggggctcctgctactctggactccgaggtgccagatgtgacatcgagctgacccagtctccatcctccctgtctgcaaccggtggganacagtcgcaccatcacgttggccgggtacaacggtacggaactattacgaacctaacctttaatttaaacgttggtaactacaaacaagtaacgaccgaagggacccgtaccctaagccttacctaatacctatgcttacgcgtactcccgtagtttacgacgtaaaggtcgggtaccagttcgtacggttcgaaggtcggactagggtgacgttcggtaggggtaactaggtaactttacgaccttccgtacaactacgtacgtaaaggtttaactccgtaaggtaaccgtaaacgttaaggtaaaacgtttaagttttacggaaactttaaacgtttaactttaaccgttagtaacctaaactaaagtaaacttaaacgttaacgtttcggtttaaccgggaaccgaaacggggtaactaaccgtaaacttaaaccaaagttaaaccgtacgtaggttcggactacggactaacctagtaccttagtcttaacctaccgttaccttacccgacctacttccgtaggtaacc

SEQ ID NO: 139633 - DNA, 732 bp, Homo sapiens
  misc_feature: GYAE6OF01C3A3R.46.67.G01.1.454.CMB.1.raw
  modified_base (198)..(198): a, c, t, g, unknown or other
  misc_feature (198)..(198): n is a, c, g, or t
  modified_base (201)..(201): a, c, t, g, unknown or other
  misc_feature (201)..(201): n is a, c, g, or t
  modified_base (244)..(244): a, c, t, g, unknown or other
  misc_feature (244)..(244): n is a, c, g, or t
  modified_base (713)..(713): a, c, t, g, unknown or other
  misc_feature (713)..(713): n is a, c, g, or t
tcagactagcagtacacgaccggtgctcgatttagagtatacatattgggtttgggggagtctcggtcaggacacagcatggacatgagggtccccgctcagctcctgggggctcctgctactctggctccggaggtgccagatgtgacatcgagctcgacccagtcctccactccctcctgtctgcaccggtggganacngtcgccacatctacgttcggccgggacaaggtaccggaaactnttacgaactaaccttaatttaaatggtaatacaaactaacgtacgaaccgacggggacccgaccctaagcctactaactcctatcgctgacctacttcccgtaggtttacgaacgtaacgggtaccgggtacctagtcggtagttcgaggtggcgtaggtcgtagtcggtaggaacgtacgtactttcacttctacctaacgtactacgtaagttaacgttcgtacggtaacgtaacggttaacggtaagtttacgttttacgtaaacctttaacgtttaacttaacgttaccgttaacctaaagttaaacgttaaacgtttaacgtttaaggttttccgggtttaaaccgtaaccggtaaagggtacctaacgttaaacgtaaacgttaaaccgttaacgtaacgttcgggtacgtacgtacggacctactagttaccgttcgtaccttacctcttacccggttaccncttaacgtctacggtaacg

SEQ ID NO: 139634 - DNA, 624 bp, Homo sapiens
  misc_feature: GYAE6OF01EDJ06.46.67.G01.1.454.CMB.1.raw
  modified_base (192)..(192): a, c, t, g, unknown or other
  misc_feature (192)..(192): n is a, c, g, or t
  modified_base (437)..(437): a, c, t, g, unknown or other
  misc_feature (437)..(437): n is a, c, g, or t
  modified_base (587)..(587): a, c, t, g, unknown or other
  misc_feature (587)..(587): n is a, c, g, or t
  modified_base (598)..(598): a, c, t, g, unknown or other
  misc_feature (598)..(598): n is a, c, g, or t
  modified_base (611)..(611): a, c, t, g, unknown or other
  misc_feature (611)..(611): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctcgacccagtctccatcctccctgtctgcaaccgtgganacagtcgcaccatcacttcgccgggcaagtcggaactatcgactaccttaatttaaatggtatacaactatacgaccgagggaccgaccctaagcctacctaatcttatcgctcgctactccgtagtttgacgtaaaggtcgggtacccagttcgtaggtctaaggtcggactagtggtacgtcgtagggactaagtacttactactctaccactatactaatatctacgacaagtagtaagttntttacgacttaacgttactttacgtacgtacaaacgtagttaacttaattaagttcgttacggaacgtaacggaacctaacgtaactaaactaaacgttaaacggacgttggacggtctagacccgtactacttcttaccgtaccttacncgtttaccccncccggttaacctnttccgtgtaaccg

SEQ ID NO: 139635 - DNA, 807 bp, Homo sapiens
  misc_feature: GYAE6OF01EPDO8.46.67.G01.1.454.CMB.1.raw
  modified_base (228)..(228): a, c, t, g, unknown or other
  misc_feature (228)..(228): n is a, c, g, or t
  modified_base (254)..(254): a, c, t, g, unknown or other
  misc_feature (254)..(254): n is a, c, g, or t
  modified_base (269)..(269): a, c, t, g, unknown or other
  misc_feature (269)..(269): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcgaggaggtccgggcccacgactgggtgacggtccttcgggacgtacccttgtcccctacaccgtgccgtctgtctcgtggtcncctcatcgagttgttcgtttctcggngggtctcgggtccgnacgccgtaccggaggggacgggtcgtaggaatacgtagttaggaagttcgtctctacgtagttagggttacggtacggtttaccttaacgttaccgacgtttcccgtactctacgtaagtacgtacgtacgtccaactgtactccgtcgacggtactccgtacacgtactacgtcttacgtttccgagtaagtcgtacgtacgtttcgacggtaccgaccggtccgtacgttacggtacgttaccggggtttatttaacgttacggtggtaaccggtaggaacggttacggaccggtttactttaagttaggtttacggttttaaggttttagggtaacggttttttacggtttaaccgtttacccgggaacctttaccgggtaacggttaaccgggttaccgggggtacccggggttacccttaccccggggtaccggggttaccggggaaccggttaaacggggtaacttccggtaccgggttaccccttaccggtttacccgttacccggttaccgacccccggttaaacccggg

SEQ ID NO: 139636 - DNA, 764 bp, Homo sapiens
  misc_feature: GYAE6OF01DOXSE.46.67.G01.1.454.CMB.1.raw
  modified_base (96)..(96): a, c, t, g, unknown or other
  misc_feature (96)..(96): n is a, c, g, or t
  modified_base (363)..(363): a, c, t, g, unknown or other
  misc_feature (363)..(363): n is a, c, g, or t
  modified_base (669)..(669): a, c, t, g, unknown or other
  misc_feature (669)..(669): n is a, c, g, or t
  modified_base (683)..(683): a, c, t, g, unknown or other
  misc_feature (683)..(683): n is a, c, g, or t
tcagactagcagtacacgaccggtgctcgatttagagtatacatattgggtttggggagtctcggtcaggacacagcatggacatgaggtccccgntcagctcctgggctcctgctactctggctccggaggtgccagatgtgacatcgagctacgaccagtcctccatccctccctgtctgcctaaccggtggacactaggtcaccaaccatcctaacgttcgggacccggtacgaaaggttaccggaattacgtttacggaacccttaaccgtttaaagttttaaaagttcggtaactaccaaaacgtagtaaccgaaccggacgggaacccggtccctaaagtccttactaatcgtaacncgtactacgactaactcctaggttacgacgtaaagggtccggtacccaggttcgtaagtcgaaggtgactaggtgtacgtgtacggtatactagttaccaccgtataacgactaacgttcgaatttaaccgcgtaacgtaccgtaaaggtttgaaacccgtttagtttacaaacccttaaagtttcttaacgacgttaacgtaaactaagttaactttaacgttaagtttcccgggttcgaaaaccgtaaggtaaccctaaactaaaacgttacttaaaaaccgggtaagtccttggggtaaaccncctaaacccgggtntaaaccccttaggttccccgttcgtttaaaccctcccttacgttaccccgggttacccaatttcccgtaaataacgttacg

SEQ ID NO: 139637 - DNA, 818 bp, Homo sapiens
  misc_feature: GYAE6OF01AYI65.46.67.G01.1.454.CMB.1.raw
  modified_base (206)..(206): a, c, t, g, unknown or other
  misc_feature (206)..(206): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactgggtgaggccttcgggacgacccctgtcccctcaccgtgccnctgttctcgtggtcgcctccatcgtagtgttcgtttcttcgtggggcgtgggtccggcgacgccgtccggaggggacgggctaggaactacgtagttggacttgtctctctagtaggtggtacggttacctattaccgtacgttccgttctaccgtaggtaaacgtacggttacgacgtaccaaccgtaagttaccttaccgttacgtaccggtaacgccgttaccgaacgtactaacttaccgtttaccgtttacccgtaggtaaacgtcgttagttacggtttcgttacgtaccggtacccgtaccggtcgttaccggaaccgggttaccgggttaacttttacggttacgtcggttacgggagtaacgggtacggaccggttttacttaagggttttcgttaagggtttttaggttttcggtaacgggttttaacgtttacccggttaacggtacccgtaacccgttagggtaccggtacccgggtacccggggttacctacccccggggtacggggttaaccggcccgggtttaaaccggggtacttaccggggttcccttacggtaccccggtttacgtaacccgtttccgacccccggtaacccgg

SEQ ID NO: 139638 - DNA, 793 bp, Homo sapiens
  misc_feature: GYAE6OF01BUOV9.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctcgtccctggtgcaactgcaggacgtccgggcccacgacgtgggtgacggtcccttcggacgtaccctgtcccctcaccgtgccgtcttcgtcctcgtggtccgcctccatccgtaggttaggttcggttttccgttccggtgggggtccgttcggggtcccggcacgtcccgtacccgggtaagggggaacgggtctaagggaacttacgtagttagggaacgttgtccgttactacgtaagttcgggtacgggtacggtttaccctaagtttaaccgtacggttcccgttcttaccgtacgaaaggtacgttcggtaactaccaacgtactactcgtacggtacgactaccgtacacgtacctactcgtttacctttccgaggtaactgtagttacgtttcgtggtacccggccgccgtcgtacggtaccggttacggttacttttaacggtcgtcggtacggtcggaaaggttacggtacggtactttagtttacgttgggttttagtttagggttacgtttacggtttaacttacccggaccttaccgtaaggtccgggtccgggaccgggttacccgtccgggtaacccgggtaggggacgtaagggttacctacggttcggtacccgttacgtacccgtttcgtaccccgcccggtacgg

SEQ ID NO: 139639 - DNA, 875 bp, Homo sapiens
  misc_feature: GYAE6OF01A9Y14.46.67.G01.1.454.CMB.1.raw
tcagactagcagtacacgaccggtgctcgatttagagtatacatattggggtttgggggagtctcggtcaggacacagcatggacatgagggtccccgctcagctcctggggctcctgctactctggctccgaggtcgccagatggtgacatcgagctcgacccagtcctccatccctccctgtcctgaccgaaccggtgggagaccgtagtcgtccaaccatccaacgttcggaccccgggtacaaacggttccgggaactacgtttacgaacgtaacctttaagttttaaaagttcggttaacttaccgaaacctaagtaaccggaaccgtaacggggacccggtaacccctaacggtccttacccgtaaacttccttagtcgtacgtcgtacctaacgttacccgtagttttacggacggtaaaacgggtcccggggttacccaggttaccgttacggttaccgacggtcggtaccgtacggttacgggtacgtaccggtacggggtaacctaaggttaccttttacccgtaacctttcccggtaacctaacccgtacgttaacccgtaagttaaccttaccgggttaccgaaccggttaacggttaggtaaacggtttacgtttacggtaaactaaacccgtttttagttaaccgttacgtaaccctaagtaacgtatttaaccgtaagtttcggtttaaccggaacggttaacgggaaccgttaaccgtaaacgttaaaccgtaaacgtaaaccggttacgtagggtaaccggtccttaaacgggaccctaaacgttacgttccggttacgttacccgttacctaccggttaccccttaaccggtccctttaactccggttaagtacccg

SEQ ID NO: 139640 - DNA, 675 bp, Homo sapiens
  misc_feature: GYAE6OF01D2XWP.46.67.G01.1.454.CMB.1.raw
  modified_base (221)..(221): a, c, t, g, unknown or other
  misc_feature (221)..(221): n is a, c, g, or t
  modified_base (243)..(243): a, c, t, g, unknown or other
  misc_feature (243)..(243): n is a, c, g, or t
  modified_base (256)..(256): a, c, t, g, unknown or other
  misc_feature (256)..(256): n is a, c, g, or t
  modified_base (524)..(524): a, c, t, g, unknown or other
  misc_feature (524)..(524): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgactggtgaggtccttcggacgacccctgtcccctcacctgccgtctcgtctcgtggtcncctcatcagtgttcgttctcgngggctgggtccgnacgccgtccggagggaacgggtctaggaactacgtagttaggaagttcgtctcgtactaggttaggtggtacgtttacctaagttaccgacggttcccgttactacgtacgaaggtcgtccgtacgtaccaccgtattactcgtcgtacggactaccgtcagactaactcttacgtttccaggtaatgtagtacgtcgtcgaccgaccgtcgtcgtacggaaccgtacggttctttaacgtcgtaggtcgacgtaggtacgtacggtnttaacgttacgttggtttaacgttttgggaacgttttagttaccttccggaacctcggtaggtaccgtcgggaccggtcctacccgggcccgtagggacgtaggtaacgttcggacgtaccgtacccgttctaccgtaccgccgtaacccg

SEQ ID NO: 139641 - DNA, 730 bp, Homo sapiens
  misc_feature: GYAE6OF01D7TOV.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtccgggcccacgactggtgaggccttcggagaccctgtccctcacctgcgctgtctctggtcgcctcatcgagttagttggtttctcgtggggctggggtccgcagccgtccgaggggagggctaggaatacagtttggaatcgtctctactagtaggtggtacggtttcctagtttaccgacggttccgtctctacaaggtacgtcgagttacacctagtactccgtacgtacggacctaccgtccgaagtcctaaacttccgtacgtttttacccgaggtaaacgtagtggtacgtttcgtcgtacggacccgtccgtcgtacggtaccgtacggggttcttttaacgtccgtaggttggaccgaaggaacggtacgtacttagtttacgttgtttaggttttaggagtttaggtttacttaccgaacttaccgtagtacggtaccgggacgggtccaccggtacccggtcggggactaacggggtacttacggtcgtacgtcccgttaccgttacctaccggtcccgttaaccgacccggtacggtccccttacggtcccggtttcccctaccccgggtccgtacccctacccgtaccctacgaacgtcgtacccgg

SEQ ID NO: 139642 - DNA, 757 bp, Homo sapiens
  misc_feature: GYAE6OF01CRO01.46.67.G01.1.454.CMB.1.raw
  modified_base (109)..(109): a, c, t, g, unknown or other
  misc_feature (109)..(109): n is a, c, g, or t
  modified_base (174)..(174): a, c, t, g, unknown or other
  misc_feature (174)..(174): n is a, c, g, or t
  modified_base (275)..(275): a, c, t, g, unknown or other
  misc_feature (275)..(275): n is a, c, g, or t
  modified_base (487)..(487): a, c, t, g, unknown or other
  misc_feature (487)..(487): n is a, c, g, or t
  modified_base (506)..(506): a, c, t, g, unknown or other
  misc_feature (506)..(506): n is a, c, g, or t
tcagactagcagtacacgaccggtgctcgatttagagtatacatattgggtttgtcctcctgctggtggcagctcccagatgggtcctgtccctggtgcaactgcaggngtcgggcccagactggtgaggtccttgggacgaccctgtccctcacctgcgctgtctctgggtcnccctaccagtcagtagttcggttttcctcgtagggtctcgggtccgatacgtccgtccgaaggggacgggctaggaactcgagttgggaattgtcctcgtnagtagtggtacgttctatacgacgtccgtctactacaaggtcgtcgacgtcctaaccgtagttactcgtaccgtaggtaacctaccgttccaagaccttaaacgttcgttaccgttttacccgagtaaagtccgttagttacgttcgttaggtaccgtacccggtcgttacgtaccggaaccggttacgggtttactttaacgtcgtacggngtacgagtacgtacggttnttacgtgttaggttagtttaggagtttacggttacttaccgtacgtaccgtacgttacggtaccgggaccggtaccgtaccggtaccgggtcggtaaccgtaacggtacgttccgtaccggtaccgtacgttcccgttaccgtaccgtcccgacccgtaaccggtaaccggtacccggtaccgttcccgtcccgttccccgtaccgggtccccttaccccgtacccgttaacctaccggtaccgtacccgg

SEQ ID NO: 139643 - DNA, 645 bp, Homo sapiens
  misc_feature: GYAE6OF01EB2IE.46.67.G01.1.454.CMB.1.raw
  modified_base (344)..(344): a, c, t, g, unknown or other
  misc_feature (344)..(344): n is a, c, g, or t
  modified_base (497)..(497): a, c, t, g, unknown or other
  misc_feature (497)..(497): n is a, c, g, or t
  modified_base (568)..(568): a, c, t, g, unknown or other
  misc_feature (568)..(568): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgactggtgaggccttcggacgaccctgtcccctcacctgcgctgtctcgtggtcgcctccatcagttagttggtttcttcgtggggcctgggtccgcagcctccggagggagggctaggaatactagttggaagtgtctctcagtaggtgggtaggtttccctagtttaccgaggttcccgtntcctacgaagtcgtcggatccaacctatactcctcgtaggaccacgttccagacctaatctacgttttccctagaagtagtcgtagttcgtgtccgaccgtcgtctcggacgtacgggtcgttttaactcgttgtcgacggagcggaacgttntaacgttattgtttagttttggaggttttagttactttaccgaactaccgtatacggtcggaccggggtcncccggtccccggtggggacccggtaagggtaatccggtcggtcccgttaccgcctttccctcgaccccgtaccccgg

SEQ ID NO: 139644 - DNA, 575 bp, Homo sapiens
  misc_feature: GYAE6OF01AWNS6.46.67.G01.1.454.CMB.1.raw
  modified_base (387)..(387): a, c, t, g, unknown or other
  misc_feature (387)..(387): n is a, c, g, or t
  modified_base (434)..(434): a, c, t, g, unknown or other
  misc_feature (434)..(434): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttggccggcaagtcggaacattgacactatttaaattgtatcaacatagaccgaggaccgccctaagctcctaatctatgctgcatcctagtttgacgtaaaggtcgggtccccaagtccggaggttcgaggtggctaggtggtatcgtgggacagtatttcactctcacatcagtatntagactaacgtagtaagtatttagactaacttatactagtactaaanataaattactaagttcgtttacggaccgtaagggacctaacgtaactaacgtaaaacttaacgtaacgtgtaggctagaccgtacctagtcttcgttcccttacgtacttaccttccccgaccttacttcgtacgttaacg

SEQ ID NO: 139645 - DNA, 675 bp, Homo sapiens
  misc_feature: GYAE6OF01BA7NY.46.67.G01.1.454.CMB.1.raw
  modified_base (193)..(193): a, c, t, g, unknown or other
  misc_feature (193)..(193): n is a, c, g, or t
  modified_base (262)..(262): a, c, t, g, unknown or other
  misc_feature (262)..(262): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgtccaccatcacttggccgggacaaggtcggaactattgactacttaattaaatggtatacaanatacgaccagggaccgccctaagctacctaatctatcgctgactactcctaggttacgacgtaacgggttcgggtaccctaagtccggtaagggttccgaaggtcggactagggtcggtagtccggttaggacgtacgttaacttcgtacgttacctacgacctactacgtaacgttaacttcgtacgtaactaacggtagtaaagttactttagaaccttaactttactttaacgtagtaacctaaacgtaattaaactttaacgtaacgttcggtttaccggaacggtacggaaccgtaaccgtaaactaaaccgtaaacgttaacgaacgttaggtacggtactaccgaacctactaacttcgtcgttacctacttaccgttcctaccccgtattaccgtgtacgtaacg

SEQ ID NO: 139646 - DNA, 807 bp, Homo sapiens
  misc_feature: GYAE6OF01AC7HV.46.67.G01.1.454.CMB.1.raw
  modified_base (457)..(457): a, c, t, g, unknown or other
  misc_feature (457)..(457): n is a, c, g, or t
  modified_base (713)..(713): a, c, t, g, unknown or other
  misc_feature (713)..(713): n is a, c, g, or t
tcagactagcagtacacgaccggtgctcgatttagagtatacatattgggtttgggggagtctcggtcaggacacagcatggacatgacgggtccccgctcagctccgtggggcctcctgctactctggctccggaggtgccagtatgtcgactatcggagccgtacgaccctagttcctccctactccctcccgtgtctcgaccgaccggtgggagacgtacgtcgtaccaactactacgtccgttcggacccgggataacggtcggaactagttaccgacctaaccgtttaagtttaacgttaggttactaacgaacgtaacgtaccggaaccggtacgggaccgtacccgtaagtaccttaactacttacgagtccgtaccgtagacctaaccgttcgtacgttacggaaccgtacgggttacccggtacgttaacgtcggttacgttacgggnggtaacggtaccgtaggggttaccgtaggtccggtaacggtaccgtacttaacggttaccttaccgtaccgacctacgtacgtaacgtacgtacgttcgaccgtaacggtacgtacgtttaacttagtttaccgtaactttaacgttaactacgtaaacgtaccgtaataagtttaccgttaatacgtttacggtaacccggaacgtaccggtttaaacaccgtaacgtaaaccgttaaacgtaccgttaacgggngttacgtaaccctacggtaccgttacctcggtttaccgccgttttaccacccgttactaaccccggttacccgtaatcccttagtacccgtacg

SEQ ID NO: 139647 - DNA, 701 bp, Homo sapiens
  misc_feature: GYAE6OF01DGTZ7.46.67.G01.1.454.CMB.1.raw
  modified_base (211)..(211): a, c, t, g, unknown or other
  misc_feature (211)..(211): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagccctgtccctcacctgcgctgtctctggtcgcctcatcagtagttggtttctcgtggggctgggtcccggnacgcctcccgagggggaacgggctaggaaactacgtagttgggtaagtcgttctacgtacagtaggtagggtacgggtttaccctaattacacgttcccgttctctacaagtgtcgagtcacctatatctcgtgacacgtccagctaatctacgttttaccagaacgtatgtagttcgtgtcgtaccgcgctggtaccgacggggttctttatttacgtggtcgtacggaaggtacggacggtacttagttattaggtttagtttttagggtaggtttaggttttacgttaccgtaacctaccgtagtacggtaccgggaccggggtccgtacccggtacccggtacgggaccgtaagggtacttacggtacgtacccgtaccgtccgttccttaccgccctaccgaaccgaccgggtccctacggttcccgtaccccgttcccccgtacgtacccctacccccgttcctacccgaagtccgtaccccgg

SEQ ID NO: 139648 - DNA, 850 bp, Homo sapiens
  misc_feature: GYAE6OF01CSAY7.46.67.G01.1.454.CMB.1.raw
  modified_base (142)..(142): a, c, t, g, unknown or other
  misc_feature (142)..(142): n is a, c, g, or t
  modified_base (833)..(833): a, c, t, g, unknown or other
  misc_feature (833)..(833): n is a, c, g, or t
tcagactagcagtacacgaccggtgctcgatttagagtatacatattgggtttgggggacctcctgtgcaagaacatgaagcacctgtggtttgtcctcctgctggtggcagcctcccagagtgggtcctgtcccgtggtcncaactgcgagggacggtcccggggacccacggtacgtgggtacggacgggtcccctttaccggggaacgtacccccttcggttccccctaccgtacccgttcggccgtcctttcggttccttccggttcgggtccgtcccctttaccacgttaccgtaaggtttggttttcggttttccttcgggtcgggggtaccgttccggggtcccggacgtacggtccccgtaccgggaaagggggacgggtcgtacgggtaaacttaacgtaggtttagggtaacgttcgttcctcgtacgtaaggttagggtacgggttaccgtttaccttaagttaccgtacggttcccgttaccttacgtacgtaaaggtacgtcggacgttaccaacctattaccttcgtacgtacggacctaccgtaccaagtacctaacgttaccgtttaccgtttacgagtaagtacgtagttacgtcgtcggcgacccgtcgtacgtacgaccggttacggttactttagtacgtgtcggtaacggagtacggtacgttattattgttaggtttagtttacgggagtttaggttaccttacgaacctacgtagacccggtaccggggaccggtcctaccccgggaccgggtcgggaaccggttaagggtaccgttcggttaacggtcccttaccggttacccttaccnccggtaccccgtaacgg

SEQ ID NO: 139649 - DNA, 943 bp, Homo sapiens
  misc_feature: GYAE6OF01BUJUU.46.67.G01.1.454.CMB.1.raw
  modified_base (172)..(172): a, c, t, g, unknown or other
  misc_feature (172)..(172): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggccttcggagaccctgtccctcacctgcgctgtctctgtcncctccatcagttagtggtttctcgtgggctgggccgcagcctccgaggggacgggctaggaatactagttggaagttgtctctacataggtggtacgttacctagttaccaggttccctctctacgaaaggtcgtacgacgtccaacctatactcgtacgtaggaccacgtaccaagcctaattccttacgttttacccaggtaagattaggtacgtttctggtacccgacccggccggtctacggaccggtacggggtttaccttttaagttacgtcggtacggacggtaacggtaacggtaccggttactttaaacgtttagttacggttttaaggttttttacggggtaaggttttacgggtttttaacccttttaacccgtaaaccccgtttaaccccggtaaaggggttacccgggttacccggggggtaacccggggggtttaccccgtaaccccgggttaaccccccgggggtcggggggtaaaccccgggtaaaacgggggtttaacccggttaacccgggtttccgggttaccccgtttaaccccgggtttccccgtttaccccggtttaacccccggtaccccccggttaaacccccggaaaccccccggggttaaccggggtacccccccttaaccggggtttcccccccgggttttacccccccgtttcccccccgggtaccgggaccccccccttttaacccccccggttacccgtaaacccccgggtttaaacccgggaccccggttaacccccggg

SEQ ID NO: 139650 - DNA, 924 bp, Homo sapiens
  misc_feature: GYAE6OF01BT5H2.46.67.G01.1.454.CMB.1.raw
  modified_base (222)..(222): a, c, t, g, unknown or other
  misc_feature (222)..(222): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcgaggagtccgggcccacgacgtggtgacggccttcggacgaccctgtcccctcaccgtgccgtctgtctcgtggtcncctcatcgagtagttggtttctcgtggggtcgtcgggtccggcacgtccgtccggaggggtaacggggccgtaggtaactacgtaggttaggaagttcgtcttccgtacgtagttacgggtaggttacggtttaccttaacgttaccgtacggtttcccggttctaccttacgaaacggtacgttcggtaacgtaccaaccgtacttacgtccgtcggtacgacccgtaccgtacccgaacgtaacctaacgttcgtttaaccgttttcccgaaggtaaaccgtattacgggttacgtttaccgtacggtacccgaccccggtccgtacggttaacggtaacccgggttaccgggttttaccgttttttaacgtaccggttttggacggtaaccggtaaacggtaaccggggtaacccggttatttaacggttttaaccgtttcggttttaaacgggttttttacggggtaggtttttacggtttacccgttttaaccggaccccggtttaaccggttaggttaacccgggttacccgggggtccgggtttaccccgaaccccgggttacccggggtaccgggggttaaacccggaaacggggtttaaacgttaccccggggttttacgggaccccccgtttaaacccggtttccccgggttaacccgttttaaccccgggccccccgttaaaccccggggg

SEQ ID NO: 139651 - DNA, 819 bp, Homo sapiens
  misc_feature: GYAE6OF01C4PVC.46.67.G01.1.454.CMB.1.raw
  modified_base (190)..(190): a, c, t, g, unknown or other
  misc_feature (190)..(190): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcgaacgtgganacagtcgtacaccagtccacgttcggcccgggtataaacggtcggaaactagtttacggaacctaaccgtttaattttaaaagttggttaacttacaaaacgtaacgttaacggacccgaacggggacccggtaccccttaaagccgttaaccttaatccgttaagtcggtcctacggccctaacgttcccgtaaggtttacgaaccggtaaacgggttccggggtacccctaagtaccgggtaacgggtttaccgaagggttcggtaccgtaaggggttacggtaacggtttaccggtacgggggtaaacctacgggttaacctttttacccgaacctttccgtaacccaacccgttaataccgtaagttaaacgttcgtacgtaacgtaacgttagttaagttacgttttacgaaccgtttaactttacgttacgttaacgtacaaacgtaagtaactttacttaacggtttacgtttaccgggaccgtaaacggtacctaaccggttaaactaaacgtttaaaacgttaaccgaaacgtttcgggtaacgtaccgttagaaccctacgtacgttacgttcgttaccttactacccgttccttaccccgattacctgttccgtaacg

SEQ ID NO: 139652 - DNA, 717 bp, Homo sapiens
  misc_feature: GYAE6OF01DC8NR.46.67.G01.1.454.CMB.1.raw
  modified_base (216)..(216): a, c, t, g, unknown or other
  misc_feature (216)..(216): n is a, c, g, or t
  modified_base (239)..(239): a, c, t, g, unknown or other
  misc_feature (239)..(239): n is a, c, g, or t
  modified_base (251)..(251): a, c, t, g, unknown or other
  misc_feature (251)..(251): n is a, c, g, or t
  modified_base (424)..(424): a, c, t, g, unknown or other
  misc_feature (424)..(424): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaatgcagggagtccgggcccagactgggtgaggccttgggagcccctgtccctacaccgtgccgctgtctctggtcncctcatcgagttagtggttctgngggctgggcganagcgtaccgagggaggctaggaatacagttggaagttcgtctactactagtaggtggtaggttacctattacgacgtccgtctactacgaaaggtacgtacgacgtaaccaccgtattactcgtcgtaggaacacgtcccaagactaactcgttacgtttccctaggaaagtnttggtacgtttacgtagtaccggaaccgtccgacgtacggtaaccgtaccggggtttactttagtttacgtggttaggacggtaaggtaacggtacgtacgttaatttaagtaggttttagttttagggttaggtttaggtttacgttaacctaaccgttacccgtaaggtaccgtaccggggaaccgggggtacctacccgggttaaccccggaggggtaacccggtagggtaaaaccttcggtaccggttcccgttaacccgtccgttaaccgtcccgtacccgtaacccg

SEQ ID NO: 139653 - DNA, 807 bp, Homo sapiens
  misc_feature: GYAE6OF01B1KE2.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccactccctccctgtctgcaaccggtgggacgacagtgtaccaccagtcacgttggcccggacaagtcggaacattgacctaccttattttaaattggtatacaacatacgaccgaaggggtacccgacccctaagtccttaccctaacgttacttacgtacgccgttacggacctactccgtagttttcggaacgtaaacgggttccggggtaccccaggttccggtaggtttacgacggtcgggtacgtaggttacgggtacgttcggtacggggaactacggttaacttttaccgacccttccgtactaacccgtattaccgtaagttaacttcctaggaccgtaacgttacgtaaagtttaacgttttcgaacttaaaccttttacgttaaccgttagttaacccaaacgttaacgtttaaacgtttaacgttaacgttttacgggttttacccgggaaccggtaaaccgggttaactaacccggtaaacttaaaccggttaaaactttaaaccggtaacggttacggtacggtacccgtaggtaacccctaaccgtagtttaacccgttcgtacccgtttacccgtaccctttacccgttaccccccgtaaccgttaccttaccgtcgttaaacccg

SEQ ID NO: 139654 - DNA, 887 bp, Homo sapiens
  misc_feature: GYAE6OF01D9NIQ.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtccgggccacgactgggtgaggtcccttcggacgtaccctcgtccctcaccgtgcgtctgtcctcgtggtccgtaccctcctagtcgtaaggttacggtttcggttttccgttcgggtggggtccgttccgggggtcccggacgaacggtcccgttacccggggaagggggtaacggggtctaaggtaacttacgtaggttacgggaagttcgttcctacgttacgtaggttacgggtcggttaccgttaccttaagttaccgcgttacccgtctacgtaagtaaacggtcgtacgtaactacccaataagtcttccgtacgacgtaaccgtaccacgactacgtaacttccgttaacgttccgaaggtaatcgttacgtacgttcgtacgggtacccgcccggaccgttacgtaagggtacccgtttaacggggttactttttaaggccgttagggacggtaacgaaggtaccggtacgttactttaagtttcgttaggttttacgtttagggtaacgtttacgtttacgtaccgaaccttacggtacgggtacggaccgggtaccgggtcctaccccgggtccgggtacgggaaccggtagggttaacctccgggttaccggaacccgttaccgttacccgtttaccgtacccggtcccctaaacccggtaccccgggtaaccggtacccttacccgggtttcccccgtaccccttccccggggtactaccccccgttacccgttaccgaacccgtacgtacccggttaccccgg

SEQ ID NO: 139655 - DNA, 877 bp, Homo sapiens
  misc_feature: GYAE6OF01ATWU8.46.67.G01.1.454.CMB.1.raw
tcagactagcagtacacgaccggtgctcgatttagagtatacatattggggtttgggggagtctcggtcaggacacagcatggacatgagggtccccgctcagctccgtggggctcctgctactctggctccgaggtgccagatgtgacatcgagctcgacccagtcctccactccctccctgtctgacaccggtgggagacagtgccaccatcctacgttcggcccgggactaaacggtaccggaaactgtttacgaaccttaacctttaaagttttaaaagttcggtaacttacaaaaccgtaagtaacggaacccggaacgggggacccggtaccccgttaaacggcccttaaccccttaaagttacccttaagttcgggtaccttcggtaccctaacgttaccccgttaaggtttttacggaaccggtaaaacggggtttccgggggtacccctaacggtttaccgggtaacgggtttccgtaagggttcggggaccgtaagggttacgggtacgttaccgggtaacgggggtaacgtaacggttactttaccctaaccgtttacccgtacctaacccgtactttaaccgtaacggtttaacgttccgttaccggtaaccgtaacgggtttaacggaaacgttttaacgttttacggtaaaccctttaaaccgtttaaccgtttaaaccgtttccggtaaactaaaccgtaacggtttaaactttaaccgttaagtttaccgggtttacccggaaccggtaacgggtaacctaacgtaacttaaaacgttaaacgtaaacgtacgtggtacgtcgtacacgtacctgtacgttcttacttacctacgttccctacccacgtctcgtacgtacg

SEQ ID NO: 139656 - DNA, 868 bp, Homo sapiens
  misc_feature: GYAE6OF01EEY4I.46.67.G01.1.454.CMB.1.raw
  modified_base (202)..(202): a, c, t, g, unknown or other
  misc_feature (202)..(202): n is a, c, g, or t
tcagactagcagtacacgaccggtgctcgatttagagtatacatattgggtttggggagtctcggtcaggacacagcatggacatgacgggtccccgctcagctccgtggggctcctgctactctggctccgaggtgccagatgtgacatcgagctcgacccagtcctccatccctcccgtgtctgaccgaaccggtggganacgtaggtcgtaccacctagtctaccgttcgggcccgggtacaacggtccggaaactagtttacgaacctaaccgtttaattttaaacgttcggttaatacctaaacgtagttaacggaacccgaacgggggtacccgtaccccgtaaagtcctaaccgttaatccttaagtcggtccgtacgtaccgtacgttcccgtaggtttacgaccggtaaacgggttccgggtaccctaagttccggtagggttcaggtcggacgtaacggtaggtacgtccggtagggtaacgtacgttacgttacctaccgttaccgtaccaacctaacttacgtaacgttaacttaccgtaacgaaccgtaaacggttaacgttaaacggttttacgtttaacggaaacccttttaaaccgtttaacgtttaccgttaacgtaacccgtaaaacgtaagtttaaaccttttaacccgtaaaggtttttcccgggtttaaccgggaaaccggtaaacgggtaaccctaaaccggttaaacttaaaacccttaaaaggtttaaacccgggttacgtcgggtacccggttaactaaccggaacccttaccgttacgtttaccgttacttacccttacgttaacccttccccgttacccgacttacttcgtaaccttacgg

SEQ ID NO: 139657 - DNA, 759 bp, Homo sapiens
  misc_feature: GYAE6OF01C4BYZ.46.67.G01.1.454.CMB.1.raw
  modified_base (222)..(222): a, c, t, g, unknown or other
  misc_feature (222)..(222): n is a, c, g, or t
  modified_base (258)..(258): a, c, t, g, unknown or other
  misc_feature (258)..(258): n is a, c, g, or t
  modified_base (563)..(563): a, c, t, g, unknown or other
  misc_feature (563)..(563): n is a, c, g, or t
tcagactagcagtacacgaccggtgctcgatttagagtatacatattgggtttgggggacctcctgtgcaagaacatgaagcacctgtggtttgtcctcctgctggtggcagcctcccagatgggtcctgtccctggtgcaactgcgaggagtccgggcccaagctgggtgacggtccttcgggacacccctgtcccctcacctgccgctgtcctctggtcncctcatctagtgttgtttctcggtgggctgggccgnacgcctaccggagggagggctaggaatacagttggagttcgtctctcgagttggtggtacgttctagttaccgtcgtccgttctcgtacgaaagtcggtactacgtacctaacctattactcgtacgtacggtaccctacgtaccaagacctaaacgtccgtttacgttttcccgaaggtaacgttagttacggttacgtttcgtacggtaccggtaaccccggtcgtaccggtacggtaaccggttaccggggttttaccttttaacgtaccggttggttacggacgaacggtaggtaccgttnttagtttagtttaggtttagtttacgggttagtttacgtttacgttaccgtaccgtaccggttagtaccgggttaccgggtcccggggtaccctacccgggtaccccgggttcggggaccggttaacgggtaaccgttccggtcccggtaccccttaaccgggtttccttaccccgtcggtacccccgtaacccgg

SEQ ID NO: 139658 - DNA, 769 bp, Homo sapiens
  misc_feature: GYAE6OF01BRLRD.46.67.G01.1.454.CMB.1.raw
  modified_base (124)..(124): a, c, t, g, unknown or other
  misc_feature (124)..(124): n is a, c, g, or t
  modified_base (138)..(138): a, c, t, g, unknown or other
  misc_feature (138)..(138): n is a, c, g, or t
  modified_base (190)..(190): a, c, t, g, unknown or other
  misc_feature (190)..(190): n is a, c, g, or t
  modified_base (757)..(757): a, c, t, g, unknown or other
  misc_feature (757)..(757): n is a, c, g, or t
tcagactagcagtacacgaccggtgctcgatttagagtatacatattgggtttggggagtctcggtcaggacacagcatggacatgagggtccccgctcagctccgtggggctcctgctactcnggctccggaggtcnccgagtatgtgacagtcgagctcgacccagtcctccacttccctccctgtcngaccaaccgggtgggagacgagtcgacaccagtctacgtcggccggacaacggtcggaactagttacgacctaacgtttaactttaagtacgtactaacgtaacgtaagtaaccggaaccggtaccggggtaccccgtaacccttaaacggtccttaaccgttaattaccgtaacgtcgacgttcggaccttaccgttccgtaagggtttaaccgacggttaaacgggtcccgggtacccttacgtacggttacggtacgtacgggtacgacgttagggtacgaagttcgggagtactgttacttccaccgtctaccgacctagtaacgaacgttacgtcgtaccggaagttacgtagtaaagtttacgtttccaaacgttttaaactcgttaacgtactaacgtaaattacgttaaacgttaacgttacggttaccgggttaaccggaaacgtaacggtaaaccgttaacgtaaacgtttaaaaccgaagttaaccggaacgtggtaacggtaccctagtacctacgtttactacgttcttacctacggttcccttacgtcacgtnttacggcctagg

SEQ ID NO: 139659 - DNA, 1199 bp, Homo sapiens
  misc_feature: GYAE6OF01DDAX4.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgacaaccgtggganacgagtcgtcaccatcacgttcggcccgggactaacggtacggaaactagttacggaacctaaaccgtttaagtttttaaaacgttgggttaaacttaccgaaaaccgttaacgtaaaccggtaaccccggtaaaccggggggtaaccccgggtaaccccccgttaaaaggtacccctttaacccctttaaaagtttaccggtttaaacgttccggtaccgtttacgggtaaccccttaacgtttaccccggtttaacggttttttaccgggaaaccggtaaaaccggggttttaccggggggttaccccctaaacgggtttacccgggtaaacgggttttacccggtaaagggttttaaccgggggaccgttaaacggggtttacggggttaaacgttaccggggttaacgggggtaaaccgttaaaccgggtttaacttttttaacccccgaaccgttttacccttaaaacccccgtaaccccgtttaaaacggtttacccgttaaaacgggttttaaacctttccccggtttaagggaaaacccgtttaaaacccggggttttaaacgggtaaaaaccccggtttttttgttttttaaaacccggggttaaacccgttttaaaacccttttttaaccgttttaaaacccggttttaaccgttaaaacccggttaaaaacggtttaaaacccggttttaaaaccgtttttaaaaccggtttaagggttttttaacccggggttttaaacccggggtaaaccccgggttaaaaacgggggttaaacccttaaacccggtttaaaacccgtaaaaccgttttaaaaaaccgggttttaaaacccgggaaaccgttttaacgggttaccgggttaaaccccgtttaaggtaaccccccgttaaaaccgggtttacctttttaacccggttaccggtttttaacccgtttaaacccgttttccccggttaacccccccgttttaacccgtacccgtttaaacccggttt

SEQ ID NO: 139660 - DNA, 771 bp, Homo sapiens
  misc_feature: GYAE6OF01BUMZ5.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgactgggtgaggtcccttcgggacgaccctgtccctcacctgcgctgtctcgtggtcgcctccatcagtagttggtttctcgtggggcgtgggtccgcacgcctccggagggacgggctaggaatacgtattaggaagtgtctctacgtagtaggtggtacgtttcctagttacgacggttccgtctctacgaaggtacgtcgagtaccacctattactcgtcgtggacctaccgtacgacgactactcttacgtttccagtagtagtagtattcgtcggtccgacccgccgtcgtcggaaccgttacgggttacgttttacgttacgtggtacggacggtaaggacggtacggttactttaacgtttaggttagtttttagggtttttaggggtagtttttacgggttttacgtttacccggtaacccgttaacccggttaggtacccgggttaccggggggtaccgggggtacccgtttcccccgggtaaccccggggtcgggggtacccggtaaaacgggggttaaccgttacggggttccccgggtacccgttaaccccggtttcccgtttaaccccgttacccggtcccccgttaaacccccggg

SEQ ID NO: 139661 - DNA, 855 bp, Homo sapiens
  misc_feature: GYAE6OF01EIY0X.46.67.G01.1.454.CMB.1.raw
  modified_base (142)..(142): a, c, t, g, unknown or other
  misc_feature (142)..(142): n is a, c, g, or t
  modified_base (204)..(204): a, c, t, g, unknown or other
  misc_feature (204)..(204): n is a, c, g, or t
tcagactagcagtacacgaccggtgctcgatttagagtatacatattgggtttggggagtctcggtcaggacacagcatggacatgagggtccccgctcagctccgtggggctcctgctactctggctccggaggtgccagntgtgacatcgagctacgacccagtcctccacttccctcccgtgtctgaccgaacggtggganacgtgtcgtcaccagtcacgttcggaccgggactaaaggtccggaaactatttacggaaccttaaccgtttaattttaaaacgttggtaacttaccaaacgtaagttaaccggaacccggtaacgggggtaccccggtacccccttaaaggtacccgttaacccgttaaacgttccttaaacgttccgggtaccttacggtaccttaaccgttaccccgttaagggttttacggaaccggttaaacgggggtttcccgggggttaaccccttaaggttcccggggttaagggtttccggtaaggggtaccggacggttagggtacggggtaacgttcgggtaacgggtaacgtacgtttactttaccggtacctacccgttacaaccgtacgtacgtaacgttaacgtctacggtaacgtaacggttagttaaagttctttacggaactttaacgtttacttaacggttactaactaacgttaaagttaactttaacgtagtttaccgtttaaccgggaacgtaaaccgggacttaaaccggtaaccttaaagtaaacgttaacgtacggttaggtccgtactacgtacctaacttcttacggttccgtaccttactacccgtttcctacccgtataccgtgttaacgtac

SEQ ID NO: 139662 - DNA, 725 bp, Homo sapiens
  misc_feature: GYAE6OF01DP13Z.46.67.G01.1.454.CMB.1.raw
  modified_base (224)..(224): a, c, t, g, unknown or other
  misc_feature (224)..(224): n is a, c, g, or t
  modified_base (234)..(234): a, c, t, g, unknown or other
  misc_feature (234)..(234): n is a, c, g, or t
  modified_base (263)..(263): a, c, t, g, unknown or other
  misc_feature (263)..(263): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtctccatccctcctgtctgacaaccggtgggagacagtgtccaacatcacttcggccggganaagtcgaacnttagactaacttaatttaagtgtatcaanatagaccgaggaccgccctaagcctactaatctatgcgtcgactacttcgtagtttcgacggtaaggtccgggtaccagttcggtaggttcaggtgacgtaggtgagtcggtaggataagttcttacacgttcctacaacctatacgaacgttaatccgtaagtaccgtaaggtaagtaaagtttacgtttacgtaaactttaacgttttacttaacgttaccgttaacaaaacgttaccgtttaaaattttacgtaaacgtttttcggttaaccgggaaccggaaacgggtaaccgttaaccgttaaaacctaaaacgtttaaaaccgttaaaccgaggtttaacgggtacgtaccttaccggtaacccgtaaccttacgtttaccgttcgtttaacccctttacggtacccgttttaacccccggtttcccgtaaccttacgtttaccgttcgttaaacg

SEQ ID NO: 139663 - DNA, 757 bp, Homo sapiens
  misc_feature: GYAE6OF01DVWH5.46.67.G01.1.454.CMB.1.raw
tcagactagcagtacacgaccggtgctcgatttagagtatacatattgggtttggggggacctcctgtgcaagaacatgaagcacctgtggtttgtcctcctgctggtggcagctcccagatgggtcctgtccctggtgcaactgcagggacgtccgggcccacgacgtgggtgacggtccgttcggacgacccttcgtcccctcacctgcgtcttcgttctcgtggtcgccctcatctagttgttggtttcttggtggggtcgtcgggtccgcgacgccgtaccggaggggagggtctaggaatactagttaggaagtcgtctctcgtagttaggtgggttacggttaccttacgttacgtacggttccgttcttacgtactaaggtacgtcgtacgtaccactacttacttcgtccgtaggacctacgtaccacgtctaacgtcttacgtttacccgtagaagttacgtaggttcgttcgttcggtaccgaccgtccgtacggtacggtaccggttacggtttacgttttacttcggtggtcggtacggaggtacggtacgttatactttaggttagtttaggttttagggtagtttggttttaccgtaccgtaccgtaccgtaggtacggttaccgggggaccggggtccccggttacccggcccggggtacggggacgggtacggtaaccggttcgttaccggttaccccgtaccggtttccctaccccggttacgtccccggtaaaccccgg

SEQ ID NO: 139664 - DNA, 606 bp, Homo sapiens
  misc_feature: GYAE6OF01BWCW1.46.67.G01.1.454.CMB.1.raw
  modified_base (289)..(289): a, c, t, g, unknown or other
  misc_feature (289)..(289): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctcatcagtagtggtttctcgtggggctgggtccggcagctcccgagggaagggctaggaatacagttggaagtgtctctcatagtggaggttcctattacagtccgtctctcaagngtcgagtcaccgatatctctggacacgtccagcaatctagttttcccctgtaagatgagttctgtcgaccgccgctcgacgacgggtcgtttaatacgttgtgcgagagtacggtctattagtagttattttgggagttggttatttcgacctaccgtagtacgtcgggtaccggggctccggtacccgtcggggaccgaggggtaactacgtcggtacgaccgttcttccgttagcccgttacccaccgtaccgggtacctacgtaccggttccctaccccgtcgtcccctacccgtcctacccgagtcgtacccg

SEQ ID NO: 139665 - DNA, 908 bp, Homo sapiens
  misc_feature: GYAE6OF01EUYS8.46.67.G01.1.454.CMB.1.raw
  modified_base (586)..(586): a, c, t, g, unknown or other
  misc_feature (586)..(586): n is a, c, g, or t
tcagactagcagtacacgaccggtgctcgatttagagtatacatattgggtttggggagtctcggtcaggacacagcatggacatggacgggtccccgctcagctccgtggggcctcctgctactctggctccgaggtgccagatgtgacatcgagctacgacccagtcctaccacttccctccctgtctacgacgtaaccgggtggacgacgtagtcgtacccaccattacctaccggttcgggacccgggtactaaaccgggtaccggtaaactactttaccggaaccttaaaccgttttaaagttttaaacgtttcggtaacttacaaacgtaacgtaacggaacccggtacgggggaccccggtaaccctaacgccctttaacccttaactaccttaagtccgtaccgtacgtaccgtaaccgtttacccgttaaggtttaccggaacgggttaaaccggggttccgggggttaacccctacggtttaccggttaaggttacgtacgggttggacgtaggtacggattaccgggaggtaactacggtaacttctacctccgtaccaactactactaacgttntacccgttagaccgtaagggttacgttaaagtttcgtttaaagtacttaaaccctttagtttaaaccggttacgtaaaccctaacggttaaatttaacctttaaacgtttcggttttaacccggttacccgggtaaacggtaaccgggtaaccgttaaacgttaaaaacgtttaaaccggtaaaacctttaaacgggttacggtaaggtacccggtaaacctacggttaaacccctaacccgtttaaagtttcccggtttaatacccctttaagtcccccttaacgtttcccccgtaaactccgtttaacgtaattacccgg

SEQ ID NO: 139666 - DNA, 841 bp, Homo sapiens
  misc_feature: GYAE6OF01COSDW.46.67.G01.1.454.CMB.1.raw
  modified_base (195)..(195): a, c, t, g, unknown or other
  misc_feature (195)..(195): n is a, c, g, or t
  modified_base (198)..(198): a, c, t, g, unknown or other
  misc_feature (198)..(198): n is a, c, g, or t
tcagactagcagtacacgaccggtgctcgatttagagtatacatattgggtttggggagtctcggtcaggacacagcatggacatgaggtccccgctcagctcctggggctcctgctactctggctccggaggtgccagatgtgacatcgagctgacccagtctccatccctcctgtctgaccaaccggtggganacngtgtaccacctatccgtacgttcggaccggggtacaaaggtaccggtaactagtttacgaacctaacctttaattttaaacgttggtaacttacaactataggaaccgagggtaccggaccctaagtcctacctatactagtcgctagctactctagtttacgacgtaacgggtccgggtacctaacgtcggtaacggttcgtaacggtcggtacgtaaggtacgggtaacgttcggtaacggggaacgttacggttacttttaccgacccgtttaccgtaccgtaaccgtaacttaccgttaaagttaccgtttacggtacgtaacggttaaccggtaggttaaacggtttaacgtttacggtaaacctttaaaccgtttaagtttaacgttaaccggttaacaaaaccggttaacgtttaaacggtttaacgtttaaaccgtttaccggggttttaacccggaaaccgggttaaaccggggtaaccctaaaccggtttaaaaccgtaaaaccgttaaaaacgtttaaaccggtaaccttgggtaaccgtacgtaaccgggtacctaaacccgttatttccggttaaaccgtttcttacaaccctttccggttaacccctacgttactcgtaacgttacccg

SEQ ID NO: 139667 - DNA, 761 bp, Homo sapiens
  misc_feature: GYAE6OF01EQMAY.46.67.G01.1.454.CMB.1.raw
  modified_base (425)..(425): a, c, t, g, unknown or other
  misc_feature (425)..(425): n is a, c, g, or t
  modified_base (438)..(438): a, c, t, g, unknown or other
  misc_feature (438)..(438): n is a, c, g, or t
  modified_base (485)..(485): a, c, t, g, unknown or other
  misc_feature (485)..(485): n is a, c, g, or t
tcagactagcagtacacgaccggtgctcgatttagagtatacatattgggtttggggagtctcggtcaggacacagcatggacatgagggtccccgctcagctccgtggggctcctgctactcgtggcctccggaggtgccagtatgtgacatcgagctcgaccctagtcctccacttccctcctgtctcgacaaccggtgggacacgtagtctaccacctatcctacgttccgggaccggtactaaacgggtaccggtaactagttacgaacttaacctttaaagtttaaacgttagtactaacaaactaagtaccggaaccggacgggtaccccggacccttaagtaccttacgtaattcctagtcgtctcgactaccgtacgtgttacgaacggtaacggtcggtactagtcggtagtacgngtggacgtaggtnacgtaggagtacgtattcgtacactcctactacgtactagtaacttntcgtaactacgtacggtaagttacttagtttaacaactttacgttaattaccgtaacgtaaacctaagttaacttaacgtaactttacgttttacggaaccgtaacggtaaaccggtacccttaaacgtaaactttaaaaccgggaaactttacggaccttacgggtaccggttactaacccggaacgttacccgttagtttaccggtttaaacccttcgttacccgttaacccgttcccttaaaccccggtattttaccgttagtaccccgtacg

SEQ ID NO: 139668 - DNA, 664 bp, Homo sapiens
  misc_feature: GYAE6OF01BIRG8.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctgggctgggtccgcagctccgagggagggctggaatacattggaagtgtctctcagtagtggaggttcctattacagtccgtctctcaagagtcgagtcaccatatctctggacacgtccagcaatctacgttttcccaggaagtactgtagttctgtcgaccgccgctgacgtacgggtcgttttaagttacgtgtgacgtaggacggtacggcttactttaagtgttagtttttggtacgtttaggtttaagtttcggaaccgtacccgtaagtagtaccgggtaaccggggtccgtaccggtaccccgtcggggacccgtaaggggtaacttacgtcggttacccgacggttcctccgttacgcccgtacccaaccggaaccgggcccctaacgttcccgggttacccctttcccccgtccggtacccctacccccttacccgtcccgaaacggtccgtaaccccgg

SEQ ID NO: 139669 - DNA, 725 bp, Homo sapiens
  misc_feature: GYAE6OF01BJPD3.46.67.G01.1.454.CMB.1.raw
tcagactagcagtacacgaccggtgctcgatttagagtatacatattgggtttggggagtctcggtcaggacacagcatggacatgagggtccccgctcagctccgtggggctcctgctactctggctccggaggtgccagatgtgacatcgagctcgacccagtctccactcctccctgtctcgccgaccggtggagacgagtcgtaccaccactcacgttcggccgggacaacggtacggaactattacgacctaaccttaatttaaattggtactacaactagtacgaccgacgggaccgaccctaagtcctacctatactagtcgctagctactcgtagttgacgtaacgggtcggtacctagtacggtaggttcgaggtcggacgtaggtaggtactcggtaggaactaggttacttacgaccgttcaccgtaaccgtattaccgtaagttactacgtacgtaaccgtaagttacgtaaagttactttaacgaacctttaaagttactttaacgtacgtaactaaagtaacgttaacttaacgttaacggtttcggttaaccggacggtaacggtaaccgtaacgtaaaccttaaacggtaaacgttaaaccgtacggttacgtacggtacgtaccgtaccgtacgttaccgtacgtttccgttaccttaccgttaacccgtttcccgtacccttaccgtacttaccgttacgtaaccgg

SEQ ID NO: 139670 - DNA, 702 bp, Homo sapiens
  misc_feature: GYAE6OF01CVF4S.46.67.G01.1.454.CMB.1.raw
  modified_base (197)..(197): a, c, t, g, unknown or other
  misc_feature (197)..(197): n is a, c, g, or t
  modified_base (229)..(229): a, c, t, g, unknown or other
  misc_feature (229)..(229): n is a, c, g, or t
tcagactagcagtacacgaccggtgctcgatttagagtatacatattggggtttggggagtctcggtcaggacacagcatggacatgagggtccccgctcagcctcctggggctcctgctactctggctccgaggtgccagatgtgacatcgagctgacccagtctccactcctccctgtctgacaaccggtggganacagtcgtacacatctacgttggacccggganaacggtacggaactagttacgaactaaccttaagttttaaaagtggttatacaaacaagtacgaaccgaggggacccgaccctaagcctacctaatctagtcgctagctaacgtcctaagtttcgaaccgtaagggttccggtaccctaggtcgtaaggttcgaggtacggcgtaaggtgtacgtcgtacgggaactaggtactttaccacgtttaccactaacctatacgtaagttaatcgtagtaacctaagtacgtaattacgtttacaacttaaacttacgttacttagtaacctaaagtaagttaaacttaagtaacgtttcggttttaaccggaacgtaacggaacctaaacggtaaaccttaaacgttaaaccgttaaacgtacgttaggtacggtaccttagacctaaccgtacgttgtaccttacgttaccacgttaccctacccgtactactcgtaacgttac

SEQ ID NO: 139671 - DNA, 800 bp, Homo sapiens
  misc_feature: GYAE6OF01CZMIK.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccggtgggagacagtgtccaccatccacgttcggcccgggacaacggtacggaaactatttcggaacctaaccttaatttttaaaagttggttaacttcaaaactaataacggaacccgaaggggacccggtacccctaagccttacctaatcctatcgctgctatccgtagtttgacgtaaagggtcgggtaccctagtacggtaggtttcgagtcggctaggtacggtagttccggtaggggaactaggttaactttaccgaccttacctacgtaaccctaataccgtaaggttaaaccttacgtcggtaaccgtaaaccggttaaggtaaaggttttaacgtttttacgtaaacgttaaacctttttaacgtttaaccgtttaacgtaaccctaaacgttaacgttaaaattttaacgttaaacgtttttcggttttaacccgggaaccgttaaacggggtaacctaaaccgttaaccttaaacgtaaaacctttaaacggtaaaccgttgggtacgtcctaacgacccgtaaccttagtttacccgttacgtttaccttttacccgtacgtttaccccgttaccccgtaccttaacgttccgttacggtaac

SEQ ID NO: 139672 - DNA, 914 bp, Homo sapiens
  misc_feature: GYAE6OF01CUCWO.46.67.G01.1.454.CMB.1.raw
  modified_base (108)..(108): a, c, t, g, unknown or other
  misc_feature (108)..(108): n is a, c, g, or t
  modified_base (174)..(174): a, c, t, g, unknown or other
  misc_feature (174)..(174): n is a, c, g, or t
  modified_base (197)..(197): a, c, t, g, unknown or other
  misc_feature (197)..(197): n is a, c, g, or t
tcagactagcagtacacgaccggtgctcgatttagagtatacatagttgggtttggggagtctcggtcaggacacagcatggacatgagggtccccgctcagctccgnggggctcctgctactctggctcgaggtgccagatgtgacatcgagctgacccagtcctccactccncctgtctgaccgaaccggtgganacgtagtgaccaaccatcgacgttcggccgggactaaggtccgaatagttcgaacctaaccttaattttaaacgtacggttacttaccgaaactacgttaacggaacccggtaacgggggaacccgtaacccgtaaacgtaccgttaacccttaaggtacccttaacggtggtaccgttacggaccgtaacgtttaccggttaacgggttttccggggaaacttaaacgggggttcccgggggttacccctaacggttaccggggtacgggtttaaccgaacgggttaccgggtacgtaacgggttaggtacgtaccgggtagggtaacgtacgttaacgttttaccgacctttaaccgaacccgtcttaacttaaccgtaagttaaacgtcctttaacgggtaccgtaaacggttaacggtaaacgttttaacgttttacgtaaaccgtttaaccgtttaacgttaccgttaacgttaaaccggtaaacttaacgttaaacgtttaacgttaacgtttacggttttaacccggggaaccggttaaaacgggtaacccgttaaacgttaaaccggtaaaacctttaaaaccggttaacgtaacgtaaccgggttaaccgacgttaaccgtacgtaacccgttacgtaccgtttaaggttcccttaccggttaccctaaccccggtttaccgacctttaacttccgagtttaacccgg

SEQ ID NO: 139673 - DNA, 1097 bp, Homo sapiens
  misc_feature: GYAE6OF01BS6MN.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcgcctcatcagttagttggtttcttcgtggggctgggtccgcagcctacccgaggggaacgggtctaggaaatactagttaggaaggttcgtctctacgtagttaggtggtacggttccttaagttaccgtacggttacccgttctacttacgaagtacgtacggacgtacctaaccgatacgtcttccgtacggacctaccgtaccacgtactaaactttacgttaccgtttttacccgaaggtaacgtaagttacggttaacggtttccgttacggtaccgtaacccggcccggttacgttaaccgggaacccggttacccggggttaaccgtttttaacgtttaacggttcgggttacggtaaccgggtaagggtaaccgggtaaccggttaacggttttaaacgttttaccgggtttaaaggttttaacgggtttttttacggggttaacggggtttttaacgggtttttttaacccgttttacccgggtaaaaaccccctttaaaccccggggtttaaggttaaaccccggggttttaccgggggtaaacccccggggggggttccccgtttaaacccccgggggttaaaccccccccgggtttcgggggggggtaaacccccgtaaacggggggttaaaacccggtttaaccgggttttaccccgggtaaccccggtttaaccccggtttaccccggtttaccccgttttaaaccccgggtacccccctttaaacccccgggtaaaaccccgggttaaccccgggggttaccccccgttaaacccgggtttcccccgggttttaaccccccccgtttaccccccccgggtttaccccgggttacccccccttaaaacccccccggtttaccccccgttaaaccccggtaaaacccgggttaccccggtaaaccccccgggg

SEQ ID NO: 139674 - DNA, 900 bp, Homo sapiens
  misc_feature: GYAE6OF01BVT8K.46.67.G01.1.454.CMB.1.raw
  modified_base (264)..(264): a, c, t, g, unknown or other
  misc_feature (264)..(264): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcagggagtccggggcccacgactgggtcgaggccctttcgggacgaccccttgtcccctcaccgtgcgtctgtctctggtcgcctcatcagttagtcgtttctcgtgggctcgggtccgnagcctccgaggggaaggctaggaactacgtagttaggaagttcggtcctcgtactagttacggtgggtacggtttacctagttacgacggttcccgttctccgtacgaaaggtcgtacgtacgttaccaaccctaattactccgttaccgtacgggaaccctacccgttacccgaacgtacctaaaagtttcccgtttaaccgttttttaccccgaaggtaaaagtttacggttacgggtttaaaccggttttcctttacgggtacccggtaacccccggtccggtcccggttaacgggtacccgggtaacgggggttttaccttttttaaaccgttacgtttcggttaccgggacgtaagggaaccggtaccggtttacttaaggtttagtttacggtttttaggttttttaggggtaacgttttacgggtttttacgtttacccgtaacccgttaacccggttaacgggtaccggtacccgggggtaaccgggggttcccccgttaccccggggtaaccccgggttcggggtaaaccccggggtaagggttaaaccgttcccggttaacggggtccccctttacccgggtttacccctaaccgtttttaccccggccccccgttaaaacccggg

SEQ ID NO: 139675 - DNA, 669 bp, Homo sapiens
  misc_feature: GYAE6OF01A9DTM.46.67.G01.1.454.CMB.1.raw
  modified_base (367)..(367): a, c, t, g, unknown or other
  misc_feature (367)..(367): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtgggctgggtccgcagcctcccgagggagggctgaatacagttggagtgtctctcataggtggtagttcctattacacgtaccgtctctacaagcgtcgagtccacatatctctggacacgtccagcaatctacgtttaccagaagtatgtcgttactcgtacgaccgccgtntacgacgtacgggtctttaatacgtgtagtcgaggacgtacggtacttaatttgtacggtttagttttagggagtttggtttacttccgtaacccgtacctagggtagtccgggtaccggggtccctacgggacccccggtcggggtaaccgaacggggtacttacggtcggttaccctaccggttcccttccgttaccgtccccgtaacccgaacccggaacccgggtccctaaccgtcccggtttacccctcccccgtacgtaccccgtaccccttcccgaccaaacggtccgtaccccg

SEQ ID NO: 139676 - DNA, 982 bp, Homo sapiens
  misc_feature: GYAE6OF01BHAMB.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctggccaaccggtgggagacagtcgtccacctatcctaacgttcgggacccgggacaaacggtaccggaactagtttcgaacctaacctttaattttaaaacgtttcggtaaattaccaaaactaagtaacggaacccgaacgggggtacccgtacccctaaacggacctttacctaaacgttacctaacgttcgaccgttcgaccgtacttcccggttaggttttacgaaaccggttaaaacgggttaccgggggttacccctaaaggttcccgggttaacgggtttccggtaaacgggttcggggtaaccgtaggggttacgggtaacgtttaccgggtaggggtaaccgtttaaacgtacgtttttaccccgtaaacccgtttacccttacccgaaacccgtttaacgtacccgttaaacggtttaaacgtttaccgttaacggtaacggttaaaccggttaagggtttaaaacggttttaacgtttttaacgttaaaccgtttaaaccgttttaacgtttaaccggtttaacgttaaccgtaaaacgtaaacgttaaacgttttaaacgttaaccggtttttacgggttttaacccgggtaacccggttaaacgggtaacccgtaaaccggttaaaaccgttaaaccgttaaaaacgttaacccggtaaaccgttacggtaaccgggtaccttaccggtaacctaacccgttaacgttacctttccggttaaccctttacccgttaacccgtttacccgtttacccccgtaccgttaacccttcgttaaccggttaaacc

SEQ ID NO: 139677 - DNA, 887 bp, Homo sapiens
  misc_feature: GYAE6OF01AEPBB.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcgcctccatcgagttaggttcggttttcttcgtgggggtcttggggtacccggcacggcctacccggagggggaacggggctagggaactacgtagttagggaacgttcgtcctctacgagttaggtggtacggttcctaagttacacggtccgtctactacgaagtcgtcgagtccaccgattactcctcgtacggaccaccgtccagtactaattccgtacgttttcccgaggtaacgtacgtacggttacgttcgttagtaccggaccgtcccggtacgttacggaacccggttaccgggtttacgttttaacgttacgtacgggttcggacggtaacggtaccggtaaccggtttacttaagtttacgtttaagggttttaggtttttacggggttacggttttaacgggttttaccgtttaacccgtaacccgtaacccgttacggtaaccgggtttacccgggggtaacccggggtccccggttaaccccgggtaccccggggtaaccggggtacccgggtaaggggttaacgttaccgggttaccggttacccgtacccgtttaccgttacccgttaccgtaccccgtacccgaacccggggtaacccggtacccgttaccggttccccgtttaccccgttaccccccgggttacgtacccccgttacccccgttacccgtaacccgaaaccgggttcccgtaccccggg

SEQ ID NO: 139678 - DNA, 589 bp, Homo sapiens
  misc_feature: GYAE6OF01EDT6J.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctcgtggtgcctcatcagtagttggtttcttcgtggggctggggtccggcagcctccgagggaggggctggaatacagttggaagtgtctctcatagtggaggttcctattacagtccgtctctcaagagtcgagtcacctatatctctcgacacgtcagacaatctacgttttcccagaagtatggtagttcgtgtcgaccgccgctcggacgtacgggttacgtttacttacgttggtcgcgagtaggacggtacttattagtgttagttttggagtttggtttattcgactacctagtacgtccgggacgggtctaccggacccggtggggaccgagggtaactcgtcggtaccgaccgtccttaccgttcgcccgtaacccg

SEQ ID NO: 139679 - DNA, 1027 bp, Homo sapiens
  misc_feature: GYAE6OF01AHXXD.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtccgggcccacgacgtggtcgagggtcccttacgggacgtacccctggtccccctcaccgttgccggtcttcggtcctcgttcggggtcgtccccttaccgaactccgtaaggttacggtttcgggtttttaccttcggtacgggggtccgttcgggggtacccgacgacggtcccgttaccccggggaaaggggggtaaggggtcccgttaggggaaacttaaccggtagggtttaggggaaacggtttcccggtttacctcccggttaaggtaacggtttaaggggttacggggttaccgggttttaccctttaaacgtttaaccggtaaccgggtttcccggttccttaccgttaaaccggtaaacgggtaccggttacggtaaccggttcccctaaaaccggtaacttaaccgtttccggtaccggttaacggaacccgtttaacccggtaccctaacgggtaacctaaacgtttcccgtttaaccgggtttttaccccaaggtaacggttacgttacggttaacgttttaccgtcgttaccggtacccgtcccggttacgtaaggttaacccggggtacggtttacgtttaacgttacgttcggtacgggtaacgtacgggtaacgtacgggttacttaacggttacgtttacggtttacggtttaggtcggtttaacggtttaccgttacccggtaacgttacccgtaacggttacggtaccggggttaccggtaccggtacccggtacccgggttacgggtaccggtaacgggtaccggttaccggtacgtaccggtaccgttaccgtacccgttccgtacccgtccggaaccggttacccgggtaccctacggttaccccgtcccgtcccgtccgtaccctacccgttacccacgtacgtcggtacccg

SEQ ID NO: 139680 - DNA, 703 bp, Homo sapiens
  misc_feature: GYAE6OF01CC95C.46.67.G01.1.454.CMB.1.raw
  modified_base (99)..(99): a, c, t, g, unknown or other
  misc_feature (99)..(99): n is a, c, g, or t
tcagactagcagtacacgaccggtgctcgatttagagtatacatattggggtttgggggagtctcggtcaggacacagcatggacatgagggtccccgntcagctccgtggggctcctgctactctggctccgaggtgccagatgtgacatcgagctgacccagtctccatccctccctgtctcgcgaaccgggtgggacgactagtcgccaccgatcgtacgttggccgggacaaggttaccggaactagttacgacctaaacctttaatttaaagttggtaactacaaaactagtaaggaaccgaacggggacccgaccctaaacggccttacctaatccttaagtcggctagacctactaccgtaggtttacgacgtaaagggtcgggtacccaagtcggtacggtgaaggtgacgtaaggtgacgtcgagggtactagtaatttccacttctacgacctagtacgtaataacgtactgtaaccgtaagtagtaagttactttacgaacttaactttataccgtatacgaaactaagttaaattacgtaaacgtttcggtttaccgaaccgaaggaaccctaaagtaaccgtaaaataaacgttaacgaacgttcgggtacggacctacgtaccgtacgtattacgttacttccttaacttacccgttccgtaacccccgtataacttgtactttaaccg

SEQ ID NO: 139681 - DNA, 715 bp, Homo sapiens
  misc_feature: GYAE6OF01AO4YG.46.67.G01.1.454.CMB.1.raw
  modified_base (367)..(367): a, c, t, g, unknown or other
  misc_feature (367)..(367): n is a, c, g, or t
  modified_base (410)..(410): a, c, t, g, unknown or other
  misc_feature (410)..(410): n is a, c, g, or t
  modified_base (417)..(417): a, c, t, g, unknown or other
  misc_feature (417)..(417): n is a, c, g, or t
  modified_base (424)..(424): a, c, t, g, unknown or other
  misc_feature (424)..(424): n is a, c, g, or t
tcagactagcagtacacgaccggtgctcgatttagagtatacatattggtttggggaccgtcctgtgcaagaacatgaagcacctgtggtttgtcctcctgctggtggcagctcccagatgggtcctgtccctggtgcaactgcgtaggacgtccgggcccacgacgtgggtgaggtccgttcggacgcccctgtccctcaccgtgcgctgtcctcgtggtcaccctccgatcgagttggttgtttccttcggtcgggtcgttagggtcccggacgacgtccgtccggtaaggggacgggtagtggtaactacgtagttagggaacgtgtctcgtacgtagttaggtggttacgttcctagttacgngtaccgtctgtacaggtacgtgacgtccactacgtatcgtcgngtaaccncaccganacctatacgtactttccagtaagacgttcgtaacgttcgtagtccgtaccgctacgtcgtacggtcggttatttactacgtgttacgcgttaagcgtaccgttagttacttagtgttaacgggttttagtgggttttaaggttcctttacgtaacccgtacgttaccgggtagttaccgggtacccgggtccgtaacccgtccggggtaaccgggtaccggtaggtaccggttaaccgtcgggttacccgtaccggttacccgttacccgttacggtcccgtaaaccccgg

SEQ ID NO: 139682 - DNA, 756 bp, Homo sapiens
  misc_feature: GYAE6OF01B2WHV.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctcgacccagtcctccactccctccctgtctcgacgaaccggtgggacacagtcgtacaccatcacgttcggccgggacaagtcggaacagttacgacctaccttaatttaagtgtatacgaacagtacgaccgtagggaccgccctaacgctacctaatcgtatgctgacactaccgtagtttagacgtaaggtcgggtaccagtcggtagttcgaggtcggacgaggtaggatcggtaggactagtacttccacgtccacgacctagtctaagtactcgttacgaaccgtaagtagtaagtactttcgaacttaacgtttactaacgtacgaactaagtaacgttaaactttacgtaacgtttacggttttaacccgggaaaccggtaaacgggtaacccctaaaccggttaaaaccttaaaacgttaaaaaacggtttaaaacccgggtaacgtttacgggttaacggtacccgttaaccgggtaaaccccgttaccttaaaccggttccgtttaccgtttacccgttttaacccgtacccgttttaccccccgttacccccgtaacccgttacccgtttaaccgttacgtttaaaccccgg

SEQ ID NO: 139683 - DNA, 763 bp, Homo sapiens
  misc_feature: GYAE6OF01BFQDW.46.67.G01.1.454.CMB.1.raw
  modified_base (231)..(231): a, c, t, g, unknown or other
  misc_feature (231)..(231): n is a, c, g, or t
  modified_base (281)..(281): a, c, t, g, unknown or other
  misc_feature (281)..(281): n is a, c, g, or t
  modified_base (493)..(493): a, c, t, g, unknown or other
  misc_feature (493)..(493): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgacaactggcagggacgtccgggcccacgacgtgggtgacggtccttcggacgaccctgtcccctcacctgccgtcgtcgtcctcgtcggtacncctaccagtcgaggttagttcggtttactcggtggggtctcggggtccgngtacgccgtaccggtaggggaacgggcttagggaatcgtaaggtttaggaacggttcttaccttcgtacgtaagttacgggtcggtaacggtttcccttaagttacctacggttcccgttctaccgtaacgaacggtactacgaacgtccaacgtctttactcgtcgtagggacccacgtccaaggacttaacgttccgtacgttttacccnggaaactgttacggttaattccgtcggtaccgtaccggtccgtacgtaggaccggttacggtttacttaaaggtccgttaggtccggaacggtagttaaccggtccgtttaattagttcggttaagtttaacgttttgggacgtttacgtttacgttccgaacctagtaccggtagtcccggggaaccgggtcctaacccgggccgtagggactaacggttacgtacttaccgggcccttaacgttcccgtaacctccgtacccgtaacg

SEQ ID NO: 139684 - DNA, 630 bp, Homo sapiens
  misc_feature: GYAE6OF01EUFVJ.46.67.G01.1.454.CMB.1.raw
  modified_base (192)..(192): a, c, t, g, unknown or other
  misc_feature (192)..(192): n is a, c, g, or t
  modified_base (253)..(253): a, c, t, g, unknown or other
  misc_feature (253)..(253): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgactacctattaaatgtatcaanatagacctagggacgccctaagctacctaatctatgctgactatcctagtttcgactaaaggtcgggtacccatcgtaggttcaaggttggacaggtagactcgtaggggactaggtactttacgaccttctaccgacctagtactaagttaactcgttagacgtaacggttgtaaacgttagttttacgacttaaacctttattaaccgtagtaaacctaaacgtaagtaaatttaccgaaagtttcggtttaaccggaacgaaacggggtacctaacggaaccttaacgtaaaagtttaaccgaacttggtacgacttacgactaccgtattcctcgttactaccgtacttccgtacccactacttcagttaacc

SEQ ID NO: 139685 - DNA, 887 bp, Homo sapiens
  misc_feature: GYAE6OF01C22UL.46.67.G01.1.454.CMB.1.raw
tcagactagcagtacacgaccggtgctcgatttagagtatacatattgggtttgggggacctcctgtgcaagaacatgaagcacctgtggtttcgtcctcctgctggtggcagctcccagagtcgggtcctcgtccgtggtgcaactgcgaggacgtccgggacccacggacgtggtggaacggccctttacgggacgtaccccgttcgtcccctacgtcccgtggccgtcttcggttcctcggttcgggtcctaccccttccaagttcggtaaggttcggtttcggttttccgttcgggtccgggggtcgttcggggtcccgacgtaccggtccgtaccgggaaggggtagggtccgtaggaactagtaggttagggagttcgttctccgtagagttacggtacggttacgttacctagtaccgtacgtccgttactactaacgaaggtcgtacgtacacctaacgtaattctcgtacgacggaacctaccgtacgacgtacttaacgttacgtttaaccgtttccgaaaggtacgttaacgttaggtccgtttcggtcggtaccgtaccgtacgtaccgtacggtaaccgtttacggggttaactttacgttacgtcggtaccggtacgaacggtaccggttacgttagttagtttaggtttagtttaacgggttttagggtacgtttacgtttacgttaccggaaccgtacgggttaacggacgggttacccggggtaccccgggttaccgttaaccccgggtcccggggtaacccggttaacggtaaacccggggttaccgttacccgggtaaccccgggttccccgtttaacccggttaccccgtttcccggtaacccccggttaccgttaaacccccgggg

SEQ ID NO: 139686 - DNA, 606 bp, Homo sapiens
  misc_feature: GYAE6OF01CNXQB.46.67.G01.1.454.CMB.1.raw
  modified_base (193)..(193): a, c, t, g, unknown or other
  misc_feature (193)..(193): n is a, c, g, or t
  modified_base (342)..(342): a, c, t, g, unknown or other
  misc_feature (342)..(342): n is a, c, g, or t
  modified_base (351)..(351): a, c, t, g, unknown or other
  misc_feature (351)..(351): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgtccaccatcacttgccgggcaagtcgaacattgacacctatttaaatgtatcaacatagaccagggacgccctaagctcctaatcatgctgcatccagtttgctaaagtcggggtcccagtcgagttcagtggcagtgatcgngggactagntttcactctacgaccctatactagtaatctaggacctaacggtagtaaagtattttacggaactaactttattaacttgtaacaactaagtaatttactaagtttgtttccggaaccgtaagggaacctaacgtaactaacttaaaacgttaacgtaacgttggtacggacttacgacgtaacccagtttaccgtatttacccgttactaaccgttccctttacccccggacttaaccgttcctaacggttaacc

SEQ ID NO: 139687 - DNA, 210 bp, Homo sapiens
  misc_feature: GYAE6OF01BGR0N.46.67.G01.1.454.CMB.1.raw
  modified_base (210)..(210): a, c, t, g, unknown or other
  misc_feature (210)..(210): n is a, c, g, or t
tcagactagcagtacacgaccggtgctcgatttagagtatacatattgggtttgggggacctcctgtgcaagaacatgaagcacctgtggtttgtcctcctgctggtggcagctccagatgggtcctgtcctggtgcaactgcaggacggtcgggcccacgactgggtgaggccttggacgcccctgtccctcacctgcgctgtctcgtn

SEQ ID NO: 139688 - DNA, 771 bp, Homo sapiens
  misc_feature: GYAE6OF01BAKYN.46.67.G01.1.454.CMB.1.raw
  modified_base (272)..(272): a, c, t, g, unknown or other
  misc_feature (272)..(272): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgccaaccggtgggagacagtcgtacaccatcaccgttcggccggggtacaacggtcggaactattgactacttaatttaaattggtatacaanatacggaccgagggaccgccctaagcctacctaatcttatcgactgacctacttccgtaagttttcgaacggtaaacgggttccgggtacccctaagttccggtaggttttaccgaagggttcggtacggtaagtcgggtaacgtccggtagggactaggttactttccaccgttcctacccaacgtattaccgaagttaactccgtagtaccgtaacggttagtaaaggtttattttacgactttaaactttagtttaaaccgtacgttaactaacgtaagtaaacttttaactaacggtttcggtttaaccggtaaccgaaacggggtaacctaaccggttaaactaaaacgttaaacgttaaaccggtagttaccggttaacgggtaccttacgggtaacccttaaccgttaacttcgtttcccgttaccgtttaccgtaaccgtttacccccgtttacccccgtaagttaaccctttacggttcgttaaacccgg

SEQ ID NO: 139689 - DNA, 779 bp, Homo sapiens
  misc_feature: GYAE6OF01EM67A.46.67.G01.1.454.CMB.1.raw
  modified_base (177)..(177): a, c, t, g, unknown or other
  misc_feature (177)..(177): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactgggtgaggcccttcggacgaccctgtccctcacctgcgctgtctcgtggtcncctcatcagtagttgtttctcgtggggctcggggtccgcacgcctacccggaagggggaacgggcttaggaaattacgtagttacgggaagttcgtcttcgtactaagtacggtggtacgttccttattaccgacggttccgtctactacgtaagtacgtcgtacgtacctaacgtacgtaacttccgtacgacggtaccctaccgtccgacgtactaacgttccgttaccgttttacccgaggtaactacgttacgttacgttacgtcggtaccgacccgtccgtacgtcggaacccgtcgggttactttagttaccgtgtacggacgtagacggtacgtacttagtttagttacggtttagttttcgggtagtttacgtttacgtaccgtaacctccgtagtaccgggttacgggaccgggttccgtaacccgtccggggtacgggtacccgtaagggtacttaaccgggttcgtacccgttaccgttcctaccgttacgaccccttacccggaacggtaccgtcccttacgggtccccgttccccgttccccggacggtaccccctacccttacccggaaccgtacgcccgtaacccgg

SEQ ID NO: 139690 - DNA, 600 bp, Homo sapiens
  misc_feature: GYAE6OF01B80S3.46.67.G01.1.454.CMB.1.raw
  modified_base (215)..(215): a, c, t, g, unknown or other
  misc_feature (215)..(215): n is a, c, g, or t
tcagactagcagtacacgaccggtgctcgatttagagtatacatattgggtttggggagtctcggtcaggacacagcatggacatgagggtcccgctcagctcctggggctcctgctactctggctccgaggtgccagatgtgacatcgagctgacccagtctccatcctcctgtctgcaaccgtgggagacagtgtcaccatcacttgccgggnaagtcggaacattgacactattaaatggtatcaacatagaccgagggaccggccctaagctacctaatctatgctgcatccagtttcgcgaaagtcgggtcccagtcgaggttcagtgcaggtgtatcgtgggactaggtactttacactctacacctatacaagttaactcctagtaccgtaacgtagtaaggttattttacgacttaacttattacctagtaacaacgtaagtaacttaactacgttacggtttcgaaccgtaacggacctaacgtaactaaactaaagtaacgtaacgttggtacgtacgtacgacctaaccgtaatttccgtcgttacttaactaccttacccttacccggacctacgttcctagttaacg

SEQ ID NO: 139691 - DNA, 521 bp, Homo sapiens
  misc_feature: GYAE6OF01A5PH7.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggccctaagctccaatctatgctgcatccagtttgcaaagtgggtcccatcgagttcagtggcagtgatctgggacagatttcactctcaccatcgagtaatcctagcaacgtgaagtattttgcaactttataactgttacaacagaattacaattgttttacggctaagggacacgactaacaaataacgaactgtggctcgacacctagtctgttacttcgaacttccttaccccgacacttccgtgtacc

SEQ ID NO: 139692 - DNA, 660 bp, Homo sapiens
  misc_feature: GYAE6OF01EPGTR.46.67.G01.1.454.CMB.1.raw
  modified_base (512)..(512): a, c, t, g, unknown or other
  misc_feature (512)..(512): n is a, c, g, or t
  modified_base (602)..(602): a, c, t, g, unknown or other
  misc_feature (602)..(602): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctcgacccagtctccatccctccctgtctgacctaacggtgggacgacaggtcgtccaacctatccgtacgttcggccgggactaaacggtccggaaactagttcgaaccttacctttaaattttaaagttgtaactacaaacgtagtaacgaaccgacgggaccggtaccctaagtccttacctaatactacgtcgtctacgactactccgttagttacgacgtaacggtcggtacctaggtcggtagtcgtaggtcgacgaggtgtagttcggaggactagttacttcactcactactactacgtaagttatcgtacgacgtaacgtaagtaacgttattacgtaacttaaacgtttntaacgttctaacgaaattaagtaacttaacgttagtttacggttacgaacggtaacggtaacctaactaacttaaactaacgttaaacgngtagtcgactaccgtactactatattcgcttactcgtaccctccgatcttcaacgtac

SEQ ID NO: 139693 - DNA, 872 bp, Homo sapiens
  misc_feature: GYAE6OF01AIG4Z.46.67.G01.1.454.CMB.1.raw
  modified_base (203)..(203): a, c, t, g, unknown or other
  misc_feature (203)..(203): n is a, c, g, or t
  modified_base (274)..(274): a, c, t, g, unknown or other
  misc_feature (274)..(274): n is a, c, g, or t
tcagactagcagtacacgaccggtgctcgatttagagtatacatattgggtttggggagtctcggtcaggacacagcatggacatggagggtccccgctcagctccgtggggctcctgctactctggcctccgaggtcgccagatgtgacatcgagctcgacccagtcctccactccctcctgtctgacgaccggtggagacngtcgtccacctactcacgtcggaccggtataacgtcgaactagtacgaacctaccttaattaacgtgtaanactaacacgtacgaaccggagggtacccgtacccgtaacgtcctacttaagttcctatcggtcctacgtacctaccgttaccgtacggttaacggaccgggttaaacgggttccggggtaaccctacgggttacggttaaccggttacggtaacgggtacgggtaccggtacggggttaacggtacggtacccggggtaggttaacccggtaacggtttaaccttaccgtaacccgttaccctaacccgtataacccggtttaaccgtaaccgttacggttaccgtaccggtaaaccgggttaaccgttaagtttaacggtttaactttaccgggaaaccttttaaccttttacgggtttaccgtaacgtaaacccgtaaagtttaaacgtaacccgtttaaaggttttacggtttaccgggtttaaaccgggaacccgtaaacggggttacccttaaactaaacgttaaaacccggttaaacggttaaacccgcgggttagtacccggaccttaaccggaaccttaaacccgtgtttaccctacgtttacccttacccgtaaccttcccgtacccgtaattcgtactaccgttaacg

SEQ ID NO: 139694 - DNA, 845 bp, Homo sapiens
  misc_feature: GYAE6OF01D3KJ3.46.67.G01.1.454.CMB.1.raw
  modified_base (201)..(201): a, c, t, g, unknown or other
  misc_feature (201)..(201): n is a, c, g, or t
tcagactagcagtacacgaccggtgctcgatttagagtatacatattgggtttggggagtctcggtcaggacacagcatggacatggacgggtccccgctcagctccgtggggctcctgctactctggctccgaggtgccagatgtgacatcgagctcgaccctagtcctcactcctcctgtctgaccaacggtggatacngtcgtccaccgatctacgttcggccgggtacaacggtcgaactgttacgactaacctttattttaaagtcggtaactacaaactacgttaacgaccggaacggggtacccggtacccctaaaggtcccttaacgtaacttcttagtacgtccgtcgacctacttaccgtaagggtttactaacggtaaacgggttccgggtacccctaaggttcgggtaacgttacgtacgggtacgggtacgtacgggttggtacgtcgttacggggaactaggttacctttctaccgtactaaccgaacctagtacgtaagttacgtacgtacgaaccgtacgtaaaggtacgttacgtttaccgtaaccgttaacgttttacgttaacgtaactacgtaaacttaacggtaactttaaacggttaacgttttacggttaaccggacccgttaaaaacggggtacccttaaaccgttaaaaggtaaacccctttaaaagggttaaaacccgtcgggttaacgttccgggtaaaaccgttccgaaatttaaccgttaaccgtaacccgttttcgggaccgttttaacctttaccccgggtaacctttcccccgggtttaaccctaaccctttcccggtttgttaaaacccggg

SEQ ID NO: 139695 - DNA, 965 bp, Homo sapiens
  misc_feature: GYAE6OF01DC880.46.67.G01.1.454.CMB.1.raw
tcagactagcagtacacgaccggtgctcgatttagagtatacatattggggtttgggggagtctcggtcaggacacagcatggacatggacgggtccccgctcagcctccgtggggctcctgctactcgtggctccggaggtcgccagtatggtacacagtacgacgcgtaccgaccctacgtccctacctactccccttcccgtcgtcctcggaccgaaccggggtagggaacgtaccgtaggtccgtaccaaccgtacgtacctacggttccgggaccgggacgtaaacgggtaccggaaacttagtttaccggaacctttaaaccgttttaaagttttaaaaggttacggtaacctaacgaaacgtaacgaacggaaccggggaaccgggtaaccccgtacctaacgtaccttaacccgttaagttacttcggcgtactaccgtacttctaaccggtttgttaacggaaccgggttacggggttccggactacgggtacgggtacgtaggtaggcggtacggtaaggcgtacgggtacgtacgggtaacttacttcttaccctgtaacccgtaccaacgttaacctaggttaaccgttacgtaccggttaacgaaacggtttaaccggtagttaaacgtttacgtttaaaccgtaacttttaacggtttaacctacgttaaacggtaactaaacgttaaacgtttaaacgtttacggtttaaccggttaacggggttaacccggaaacccggttaacgggtaaaaccctaacgttaaaaaccgggttaaaacttaaaaccccgggttaaggtacccggtttaaggggccccgtttaaacgtaaacccgttaacccgttacccgttaggttttacccgtttcccggtttaccctttaaccggtttcccccttaacccgttaacccggtacccttttaaaggttccggtttaaagttaccccgg

SEQ ID NO: 139696 - DNA, 876 bp, Homo sapiens
  misc_feature: GYAE6OF01DNFGN.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtccgggcccacgactggtgaggtccttcggacgtaccctgtccctcaccgtgcgctcgtctcgtggtcgcctcatcagtagttcgtttctcggtgggctagggtccgcacgtcctaccggaaggggtaacggggtctagggtaactacgtagttacgggtaagttcgttacctcgttacctaacggttacgggttacggttaccggtttaccttaacgttaaccggtacggttcccgttaccttacgtacgtaacggtacgtaccgtacgttacctaaccgtacgttacgttccgtacgtacggtaccgtaccgtaccgtacgtacgtaacgttaccgttaccgtttaccgagtacgtacgttcggttacgttcgtacggtaccggtacccgtccgtacgttacggtaccggttacggtttacgtttacgtacgttacggtacggtacggaaggtaaccggtacggttaacgtttaagtttaggtttaggttttaggtttacgggttacggttttacggtttaccgttaaccgtaacccgttaccggtaacggttacgggttacccggggtaccgggtacccgttacccgggtaacccggggtaccgggtaaccggtaacgggttacgttaccggttacgtacccgttaccgttccgttaccgttaccgtacccgtacccggtaacccggtccggtacccgttccggttcccggtaccccgttccccgaccgtaccccgttaccctaccgtaccgacgtccgtccg

SEQ ID NO: 139697 - DNA, 714 bp, Homo sapiens
  misc_feature: GYAE6OF01DAQUS.46.67.G01.1.454.CMB.1.raw
  modified_base (175)..(175): a, c, t, g, unknown or other
  misc_feature (175)..(175): n is a, c, g, or t
tcagactagcagtacacgaccggtgctcgatttagagtatacatattgggtttgtcctcctgctggtggcagctcccagatgggtcctgtcccctggtgcaactgcaggagtcgggcccacgactgggtgaggccttcggacgaccctgtccctcacctgcgctgtctctggtcnccctaccatcagtagttggtttctcgtggggctcgggtccggcacgcctccgaggggaagggtctaggaatacgagttaggaagtgtctctctagtaggtggtacgttacctattacacgtccgtctcctagaagagtcgacgtccaacctattacgtctacgtcggaaccgtaccgtccaagacctaaacttcttaccgttttacccgaggtaaaggtattcggtacgtttcgttacggtaccgacccggtccgtacgtacggaaccggtaccggtttacttttaacgttacgtacggtcgacgaaggtacgtacggttacttagtttaggtagttttagttttagggtaggtttaggtttacttaccggacctaccgtagcgttacgggcgggtacctcccggaccgtcggggaccgaagggtactaccgtcggtacctaccgttccttccgtacgtccccgtaccgaccggtaccggccctacgtcccgttccccttccccgtaccgccctccccgtaccacgaccgtcgtacccg

SEQ ID NO: 139698 - DNA, 824 bp, Homo sapiens
  misc_feature: GYAE6OF01CJ2BI.46.67.G01.1.454.CMB.1.raw
  modified_base (536)..(536): a, c, t, g, unknown or other
  misc_feature (536)..(536): n is a, c, g, or t
  modified_base (581)..(581): a, c, t, g, unknown or other
  misc_feature (581)..(581): n is a, c, g, or t
  modified_base (654)..(654): a, c, t, g, unknown or other
  misc_feature (654)..(654): n is a, c, g, or t
tcagactagcagtacacgaccggtgctcgatttagagtatacatattgggtttggggagtctcggtcaggacacagcatggacatgagggtccccgctcagctccgtggggctcctgctactctggctccgaggtgccagatgtgacatcgagctacgacccagtcctaccactccctccctcgtctcgaccgaaccggtgggacgactagtcgtaccaaccattaccaccgttcggacccggggaccgtaaacggttaccggaaacttaacgtttaccggaacccttaaaccttttaaagtttttaaaacgtttacgggttaacttaaccctaaaacgtaacgttaaccggaaaccccgggaaccgggggtaaccccggtaccccgttaaaacggtacccctttaacccgttaactttaccgtaacgttcgtaccgtcgtaccctaacttaacccggtagttttaccggaaccggttaaaacggggttccgggtaccctaacggttacggttaaccgggtttacaggtaccgggngtaacggtcggttacgtcggtaggtaccgtaagttacctttaccnccgttaccacgtacctagtacgtaagttactcgtacgacctaagttagtattatttacgtaacttaacgtttnttaacgttcgtaactaacgtaattaagttacgttaacggtttacgtttaacggaaccgtaacggaacctacgttaactaaagtaacttaacgactgtacgcgtacaccgtagttaccgtacttacgttcgttaccttacccgttcccgtaccctatcccttagtctaacg

SEQ ID NO: 139699 - DNA, 679 bp, Homo sapiens
  misc_feature: GYAE6OF01DN3BM.46.67.G01.1.454.CMB.1.raw
  modified_base (484)..(484): a, c, t, g, unknown or other
  misc_feature (484)..(484): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcgaaccggtgggacacagtcgtccaccatcacgttcggaccgggacaagtaccggaactagttacgacctaaccttaatttaaagtgtatacaacagtacgaccgacgggaccgtacccaagcctacctaatctatgtctgcctatacctagttacgacgtaacggtcgggtacccagtcggtaggttcgaggtggctaggtggtatcggtaggactagtactttcacctctacaccgtatcgtaattaactccgtagtaccgtaacgtagttaagttacttttaccgatttaaaccgttttnttaacgtacgttaactaaacgtaagttaacttaacgtacgttttaggtttacccggaacgtaacggtaccgtaaacgtaactaaacgttaaaacttaacgtaacgtcggttaacgattaccgtaacgtacccttaattccgttcgtttacccttacgtacttccccgtttacccaccttacgtccgttaggtacc

SEQ ID NO: 139700 - DNA, 742 bp, Homo sapiens
  misc_feature: GYAE6OF01BKAPA.46.67.G01.1.454.CMB.1.raw
  modified_base (593)..(593): a, c, t, g, unknown or other
  misc_feature (593)..(593): n is a, c, g, or t
  modified_base (734)..(734): a, c, t, g, unknown or other
  misc_feature (734)..(734): n is a, c, g, or t
tcagactagcagtacacgaccggtgctcgatttagagtatacatattggggtttggggagtctcggtcaggacacgagcatggacatgacgggtccccgctcagctccgtggggctcctgctactctggcctccggaggtcgccagatgtgacatcgagtctcgaccagtcctccacttccctcccgtgtcctcgaccgtaaccgggtgggacacgtacggttctacctaaccgtatccgtaacggttcggacccggggtactaaacgggtaccggtaacctaagttacgaaccttaaacctttaaagtttaaagtcggttaacaactaaactagtaaccggaaccggaaccggggacccggtaaccctaaggtacctactaaacgttctaagtcggtactaccggataaccgtacgttaggtttaccgaacggtaacgggtccgggaccctaggttaccgtagttacgacggtcggacgtaggtacgtacgtcgtaaggacgttaacgttcctaacgctacgtacgactattaccgataacgttcacgaacgtacgtagtaagttacttacgaccttaacgttacgtacgtntaaacgtactaagttaacttacggtagttcggtaacgaaccggtaaggaccttaagaacttaaacgtaactaacggcgtagacgccttagaccgttcgtaattccttgttaccctacgtaccttccgacgtaactacgttnaaacgttc

SEQ ID NO: 139701 - DNA, 618 bp, Homo sapiens
  misc_feature: GYAE6OF01ENN27.46.67.G01.1.454.CMB.1.raw
  modified_base (192)..(192): a, c, t, g, unknown or other
  misc_feature (192)..(192): n is a, c, g, or t
  modified_base (217)..(217): a, c, t, g, unknown or other
  misc_feature (217)..(217): n is a, c, g, or t
  modified_base (250)..(250): a, c, t, g, unknown or other
  misc_feature (250)..(250): n is a, c, g, or t
  modified_base (365)..(365): a, c, t, g, unknown or other
  misc_feature (365)..(365): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggnaagtcgaacatgactactattaatggtatcaanatagaccagggacgccctaagctacctaatctatgctgcatcctagtttgcgtaagtgggtcccagtcgagttcaggtgcagtggatcgtggactagtattcactctcaccatanagtaactctagacgtaacgttagtaagtatttacgacttaaacgtttactttaactacgtaacgaaacgtaacgttaaactttaactaagtttcggttttaccggaaccgtaaacgggtaccgtaacgtaacctaaacgtaaacttaaacggaacgttggtaccggtactacggtacctaaccgtattccgttacgttaccttacccgtactttacccttacccccgtacctaactttcccgtagttaacccg

SEQ ID NO: 139702 - DNA, 716 bp, Homo sapiens
  misc_feature: GYAE6OF01DOIPZ.46.67.G01.1.454.CMB.1.raw
  modified_base (194)..(194): a, c, t, g, unknown or other
  misc_feature (194)..(194): n is a, c, g, or t
  modified_base (710)..(710): a, c, t, g, unknown or other
  misc_feature (710)..(710): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgacaaccggtggganacagctacaccatcgtacgttcggccgggacaaggtcggaactagttcgaactaaccttaattttaaacgttggtactacaaactagtaacgaaccgaaggggacccgtaccctaagccttacctaatctactcgctcgactactcctaggttacgacgtaaagggttccgggtaccctagttacggtaggttcgtaaggtcggtacgtaagggtggtaacttcggtacgggaactacggttactttcgaacccttcgtacctaaccgtacttacgtaagttacctacgtacgaaccgtaggttaagtaacgtttagttttcgaactttaaccgtttaagtttaacttaacggtaactaaacgttaacgttaaacttaacttaagtttacgggttttacccggaacgtaaacggggtacctaacgtaacttaaacctaaagttaaccgaagttcgtacgctacgtacgtacctattccgtacgtttctactacgttaccctaccctagtcttacgnttaacg

SEQ ID NO: 139703 - DNA, 692 bp, Homo sapiens
  misc_feature: GYAE6OF01EZRKE.46.67.G01.1.454.CMB.1.raw
  modified_base (194)..(194): a, c, t, g, unknown or other
  misc_feature (194)..(194): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccggtggganacagtgtccaccatctacgttgccgggacaaggtcggaactattcgacctaccttaatttaaagttgtatcaacatagaccagggacgccctaagcctacctaatctatgctgcactccgtagtttgaccgtaaaggtcgggtaccccaagtcggtacggtttcgaaggtcggctaaggtgggattcggtcggggaactaggttactttccaaccttcctaccgtaaccacttaccgaagtttaaactccgtacgacgtaaccggttagtaaagtttacttttacgacttaaactttacttaactcgtactaactaacgtaatttaacgttaagtttcggtttaccggaaccgtaacgggtaacctaaccgttaactaaaaccgttaaaacgtttaaaaccggtatttacgggtacgtaccgtaccgtaacctaacccgttattccgttacgttacttaccctactttccccgttaccgaccttagtcctaggtaacc

SEQ ID NO: 139704 - DNA, 730 bp, Homo sapiens
  misc_feature: GYAE6OF01C7T3K.46.67.G01.1.454.CMB.1.raw
  modified_base (203)..(203): a, c, t, g, unknown or other
  misc_feature (203)..(203): n is a, c, g, or t
  modified_base (671)..(671): a, c, t, g, unknown or other
  misc_feature (671)..(671): n is a, c, g, or t
tcagactagcagtacacgaccggtgctcgatttagagtatacatattgggtttggggagtctcggtcaggacacagcatggacatgagggtccccgctcagctccgtggggctcctgcttactctggctcgaggtgccagatgtgacatcgagctcgacccagtcctccatccctccctgtctgaccaacggtggagacagtntcacatcacgttggaccggacaaggtacgaactattacgaactaacttaattttaaagttgtaatacaactagtaacgaaccgaggggaccgtaccctaagtacttacctaatcgtatacgtctagactaacgtctagtttaggaactaaacgggtccgggtacctaggtcggtaaggttacgcggttagacgtaggtaggtaacgttggtacggtaacgtaagtacttttacgacctttaccgacaacctaacgttaaccgaagttactaccgtagtaaccgtaaggtaacgtaaagttagtttaactaaccttaagtttactaacgtacgtaacaaacgttaagtaaacgttaattaacgtttacgggtttaacgaaccggttaaaggtaaccctaaacgttaaaccctaaacttaaaacgttaaacccgtaagttacgggttacgaccttagaccctaaacgttnttacggttccgttactacttaaccgttccgttaacccaccttagttaccgtgttaaccg

SEQ ID NO: 139705 - DNA, 757 bp, Homo sapiens
  misc_feature: GYAE6OF01BIOC8.46.67.G01.1.454.CMB.1.raw
  modified_base (219)..(219): a, c, t, g, unknown or other
  misc_feature (219)..(219): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgacgtggtgaggtccttcggacgacccctcgtcccctcacctgcgctgtctctggtcncctcatcagtagtgtttctcgtggggcgtgggtccgcacgcctaccggagggaacggggctaggaatacgtagttaggaagtgtactctacgagttaggtggtacggtttcctagttacacggtcctctctacgtagacgtacgactacacctatactcgtacgtacgaccaccgtacacgactaacgtcttacgtttacccaggtaaacgtagttacgttacgttcgtcgtaccggtacccgtccggtacgtacggtaaccgttaccgggttacgttttaacgtacggttggacggtacgtacgggtacggtacggttacttaagtttagttacgttttaggttttagggtaaggtttacgtttacgtttaccgacccgttaacgttagggtaaccggttccggggtacccggggtaccttaccccggggtaccccgggttacgggggaacccggttaacgggtaacgttaccccggtacggtacccgttacccggttacccgttacccgttaacccggtccccgtaaacccccggg

SEQ ID NO: 139706 - DNA, 871 bp, Homo sapiens
  misc_feature: GYAE6OF01C0J8X.46.67.G01.1.454.CMB.1.raw
  modified_base (186)..(186): a, c, t, g, unknown or other
  misc_feature (186)..(186): n is a, c, g, or t
  modified_base (308)..(308): a, c, t, g, unknown or other
  misc_feature (308)..(308): n is a, c, g, or t
tcagactagcagtacacgaccggtgctcgatttagagtatacatattgggtttgtcctcctgctggtggcagctcccagatgggtcctgtccctggtgcaactgcagggagtccgggcccacggactgggtgacgggcccttcgggacgacccctgtcccctcacctgcgtctgtctcgttggtcnccctccatcgtagttgttggttttcctcggtcgggggctcggggtacccgcacggtccgtaccggaaggggggaacggggtcttaagggaaactacgtagtttagggaagttcgtctacgtnagtaggtgggtacgtttcctaagttacgacggttcccgtctactacgtaaaggacgttcgagtaccaacctatacgtcctcgtacggaacctaacggtccaagtacctaagtcttaaccgttttccgaaggtaagtacttggtacgtttcgtaggtacccggaccgtccccgtggtacggtaaccggtaacggggtttacgttttaactacgttcgggtaggccggtaacggaacgggtacggtacttaagttagttagtttagtttttagggaacgttttcggtttaacgtttaccgtaacccgtaccgtaaggtacggtacccggggtaccgggtcccgtacccgggtacccggtacgggggtaacccgtacgggttaaaccgtaccggtccggttacccgtacccgtttacccgttacccggttaacccgtccccgttaaacccggaacccggaacccggggtaccccttacgggtttcccccgggtttaccccttaccccccggtcggtaaccccctaccccgttacccgaaccgttaaaccgggtcccgtaaccccgg

SEQ ID NO: 139707 - DNA, 568 bp, Homo sapiens
  misc_feature: GYAE6OF01CKBNC.46.67.G01.1.454.CMB.1.raw
  modified_base (174)..(174): a, c, t, g, unknown or other
  misc_feature (174)..(174): n is a, c, g, or t
  modified_base (315)..(315): a, c, t, g, unknown or other
  misc_feature (315)..(315): n is a, c, g, or t
  modified_base (336)..(336): a, c, t, g, unknown or other
  misc_feature (336)..(336): n is a, c, g, or t
  modified_base (340)..(340): a, c, t, g, unknown or other
  misc_feature (340)..(340): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactgggtgaggccttcgggagaccctgtccctcacctgcgctgtctctggtncctccatcagtagtggtttctcgtggggctgggtccgcagcctccgaggggagggctggaatacattggaagtgtctctcagtagtggaggttcctattacagtccgtctctcaagagtcgagtcaccatatctctggacncgtccagcaatcagttttccngaanatgattctgtgaccgcgctgacgacgggtctttatactgtgcgagagacgctattagtgttagtttggagttggttatttcgacctaccgtagatcggacggggtctccggacccgtggggccacgggtatacgtggtccaccgtcttcctacgcctaccgaccgaacgggcccagttccggtcccttcccccgtcggtccctaccctccctacccgaagcgtacccg

SEQ ID NO: 139708 - DNA, 792 bp, Homo sapiens
  misc_feature: GYAE6OF01B20KM.46.67.G01.1.454.CMB.1.raw
  modified_base (96)..(96): a, c, t, g, unknown or other
  misc_feature (96)..(96): n is a, c, g, or t
  modified_base (176)..(176): a, c, t, g, unknown or other
  misc_feature (176)..(176): n is a, c, g, or t
  modified_base (379)..(379): a, c, t, g, unknown or other
  misc_feature (379)..(379): n is a, c, g, or t
  modified_base (490)..(490): a, c, t, g, unknown or other
  misc_feature (490)..(490): n is a, c, g, or t
  modified_base (682)..(682): a, c, t, g, unknown or other
  misc_feature (682)..(682): n is a, c, g, or t
tcagactagcagtacacgaccggtgctcgatttagagtatacatattgggtttgtcctcctgctggtggcagctcccagatggtcctgtcctggtncaactgcaggacgtccggcccacgactggtgaggtccttcgggacgaccctgtccctcacctgcgtctgtctcgtggtcncctcatcgagtgttgtttctcgtgggctgggtaccgcacgtccgtaccggaggggaagggtctaggtaatactagttaggaagtcgtcctctacgtagttacggtggtacgtttaccttaagttacctacggttcccttgtaccttaagaaggtcggtaccgtagtaccctaacctatttacgtccgttcgtaccggtaaccnccggttaccgagtacctaaatttcccgtttaccgtttaccgagtaatacgttgttacgttctcggtaccgcccgtccgtgtacggaaccggttcggtttacttttaatcgnggtacgacggtacgacgggtactactttagtttacgttagttttaggttttacgggtgttttacgtttaccgttacgacccttaacggtacggtacggttccggggaccggttccgtacccgggaccgggtcgggtaaccgtaacggttaactccgggttactaccccggtttacgtaccttaccggtaccnccccgtaaacccggaccgtaaccgggtcccctttacgggttacccccgtcccctttaccccggaccgttacccccttacccggaccaaccggtaaccgccgttaacccgg

SEQ ID NO: 139709 - DNA, 760 bp, Homo sapiens
  misc_feature: GYAE6OF01C0RGO.46.67.G01.1.454.CMB.1.raw
  modified_base (204)..(204): a, c, t, g, unknown or other
  misc_feature (204)..(204): n is a, c, g, or t
  modified_base (436)..(436): a, c, t, g, unknown or other
  misc_feature (436)..(436): n is a, c, g, or t
tcagactagcagtacacgaccggtgctcgatttagagtatacatattgggtttgggggagtctcggtcaggacacagcatggacatgagggtccccgctcagctccgtgggggctcctgctactcgtggctccggagtgccagatgtgacatcgagctcgacccagtcctccatccctccctgtctgccaccgggtggacgacngtcgccaaccatcacgttcgggcccgggacaaggtaccgaactgttacaacctaaccttaattttaaagttggtaattacaaactaatacgaaccgacggggaccgtacccaagtcctaccgtaatcctatcgctggacctctaccgtaggtttagacgtaacggttcggggtaccctaagtcggtaacggtcgagtggctagggtgatccgtagggactacggtattaccncgttactaccaccgtaattacgaacgttaactcctacggtaaacgtaacggtttaagtaagttttaacgttttaatttaaaaccgtttagtttaccgttacgtaactaaacgtaaagtttaactttaacgttaaggtttacggtttacccggaacggtaacggttaacccggaacttaaccgttaaataaaaaccttttaacggtaacttggggtaaccgttaccgtactacccgttaaactccctttacgttcgtttaacctttacccggacctttaccccgttaccccgaacctttacttaccgtgttaaaccttacccggg

SEQ ID NO: 139710 - DNA, 807 bp, Homo sapiens
  misc_feature: GYAE6OF01DP7IX.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtccgggcccacgactggtgaggccttcgggagaccctgtccctcacctgcgctgtctctggtgccctccatcagtagttgtttctcggtgggcgtcgggtccggcacgtcctccggaaggggacgggtctaggaatactagtaggaagtcgtctctatagtaggtaggtacggttcctagttactacgttccgtctctacaacgtagtacgacgtccactattactcgtcgtacgaccgtaccgtcagactaacttcgttaccgtttaccagtaagtctaggtacgtttcgtagtccgacccgtccgtacgtacggtaacccggtagggtttaccttttaacgttccgttaggtcggacggtaaggtaacggtaccggttaactttaagtttagttaggttttaggttttagggtaaggtttcggttttaactttacccggtaaacccgttaaccgtaaggtaccgggttaccggggacccgggttaccgtaccccggtaacccgggtcggggtaacccgtaaaggggtaaccttacgggttaccggttaccccgtaccgttcccgtttacccgtcccggtaccccgtacccgaaacccgggtacccggtacccgttaccggttcccccgggttcccctttccccggacccgtacccctacccccgtacccgttaaccgaacgtcccggtaacccgg

SEQ ID NO: 139711 - DNA, 796 bp, Homo sapiens
  misc_feature: GYAE6OF01B3Y2Z.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtccgggcccagactggtgaggtccttcgggacgaccctgtccctcacctgcgtctcgtctcgtggtctccctccatcaaggttcggttcggttttcttcggtgggggcctcgggggtcccgactacggcccgtaccgggaagggggaacggggtctagggtaaaacttacgtagggttagggaacgttcgtactacctagtaagttagggttcgggtacgtttaccttacgttaactcgggttcccttacctactacgaaaggtcgttacgagtcccaaccttagtacttccgtacgtacgacctaccggtaccacgtactacttacgttaaccgttttccgaagtatacggtgttcgttcgtacggtccggaccgcccgtagtcggtacgtacgggtttactttagttcgttaggcgacggtaacgacgtaccggtagtttacgtagttagttttacggtttaggttaggtttacggtttaccgttacgtaaccgtaccgttaggacggtccggggttacggccgtacccggaccggtacgggacgagggttaccttacgtccgtacgtacccttccgtacctaccgtcctaaccggaccgtccgggttccgaccgttaccccggttccccctaccccggtctcccccgtaaccctacccggaccgtaacgtcccgtaaccccgg

SEQ ID NO: 139712 - DNA, 700 bp, Homo sapiens
  misc_feature: GYAE6OF01CWGB9.46.67.G01.1.454.CMB.1.raw
  modified_base (311)..(311): a, c, t, g, unknown or other
  misc_feature (311)..(311): n is a, c, g, or t
tcagactagcagtacacgaccggtgctcgatttagagtatacatattgggtttggggagtctcggtcaggacacagcatggacatgagggtccccgctcagctccgtggggctcctgctactctggctccgaggtgccagatgtgacatcgagctgacccagtctccatcctccctgtctgccaacggtgggagacagtgtccaccatcacgttcggaccgggacaaggtcggaactagttacgaacctaaccttatttaaagttggtatacaaacatacgaccgtagggaccgaccctaagcctactatntagtcgctgacactccgtaagttcgagaacggtcgggtacctagtcgaggttgagtcggacgtagtggtactcggtacgggaactaacggtacttttaccaccgttctaccgacctataacgtagttaaactcgtactaaccggtaagtacgaaagtttacgtttacaaccgtttaactttacgtaacgtagtaacctaagtaagttaaacttaccgtaagttttccgggttaaccgaacgggtaacggtaacctacggtaaacccttaaacgttaaagttaacccgaaggtttacgaccgtacgtacgtacctaaccgttgtacccgttcgttccctaacgttccctttaccccgttacccggatttacccgtcgttacttaacccgg

SEQ ID NO: 139713 - DNA, 834 bp, Homo sapiens
  misc_feature: GYAE6OF01CFLFI.46.67.G01.1.454.CMB.1.raw
tcagactagcagtacacgaccggtgctcgatttagagtatacatattgggtttggggagtctcggtcaggacacagcatggacatgagggtccccgctcagctccgtggggctcctgctactctggctccgaggtgccagatgtgacatcgagctgacccagtcctccatccctccctgtctgcaaccggtgggagactagtcgtccaccatccgacgttcggccgggactaagggtaccggaaactagttacgaacctaaccttaagttttaaaagttggtaactaccaaacgtaacgtaacggaacccgtaacggggaacccggtaccccttaaaggtcccttaccttaaacgttaccttaacgtcggtccttacggacctaacgttacccgttaggttttacgaacggtaaacgggttccggggtacccctaaggtccggtaaggtttaccgagggtcgggtacgtagggttacggtacgttccggtagggtaacctaaggttaccttttccgaacccttcctaacccgtaaccctacgttacgtaacgttaacgttccgtaacggtaccgtaaacgggttaggttaaacgtttacgttttaacgtaaacctttaaacgttttacttaaccgttacgttaaactaaacgttaactttaaactttacgttaacgtttacgggtttaaccgaaccgggtaaacggaaccttaaccggtaaattaaaccgtaaaagttaacgtacgttacggtacggtactacgaacccgtacgtatttcgtacgttaccgttacctacgttcccttacccgccttaacttcgtcgttaacccg

SEQ ID NO: 139714 - DNA, 805 bp, Homo sapiens
  misc_feature: GYAE6OF01COH8L.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcgaggacgtcgggcccacgacgtgggtgacggtcccttacggacgtacccctcgtccccctcgacccgtgccggtcttcgtccttcgtcgggtctccctccattcgtaggttggttcggttttcttcggtggggtccgttcggggacccgcgacggtccgtacccggaagggggaacggggtcctagggaataacgtaggttaggtaacgttcgtaccttcgtacgtaagttagggtacggtacggtttacctaagtttaccgtacgttccgttactacgtacgtaagtcggtacgtacgtaccaacgtatactcgtacgtacggactacgtaccagtacctaagtacttacgtttccgaagtaagttacgtaggttacgtttcgcggtacggtacccgtcgtcgtacgaccggttacgggttcttaacgtccgtggtacgacggacgacggtcgtattagttagttacggttagttttagggtacggttgtttaaccgttcggaaccttacgtaacgggtcggtacccggggaccggggttccctaaccccgggttacccgggacgggggtacccttaaaggggttaacccgtttacggggtacccgttacccgggtacccgtttaccgtacccccgtacccggtcccgtaacccccggg

SEQ ID NO: 139715 - DNA, 757 bp, Homo sapiens
  misc_feature: GYAE6OF01B9TF0.46.67.G01.1.454.CMB.1.raw
  modified_base (378)..(378): a, c, t, g, unknown or other
  misc_feature (378)..(378): n is a, c, g, or t
  modified_base (386)..(386): a, c, t, g, unknown or other
  misc_feature (386)..(386): n is a, c, g, or t
  modified_base (737)..(737): a, c, t, g, unknown or other
  misc_feature (737)..(737): n is a, c, g, or t
tcagactagcagtacacgaccggtgctcgatttagagtatacatattggggtttggggagtctcggtcaggacacagcatggacatgagggtccccgctcagctccgtggggctcctgctactctggctccgaggtgccagatgtgacatcgagctcgacccagtcctacctactccctcccttgtctgaccgaaccggtgggacacgtagtctccaaccactctacgttcgggcccgggactaaggtaccggaacttagttacgtaaccttaaaccgtttaaagttttaaacgtttacggtaataccaaaactaggaaccgtaaacccggaacggggtaccccggtacccctaacgtccttaaccttaacttgtacncgtaccgngacctacgttacctaggttacggtaacgtaacgggtccgggtaccgtacgtggtacgtcggtagtcggtacgtaggtcgtacgtcgggtaggtaactacgttactttaccgaacttcccgtacaaccgttacgtacgtaacgttactcgtagtaacccgtaaggttacgtagttacttacgtaactttacttatacgtacgaacgtaatagtaactttaacgtcgtttacgtaccgaacgaacggaccctaaagtaactaacgtaaacgtacgtacggttagacgtactaccgtactcggttactacggttcctttacccgttaaccggttcccttaccgtaccccgttanacgtttcgtaacgttaaccg

SEQ ID NO: 139716 - DNA, 738 bp, Homo sapiens
  misc_feature: GYAE6OF01CGX41.46.67.G01.1.454.CMB.1.raw
  modified_base (199)..(199): a, c, t, g, unknown or other
  misc_feature (199)..(199): n is a, c, g, or t
  modified_base (685)..(685): a, c, t, g, unknown or other
  misc_feature (685)..(685): n is a, c, g, or t
tcagactagcagtacacgaccggtgctcgatttagagtatacatattgggtttgggggagtctcggtcaggacacagcatggacatgacgggtccccgctcagctccgtggggctcctgctactctggctccggaggtgccagatgtgacatcgagctcgaccagtctccactcctccctgtctgaccaacggtggganacagtcgtaccactatcacgttcggccgggacaacggtcggaactagttacgaacctaacctttaaagttttaaaagttcggtaactaccaaactagtaacgaaccggaaggggacccggtaccctaaacgtcctacctaatctaacgtcgaccttcgactacttaccgtaggtttacgaaccgtaaaacggggttccggggtacccctaaggttaccgggtaaggtttaccgagggttcggaacggtaaggtacgggtacgttacgggtacggggaaactacgtttaactttaccaccgttctacaaccgtatacgtagttaactcgtacaccgtaaggtactaagttactttagaaccttaattacttactacgtaactaacgtaaattacctttaagtacgtttacggttaccgaacgtaaacggactaacctaacgtaaaataaacgtaagtacggtgtcgaccttacaacccgttaacgtnttacgttcgttaccttataccccgttcccgtacccacttacttcgtagtaacc

SEQ ID NO: 139717 - DNA, 746 bp, Homo sapiens
  misc_feature: GYAE6OF01A66AU.46.67.G01.1.454.CMB.1.raw
  modified_base (247)..(247): a, c, t, g, unknown or other
  misc_feature (247)..(247): n is a, c, g, or t
  modified_base (264)..(264): a, c, t, g, unknown or other
  misc_feature (264)..(264): n is a, c, g, or t
tcagactagcagtacacgaccggtgctcgatttagagtatacatattgggtttgggggacctcctgtgcaagaacatcgaagcacctgtggtttgtcctcctgctggtggcagctcccagatgggtcctgtccctggtgcaactgcaggagtccgggcccacgactgggtgaggccttcggacgaccctcgtccctcacctgcgctgtctcgtggtcgcctccatcgagttagttcggtttcttcgnggggtctgggtcccggntacgccgtacccggaggggtaaggggcctagggtaatactagttaggaagttgtcctgtactaagttggtcggtacggtttaccttattacgacggttcccgtctcctacgaaggtcgtcggtacgtacctaactactactccgtacgtacgggaccctacgtccaagacctaagtccttacggttttcccgaaggtaaacgtattacggttactttcgtacggtccgacccggtccgtacgtacggaccggtacgggttacttttacgttacgtggtacggaacggacggtaacggtcggtactttaagttacggttagttttagggttttggaacgggttttcgtttaacgttaccgaacccttaccggtaggtaccgtcggggtccgggtacctaccccgggcccggtggggaacccggtagggtaacccttacgtccggttactacccgttacttaccccgtcgtaccccgtaacccg

SEQ ID NO: 139718 - DNA, 664 bp, Homo sapiens
  misc_feature: GYAE6OF01BYWUF.46.67.G01.1.454.CMB.1.raw
  modified_base (189)..(189): a, c, t, g, unknown or other
  misc_feature (189)..(189): n is a, c, g, or t
  modified_base (214)..(214): a, c, t, g, unknown or other
  misc_feature (214)..(214): n is a, c, g, or t
  modified_base (224)..(224): a, c, t, g, unknown or other
  misc_feature (224)..(224): n is a, c, g, or t
  modified_base (302)..(302): a, c, t, g, unknown or other
  misc_feature (302)..(302): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaacgtgganacgagtgtcacatcacttggccggnaagtcgaacnttgacacctattaatgtatcaacatagaccgagggaccgaccctaagcctacctaatctatgctgctactcctagttnacgtaaggtcgggtaccctagtcgagttcgaggtggctggtaggattcggtaggactaaggttctttacgacgtacctacgaacctatacgtaagttaactcgtacgaaccgtaacggttagtaacgtttatttacggaactttaacgtttacttaacgtttacgtaacgaaaccgttaaggttaacttttaacgtacgttttacgggttttaaccggaacgttaaccgggtaactaaaccggtaaacctaaacgttaaacgttaaacgtaacgttggtacgtaccgagtacctaccgttaattccgttacgttacgtacccttaccgtttaccctacccggtacacgtttctcgttaaccg

SEQ ID NO: 139719 - DNA, 660 bp, Homo sapiens
  misc_feature: GYAE6OF01BAHR8.46.67.G01.1.454.CMB.1.raw
  modified_base (193)..(193): a, c, t, g, unknown or other
  misc_feature (193)..(193): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgtcaccatcacgttcggccgggacaaaggtccggaaactatttcgaacctaaccttaattttaaagttggtaatacaaacatagaccgagggaccggaccctaagcctactaatctatgctgctatccgtagtttacgacgtaaaggtcggggtccagtcgtaggttcgagtggactagtcggatcgtagggatacgtatttcactctaccactatacgaagttactcgtcgaacgtaacggttagtaaagttagttttcgaacgttaaactttattacttacgtaactaaactaagttaaatttactaagttttacggtttaaccggaccggtaaacgggacctaaccgtaacttaaacgtaaactttaaccgaacttaggtacgtactacgtaacctacgtaacttccgttgttaccttctaaccgttcccttaccccgtactacttccgtagttaaccg

SEQ ID NO: 139720 - DNA, 822 bp, Homo sapiens
  misc_feature: GYAE6OF01EX7CV.46.67.G01.1.454.CMB.1.raw
  modified_base (194)..(194): a, c, t, g, unknown or other
  misc_feature (194)..(194): n is a, c, g, or t
  modified_base (234)..(234): a, c, t, g, unknown or other
  misc_feature (234)..(234): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccggtggganacagtgtcaccatcacttggccgggtacaagtcggaactnttcgactaccttaatttaaatggtatacaacatagaccgagggaccgccctaagctctaatctatcgctgactatccgtagtttacgacgtaaagggttcgggtaccctagttacggaacgggtttcaacgggttgggacgtaaggttacgggtaacgttaccggttacgggggaaaccttaacgggtaactttttacccgtaacccgtttaccgtaaccttaaacccgaacgtttaacgtaaaccggttaaacttcccggttaacggtaaccgtaaaccgggtttaagttaaacggtttaactttttagggaacccttttaaaacgttttaagtttaacccgtttacggtttaaaccctaaaacgttaacgttaaactttttaacgtaaaggttttccggttttaacccgggtaaccggaaaacgggttaaccgtaaaccggtaaacctttaaaaaccgtaaaaaccggttttaaacgaaacgttcgggttaacgggtcctaaaggtaccccaaaccgttagtttccgttacgttcctttaccctaacgtttccccttaacccgactttacgttcgtaacggttaac

SEQ ID NO: 139721 - DNA, 736 bp, Homo sapiens
  misc_feature: GYAE6OF01BCD3R.46.67.G01.1.454.CMB.1.raw
  modified_base (195)..(195): a, c, t, g, unknown or other
  misc_feature (195)..(195): n is a, c, g, or t
  modified_base (221)..(221): a, c, t, g, unknown or other
  misc_feature (221)..(221): n is a, c, g, or t
  modified_base (233)..(233): a, c, t, g, unknown or other
  misc_feature (233)..(233): n is a, c, g, or t
  modified_base (290)..(290): a, c, t, g, unknown or other
  misc_feature (290)..(290): n is a, c, g, or t
  modified_base (715)..(715): a, c, t, g, unknown or other
  misc_feature (715)..(715): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgccgaaccggtggganacagtgtcaccatcacttgccggganaagtcggaactnttgacacttattaaatgtatacaacatagacgacgggaccgccctaagctacctaanctagtgctgacacttcctagtttcgacgtaaacgggttcgggtacccagttaccggtaggtttacagggttcgggacgtagggttacggacgttacggttacggggaactaggttaactttccgtaccttacgtaccaaccgtattaaccgtaagttaactctaggtacgtaacggttagtaaacggttcttttacggaacctttaaacggtttatttaacccgttaggttaaccctaaacggttaaacgttaaacttaagttaaccgtttaacgggttttccggaaaccgtaacgggtaacctaaccgttaaaccgtaaacgttaaaacgttaacgaaacgttcggtaaccgggtacttaccggacctaaccttacgttacgtttacgttacccttttacccgactttcccggtaccccttaanccgttttaacgtggttaaccc

SEQ ID NO: 139722 - DNA, 903 bp, Homo sapiens
  misc_feature: GYAE6OF01C7KRA.46.67.G01.1.454.CMB.1.raw
  modified_base (227)..(227): a, c, t, g, unknown or other
  misc_feature (227)..(227): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtcctggtgcaactgcgaggagtccgggcccacgacgtggtgacggtccgttcggacgtaccctgtcccctactaccgtgcgtctcgtcctcgtggtcnccctcactcgtagttggttcgttttcgtcggtcggggtccgttccggggtaccgcgtacgtcccggtccggaaggggtaacgggtcgtaggtaacgttaacgtagttaggtaagttcgttccgtcgtactaaggttagggttacggtacggtttaccttaacgtttaaccgtaccgttacccgttcgtacgttaacgaaaggtacggtaccgtaccgttaccgtaaacccgtattacgttaccgttacgtacggtaacccgtacccgtacctaagtaacctaacgttccgtttaacgttttacccgtaagtaacgtacgttcggttacggttacgttcggtaccggtacccgtcgtacgttacggacggtttaccgggttaattttacgttacggttaggtacggtacggtaacggtacggtaaccgtttagtttaacgttacggttttaggtttagggtttttaggttaacggttttaccgtttaacgttacccgttacgtaacccgttaggtacccgggttaccgggtaacccgggggttccgttacccccgggtaccgggttaccggggaacggttaaaccggttaaacccgtttccggtacccgggtttaacccgttaccccgggtttaacccgtttacccgttaacccgggtcccccgttaaaccccgggg

SEQ ID NO: 139723 - DNA, 804 bp, Homo sapiens
  misc_feature: GYAE6OF01BCOJW.46.67.G01.1.454.CMB.1.raw
  modified_base (368)..(368): a, c, t, g, unknown or other
  misc_feature (368)..(368): n is a, c, g, or t
tcagactagcagtacacgaccggtgctcgatttagagtatacatattgggtttggggagtctcggtcaggacacagcatggacatgagggtccccgctcagctccgtggggctcctgctactctggcctcggaggtgccagtatgtgaccatcgagctcgacccagtcctccacttccctccctgttctacgccgtaaccgggtgggacacgtagttcgtaccaacctattaccgtacgttcgggacccgggaactaacgggtaccggaactacgttcgaaccttaactttaagttttaaagttggtaactacaaactagtaacggaccggacgggtaccgaccctagtcctaccttatcttacgtcncgtcacctactccgtagttacgacgtacggtccggtaccctaggttacggacggtttgaacgggtcgtacgtagggtacgtcgttacggacggtacgtaacgtttccttcgaccttccgtaacctactactacgtaccgttacttacgtacggtaccgtaggttaacggtatttacgtttacgttaacttacgtttattaaccggttactaacgtaaacgtttaactaaccgtttaacgttaacggttttccgggttaaccggtaaccggtaaacgtaccggtaaaccgttaaccgtaaaacttaaacggtttaacgaacggtttacggtaattccgggtaaccctacgttaaccgttaccgtttaccgttagtttccccttaacgttaccctttacccgttccctaacccgtttaatcccggttaaagttacccg

SEQ ID NO: 139724 - DNA, 716 bp, Homo sapiens
  misc_feature: GYAE6OF01A6JOQ.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagacccctgtccctcacctgcgctgtctctggtgcctccatcagtgtcggtttcttcgtggggctcgggtccggcacgcctccgaggggagggctaggaactacgtagttggaagtgtctctcagtggtggtacgttcctattacacgtccgtctctacgaagcgtcgagtcaacctattactctcgtacggacaccgtccagctaacttcttacgttttccaggaactgtagtacgttcgtgtacgacccgcgacgtacgacggtaccgggttacttttaagttcgtggtcgacggagtacggtacgttactttaacgttagttacgtttaaggttttgggtacgttttaggtttaacgttaccgaaccgttaacccggtagtacggttaccggggccgggtaacccgtcccgggaaccccgggttggggacccgtaaggggttaacgttacccgttcgggtaccgtacccgttccgttccgttaccgccctaacccgaccggtaaccggccttacggttccccggtccctttccccgcggttaccccacccttccgaacccgtagcccgtacccg

SEQ ID NO: 139725 - DNA, 949 bp, Homo sapiens
  misc_feature: GYAE6OF01CA163.46.67.G01.1.454.CMB.1.raw
  modified_base (219)..(219): a, c, t, g, unknown or other
  misc_feature (219)..(219): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggtcccttcggacgaccctgtcccctcaccgtgcgcttgtctcgtggtcncctcatcgagtagtggtttctcgtggggctgggtccgcagcctaccgagggaagggctaggaatacgagttggtaagtcgtctctcacgtaggtggtacgtttcctattaccgacggttcccgttcttaccgtacgtaacggtacggttccgtaacgtacctaaccctagttaaccgtttccgttcggttaacggaacccgtaacccgttacccgaaacgtaccgtaaacgtttcccgttaaccgttttttaccccgaaggttaacgtacgttacggttacggtttaccgtacggtacccggtaaccccggtcccggtaccgttacggtaacccgggtaccggggtttaacgtttttaaccgttacggttcgggtacggtacggtaacggtaacgggtaccggtttaaccgtttaagtttacgtttacgggttttaacggttttttacggggtacgggtttttaacgggttttttaacccgttttacccgggtaaccccgttaaacccggttaagggttacccgggtttaacccggggggtaaacccggggggttaccccctttaacccccggggggtaaccccggggtttacccggggggggaacccgttaaaaccggggggtttaaacccgttacccggggtttacccgggttacccccgttaaaccccggtttttacccggtacccccgggttttaaaccgcccccccgggtttaaaacccccgggg

SEQ ID NO: 139726 - DNA, 699 bp, Homo sapiens
  misc_feature: GYAE6OF01BTUBV.46.67.G01.1.454.CMB.1.raw
  modified_base (197)..(197): a, c, t, g, unknown or other
  misc_feature (197)..(197): n is a, c, g, or t
tcagactagcagtacacgaccggtgctcgatttagagtatacatattgggtttggggagtctcggtcaggacacagcatggacatgagggtccccgctcagctcctggggcctcctgctactctggctccgaggtgccagatgtgacatcgagctgacccagtcctccatccctccctgtctgccaaccggtggganacagtctaccaccagtcacgttcggccgggacaacggtcgaactagttacgaacctaacctttatttaaagtggtataccaacagtacgaccgaacgggacccgccctaagtcctacctaatcctagtgctgactactacgtagtttacgacggtaacggtcgggtcctagtcggtagttcgagtcgtacgtggtagtagtcgtggaacgtgttacttcgtacctctaccacgtaacgtacgtacgttaactacgtcgtacgtaacgtagtaacgttactttacgtactttaacctttacgttacgttacgtaacctaacgttaacgtaactttaacgtacgtttacggtttaaccggtaacggtaacggtaacctaacgtaacctaaacgtaaacgttaaacgtacttaggtacgtaccgtacgtaacctaccgtagttacttccgttacccttacgttacccgtttccccggtaccccttacgtacttgtacgttaaccg

SEQ ID NO: 139727 - DNA, 725 bp, Homo sapiens
  misc_feature: GYAE6OF01B5X6J.46.67.G01.1.454.CMB.1.raw
  modified_base (206)..(206): a, c, t, g, unknown or other
  misc_feature (206)..(206): n is a, c, g, or t
  modified_base (241)..(241): a, c, t, g, unknown or other
  misc_feature (241)..(241): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggacgaccctgtccctcacctgcgctgtctctgtgcctcatcagtgtggtttctcgtgggctgggtccgnagctccgagggagggctaggaatacattggaagtntctctcgagtgtggtacggttcctattacacgtccgtctctacgaagtagtcgagtcaccattactctcgtggaccacgtcagacaatctacgtttccagaacgtgtagtagttcgtgtcgaccgcgactggacgtacgggttacgtttagttacgtggtgacgagtacggacgtcgttaagtttacgtggttaagttttgggtagtttacggtttactttacggtaacccttacccgtagtaccggttacggggacccgggtaccgttaccccggtacccgggtacggggtacccgtaacggggtaacgttaccgttacgggtaccccttaccggtccctttacccgttaccgacccccgttaacccggtaaccccggtaacgggtacccccgtaacggtttccccgggttcccccgttaccccccgttcgggtacccccttaccccgtaccccgtaacccgtaaaccggccgtaacccccgg

SEQ ID NO: 139728 - DNA, 782 bp, Homo sapiens
  misc_feature: GYAE6OF01EJ89A.46.67.G01.1.454.CMB.1.raw
  modified_base (265)..(265): a, c, t, g, unknown or other
  misc_feature (265)..(265): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggccttcggagaccctgtccctcacctgcgctgtctctggtgcctccatcagtgttggtttcttcgtgggcgtgggtccggcgacgccgtacccgaggggaaggggcgtaggtaatactagttaggaagtgtctntccccagtacgtggtacgttcgtattacacgtccgtctctacaagacgtcgagttacaccatatcgtctggacacgtcacgacaactcgtacgttttaccgtagaacgtatgtacgttcgtgtcgtacccggcgtcgtacggaacgtacgggtacttttagttaacgttggtacggcggtaacggaacggtaccggtattaagtttaagtaggtttagttttagggtaggtttacggtttaacgttaccgtaaccctaaccgtaggtaccggttaccggggaccggggtaccctaccgggtaccccggtacgggggtaccggaacggggtaaacttacgggttacgggtacccgtaacccggttcccttaccggttaccgtcccctaaccccggtaacccgtaaaccggggtacccccgttaacggttcccccggttaacccctttcccccgggtaccggtaccccttaaccccccgtacccccgttaaccgtaaacggtaccccgtaacccccggg

SEQ ID NO: 139729 - DNA, 906 bp, Homo sapiens
  misc_feature: GYAE6OF01BSWRK.46.67.G01.1.454.CMB.1.raw
  modified_base (212)..(212): a, c, t, g, unknown or other
  misc_feature (212)..(212): n is a, c, g, or t
  modified_base (239)..(239): a, c, t, g, unknown or other
  misc_feature (239)..(239): n is a, c, g, or t
  modified_base (722)..(722): a, c, t, g, unknown or other
  misc_feature (722)..(722): n is a, c, g, or t
tcagactagcagtacacgaccggtgctcgatttagagtatacatattgggtttgggggacctcctgtgcaagaacatgaagcacctgtggtttgtcctcctgctggtggcagcctcccagatcgggtcctgtcccgtgggtgcaactgcgagggacggtccgggacccacgacgtgggtacgacggtccgttcgggacgtccctcgtccccncaccgtggcctcgtcgtctcgtggtcnccctcatcgtaggtttggttcggtttccttgggtcgggggtcgttcggggacccggctacggcccgtaccgggaaggggacgggtcgtaaggtaactagtaggttacggaagttcgtcttacgtactaggttacgggttgggtaccgtttaccgttaacgttccggtaccggttcccttacgttaccgtaacgaaacggttacggtaccgtaaccgtaacctaacccggttaagttccttacccggttacggtaacccggtaacccgtaacccggtaacgtaaccgtaacctttaaccgttaccgttttaccccggtttaccggtaaggtaaaaccgttaggttcggtttaacgttttccggaccgggttacccggacccggtaccggttacggtaaccggtaccgggttaccgggtttacgttttaacggttcgtacgggtacggtaacggtaggtaaccggtacgtttatttaacggtttnttaagggttttaggtttacggtaggtttaccgttaaccgttcccgaaccgtaacttggggacccgtaccgggggtccggtacccggtacccgggtcgggttacggggacggtaaacggtaccggtttaccggcccggttaaccgtaccccggttatacccgtacccggttacccaaaccccggg

SEQ ID NO: 139730 - DNA, 804 bp, Homo sapiens
  misc_feature: GYAE6OF01DRL7S.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtccgggcccacgactgggtgaggcccttcgggagacccctgtcccctcacctgcgctgtctctggtgccctccatcagtagttcggttttcttcgtggggctcgggtccggcacgcctcccggaggggaaggggctaggaatacgtattgggaagttgtctctcatagtggtacgttccttattacacgtccgtctctacaagtagtcgtacgtccaccattacttccttcgtacggacccaccggttccacgtactaacttccgttaccgtttttccccaaggtaagtagtttacggtacgtttcgttacggtcggacccccggtccgcgttaaccggaaccggtaccggggtttacctttttaacgttacgtaggttacggaacgggtaggaaccggtacgggttactttaagttttagttacggtttttaggtttttacggggtagttttacgggttttaactttaccggaacccgttaacccgtaggtaccggtaccggggaccggggtcccgtcccgggaccccggttggggacccggtaaggggtaactcggttaccggtcctacccgttccgttccgttacccgcccgttacccgaaccggtacccgggtacctaccgttcccccggttccccttacccccggtcggtaccccctaccctacccgtaaccgtacggccctacccggg

SEQ ID NO: 139731 - DNA, 702 bp, Homo sapiens
  misc_feature: GYAE6OF01CY0FA.46.67.G01.1.454.CMB.1.raw
  modified_base (164)..(164): a, c, t, g, unknown or other
  misc_feature (164)..(164): n is a, c, g, or t
  modified_base (248)..(248): a, c, t, g, unknown or other
  misc_feature (248)..(248): n is a, c, g, or t
  modified_base (276)..(276): a, c, t, g, unknown or other
  misc_feature (276)..(276): n is a, c, g, or t
  modified_base (334)..(334): a, c, t, g, unknown or other
  misc_feature (334)..(334): n is a, c, g, or t
  modified_base (437)..(437): a, c, t, g, unknown or other
  misc_feature (437)..(437): n is a, c, g, or t
  modified_base (625)..(625): a, c, t, g, unknown or other
  misc_feature (625)..(625): n is a, c, g, or t
  modified_base (636)..(636): a, c, t, g, unknown or other
  misc_feature (636)..(636): n is a, c, g, or t
  modified_base (662)..(662): a, c, t, g, unknown or other
  misc_feature (662)..(662): n is a, c, g, or t
tcagactagcagtacacgaccggtgctcgatttagagtatacatattggggtttgggggagtctcggtcaggacacagcatggacatgagggtccccgctcagctcctggggctcctgctactctggctccggaggtgccagatgtgacatcgagctgaacccngtcctccactccctccctgtctcgaccgaaccggtgggacgacagtcgtaccaccatctacttcggccggacaagtcggaactntacgactactatttaatcgtaactcaanagtacgaacccggaagggtaccgaccctaagtcctaacctaattcctagtcggctacncgtacttcccgtagttcgaacgtaagggtcccgggtaccagtccggtaggttccgaggttcgaggttcggtaggtcgtaccgtagggactacgtactttaccnccgtactccgtaccgaattcgtaagtacgtccgtagaaccgtaaggttacgaatttggtttaccaacgttaaccgttacgtttcaacgtacaaacgtaattaacgttactaagtttcgttaacgggaaccgtaacggtactaaaccgtaacgttaaataaacgttacggtaacttggtacccgggtanccggtaaaccnccttattaaccgtcgtttaacccttntacccgtttcctaccccgtatacccgttgtaccttaacgg

SEQ ID NO: 139732 - DNA, 741 bp, Homo sapiens
  misc_feature: GYAE6OF01CABEG.46.67.G01.1.454.CMB.1.raw
  modified_base (197)..(197): a, c, t, g, unknown or other
  misc_feature (197)..(197): n is a, c, g, or t
  modified_base (545)..(545): a, c, t, g, unknown or other
  misc_feature (545)..(545): n is a, c, g, or t
  modified_base (731)..(731): a, c, t, g, unknown or other
  misc_feature (731)..(731): n is a, c, g, or t
tcagactagcagtacacgaccggtgctcgatttagagtatacatattgggtttggggagtctcggtcaggacacagcatggacatgagggtccccgctcagctccgtggggctcctgctactctggctccgaggtgccagatgtgacatcgagctcgacccagtcctccactcctccctgtctgccaaccggtgganacagtcgtacacatctacgttcggccgggacaagtacggaactattagacctaaccttaatttaaaacgttggttaatactaaacaagttaaccgacccggtaagggaacccggtacccgtaaagtccctaccgttaaattccgtaatcggtcctacggacctaactttaccgtaagttttacggacgtaaaaggggttccgggtacccctaaggttccggtaacgggttacgaagggttcggacgtaagggttacgtacgttcggtaggggaactaaggttcctttacacttcctacaacgttataccgaagttacttccgtagaccgttaaacgttaggtaaattntttacggtaactttaactttaacgtttacttaacggtaactaaactaacttaaactttaacgttagtttaccgttaccggaacgtaaacggaacctacgaaacttaaacgttaaacgttaacgactttagggtccgacttaacgccgtaactacttcgtcttacttcctacgttcctaccacttanctagtaaccg

SEQ ID NO: 139733 - DNA, 552 bp, Homo sapiens
  misc_feature: GYAE6OF01A0ZNP.46.67.G01.1.454.CMB.1.raw
  modified_base (192)..(192): a, c, t, g, unknown or other
  misc_feature (192)..(192): n is a, c, g, or t
  modified_base (216)..(216): a, c, t, g, unknown or other
  misc_feature (216)..(216): n is a, c, g, or t
  modified_base (226)..(226): a, c, t, g, unknown or other
  misc_feature (226)..(226): n is a, c, g, or t
  modified_base (330)..(330): a, c, t, g, unknown or other
  misc_feature (330)..(330): n is a, c, g, or t
  modified_base (341)..(341): a, c, t, g, unknown or other
  misc_feature (341)..(341): n is a, c, g, or t
  modified_base (354)..(354): a, c, t, g, unknown or other
  misc_feature (354)..(354): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccggnaagtcgaacnttgactactatttaaatggtatcgaacatacgacaggacgccctaagctacctatctatgctgcatcctagttgacaagtcgggtccagtcgagttcaggtgcngtgatgagganagtattacacgtntacactatctaagtatctgacacgtagagtattagtactaacttatactagtactaactaagtaactacgtaagttcgtttacggaccgaacggaactacgaactaaactaaataaacgtagtagtaggtctaggtacctacgtaatcttcgttccgttactacgttccctacccggtacctacgttctacgttaacg

SEQ ID NO: 139734 - DNA, 866 bp, Homo sapiens
  misc_feature: GYAE6OF01BSFZH.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccagactggtgaggtccttgggagaccctgtcccctcaccgtgcgtactgtctacgtggtcgcctccgatcaaggttacggttcggtttccttcgtgggggccttggggtcccgactacggcctacccggaggggtaacgggtcgtaggaactacgtagtttacgggaagttcgtactcgtacgaagttacgggtggtacggtttcccttaaagttaccgtaacggtttcccgtctaccgtacgaaacggtaccgttaccgaacggtccaacccgtaattaccgttacgtccgttagggaacctaccgggtcctaaggtaccgtaaacttccgttaacggtttttccccaaggtaactacgtttcggttacgtttaccgttacggtaccggtacccgtacccggtacgttacgggtaaaccggtacgggtttacgttttaaaccgttacgttgggtaaccggtacggttaaaccggacggttaaccggtacgtttaacgttttaacggtaccggttttaaggttttttaccgggaaggttttacggttttaaccgtttaacgggaaccccgttacccggtaaggttacccggtaccggggttaccggggtcccgttacccggtaacccggtcggggtaaccggtacgggtacgttaaccggtccggttaccctaccggtacctttccggttaccgccccgttaaacccgg

SEQ ID NO: 139735 - DNA, 632 bp, Homo sapiens
  misc_feature: GYAE6OF01B7J3W.46.67.G01.1.454.CMB.1.raw
  modified_base (193)..(193): a, c, t, g, unknown or other
  misc_feature (193)..(193): n is a, c, g, or t
  modified_base (478)..(478): a, c, t, g, unknown or other
  misc_feature (478)..(478): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgtcaccatcacttggaccgggacaaaggtcggaaactagttcgaactaccttaattttaaacgtggtatacaacagtagaccgagggaccggccctaagcctacctaagtactagtgacttgcctactcctagtttagaccgaaaggtcggggtacccagtacggtaggttacgaggtggcgtaggtagtactacgtagggactagtactttacgacttctacaccgatacagtaatctagactaacgtagtaattagttagactaactttagtacttanactaaatactaattactaattacggtttacgaccgtaacggaactacgtaaactaaactaaacgtaaacgtactaggtacgtaccgtagacctaaccgtattccgttacttaccgttactacgttcccttaccccacgtacttcgacgttaacg

SEQ ID NO: 139736 - DNA, 892 bp, Homo sapiens
  misc_feature: GYAE6OF01EODYD.46.67.G01.1.454.CMB.1.raw
tcagactagcagtacacgaccggtgctcgatttagagtatacatattggggtttgggggacgtctcggtcaggacacaggcatggacatggagggtccccgctcagctcctggggctcctgctactctggctccgagtcgccgagactgtgacatcgagctcgacccagtcctcctactccctcccgtgtctgccgtaccggtgggagacgtacggtcgtaccacctactaccgtacgttcggacccgggtacaacggtaccgggaactagttacgaacctaccttaattaaagttacggtaatacaaaccgtagttaacggaccgtaacggggtacccgtaccctaaaggtcctacccgttaatccgttagtccgcgttcgtaccacgttccgtaggtttacgaacgtaagggtccggacccttaggtacggtaccgtacgtcggtcggactaggtagacttcggtaacggaccgttaaggttcccttaccgtacccttaaccttcgtaaaccttacgtacccgtaagttaaccttaccggacgttaaccggtaaggtttaacggtaaagttttaccgtttaaccgtaacgtttaaccctttaacgggttaccttaaccggtaaacgtaaacccgggtttaaacgtttaaaccttttaaacccgttaagttttacccgggtttaacccgggtaacggtaaaccggtaccggtaaaaccttaaacggttaaaacgtttaaaacccgttaaaccggtacggttcggtaaccggttaccttacccggaaccggtttaaccgtaacgtttacccgggttctttaaaaccccgttcttaaccccgtttccccggttaccccgtaacccggtttcttaaaccggttccggttaaacc

SEQ ID NO: 139737 - DNA, 664 bp, Homo sapiens
  misc_feature: GYAE6OF01DBWLK.46.67.G01.1.454.CMB.1.raw
  modified_base (278)..(278): a, c, t, g, unknown or other
  misc_feature (278)..(278): n is a, c, g, or t
  modified_base (465)..(465): a, c, t, g, unknown or other
  misc_feature (465)..(465): n is a, c, g, or t
  modified_base (626)..(626): a, c, t, g, unknown or other
  misc_feature (626)..(626): n is a, c, g, or t
tcagactagcagtacacgaccggtgctcgatttagagtatacatattgggtttggggagtctcggtcagggacacagcatggacatgagggtccccgctcagctcctggggctcctgctactctggctccgaggtgccagatgtgacatcgagctgacccagtctccatcctcctgtctgacaaccggtggacacgagtcgccacatctacgtggaccggacaacggtacggaactattacgactaaccttaattttaagttaggtactacaacgtanaacgaaccgacggggacccgtaccctaagcctactaactctatacgcttagactacttcgttagttacgaacggtaacgggtcgggtaccctagtccggtaggttactaggtacggctaggtaggtacgtacgtagggactagttaccgttaccaccgtcctaacctactaacgtactaagttactntacggacgtaacgttaagaatttctttaacgacttaactttacttactacgtaactaataacgttaaatttctaaggttttcggtaccggaactaaggtaacctagtaaataaacttaaacgtacgtaacgtagttacgattccgaacctctagttacctntacccttactacgttccctaaccgtcagttcgtcgtac

SEQ ID NO: 139738 - DNA, 851 bp, Homo sapiens
  misc_feature: GYAE6OF01D4QP6.46.67.G01.1.454.CMB.1.raw
  modified_base (557)..(557): a, c, t, g, unknown or other
  misc_feature (557)..(557): n is a, c, g, or t
tcagactagcagtacacgaccggtgctcgatttagagtatacatagtttggggtttgggggagtctcggtcaggacacagcatggacatggacgggtccccgctcagctccgtggggctcctgcctactcgtggctcggaggtcgccagtatgtagacagtcgagtcacgaccctagtctccacctcctccgtagtctgaccgaacggtgggacgacgtagtcgaccacctacgttactacgttcgggaccggtacgtaaacggtaaccggtaaactacgttacgtaacccttaacctttaaagttttaaacgttaggtaactaacgaaaccgtaacggtaacggaaacccggtaacgggggaaccccgtacccgttaacgtacttaacccgtaagtaccttaacggtcgacgtacgacctacgtacctaggtacgtaagtaacgggtcgtaaccacggttcggaaggttcgaagggtcgaggtacggtagtacgaggttacggaacttaacttcgtttacgacctacctaacgaacttacgtacgtaaacgtttancgtaaccgtaaagttaacggtagtaaacgtttactccggtaaacctttaattaacggtaccttaacggtaaacctaagtaaagtttaaaccgtttacttaaccgggtttccggttaaacccggaaggaaccgttaacgtaaaaccctaagtttaaaacggttaaaaccgttaacggagtttcccggaagaaccttaccggaaacttcccggaagtttacgtttccccgggtaatttcccgttaaccccggtaccccgtacccggtaactatttaacccccgggtattaacccgg

SEQ ID NO: 139739 - DNA, 664 bp, Homo sapiens
  misc_feature: GYAE6OF01ENKPN.46.67.G01.1.454.CMB.1.raw
  modified_base (209)..(209): a, c, t, g, unknown or other
  misc_feature (209)..(209): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggccttcggagacccctgtccctcacctgcgctgtctctggtgcctccatcagtagtgtttctcgtgggctgggtccgnagcctccgagggagggctggaatacagttggaagtgtctctcatagtggtaggttcctattacagtccgtctctacaagagtcgagtcaccatatctctgacacgtccagcaatctacgttttcccagaagatgtagttctgtcgaccgccgctgacgtacgggtcgttttatacgtgtgacgagtagacggtcttattagttgttaagttttggagtttggtttacgtttcgaaccctaccgtacgacgtccggggaccggggtcctacccggaccccggtggggacccgaagggtaacgttaccgttcggtcccgtacccgttccgttacccgttacggtccccttacccgaaccccggaaccgggtcccctaacggttcccgggtacccccctttccccgccggtacccctaccccccgttacccctacccgtaaacggaccgtacccccgg

SEQ ID NO: 139740 - DNA, 925 bp, Homo sapiens
  misc_feature: GYAE6OF01CHYO4.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctcgtggtcgcctccatcagttagtggtttcttcgtgggctgggtccgcagcctacccgaggggacgggctggaactacgtagttagggaagttcggttcctacgttccgtaagttacgggttcgggtacgggttttaccttaacgtttaaccgacggttcccggtttaccttaccgttaaccgtaaaggtacggttaccggtaacgttacccgtaaccctaagtttaaccttaccgttccggttacgggaaaccctaccggtttccccgaaacggtacccgtaaaactttccgtttaacccggtttttttacccccgaagggtaaaacgttacgtttacgggtaacgtttttccggtagggttcccggaaccccgggtcccgtacgttaccggaaccgggttacccggggtttactttttaaacggttcgttacgggtacggtacgggtaacgtaacgggtaccgggttctttaacgtttacggtttaggttttacggtttttagggtacggttttacggttttacggtttacccgtaaccgttaacccggttaagtacggtacccgggggtaccgggtccgtttacccgggaccccggttacgggggaccgtaacggggttacttaccggtcggttaccccgtccgttaccgttccgttaccgtaccccgtaccgtaaccggtaccgggtccctaccggttcccgttcccgttacccccgtcggtacccctccccgtacctaccgtaacggcgtaccccg

SEQ ID NO: 139741 - DNA, 779 bp, Homo sapiens
  misc_feature: GYAE6OF01D2VK8.46.67.G01.1.454.CMB.1.raw
  modified_base (200)..(200): a, c, t, g, unknown or other
  misc_feature (200)..(200): n is a, c, g, or t
  modified_base (235)..(235): a, c, t, g, unknown or other
  misc_feature (235)..(235): n is a, c, g, or t
tcagactagcagtacacgaccggtgctcgatttagagtatacatattgggtttggggagtctcggtcaggacacagcatggacatgagggtccccgctcagctccgtggggctcctgctactctggctccgaggtgccagatgtgacatcgagctcgacccagtcctccactccctcctgtctgaccgaaccggtggganacaggtcgtaccactatccacgttggacccggganaacggtaccggaactagttacgacctaactttaagttttaagttcgtatacaaactataacgaccggacggggaccgtaccctaagccttaccgttaaactctaatcgtactgtacctacttccgtagtttcgacggtaaggtccgggtacctagttccggaaggtttcagggtacgcgtaagggtcggtagtaccggtagggtactaaggttactttacgaccgtttccactaacctagttacgttaacgtaacgttcctacggtaaccttaacggtaacgtaacgttttacggtttaactaactttaaacgtttagtttaaccgtacgtaaacctaaggttaaacttaactttaaccgttaacggtttttacggtttaccggaaccgttaaacgggaacttaaaccgtaaacttaaaacccgtaaaagttaaccggagttaccgggtaatcccgttaaggaccctaaacgttctttaccgttttacggtccctttactacccgtttaccccgttaccaccctttagttaccttggttaaacc

SEQ ID NO: 139742 - DNA, 887 bp, Homo sapiens
  misc_feature: GYAE6OF01BBTV4.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccactcctccctgtctgaccaaccggtgggagacagtcgtaccacctatctacgttcggccgggacaaggtcggaaactatttacgacctaacctttaattttaaagttggtaatacaaacgtaagtaacgacccggaacggggacccggacccgtaacgtcctacctaatactatcgctcgactactccgtaggtttgaacggtaaacgggtcggggtacccctaagttaccggtagggtttaccgtaaggttcggggacgttaaggggttacggtacgttacggtacgggggtaaccttaaggttaaccttttcctaaacccgttctaacccctaaaccctagttaaccgtaacgtttaaacctcgttaaccggtaaccgtaaacgggttaacgttaaaggttttaacttttacggtaaaccctttaaaactttttaaccgtttaaccgttaacggttaaacctaaacgtaacgtttaaacgttttaaacccgttaacgtttttacgggtttaacccggaacccgggttaaaggtaacccgttaaaccgttaaaaccttaaaacggtaaaacctttaaaccggtaagttaccgggtaacggttacctaaccggaaccttaaaccgttaacgttccgtttaaccggtttacctttaacccgtaccgttttaacccccggttccccgttaaccctttacgttaccccgttaaggtttaaccgg

SEQ ID NO: 139743 - DNA, 692 bp, Homo sapiens
  misc_feature: GYAE6OF01AP8Q0.46.67.G01.1.454.CMB.1.raw
  modified_base (292)..(292): a, c, t, g, unknown or other
  misc_feature (292)..(292): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccggcagctcccgaggggaacgggctggaatacgattggaagtgtctctcataggtggtaggttcctattacagtccgtctctcaagngtcgagtcaccatactcgtctggaccacgtccagtccaaattctaacgttttcccagaagtactagtacgttctaggtccgacccgccgtactggaccgtacgggttacgttttaagttacgttggtcgacggagacggtacggtcttaatttagtagttagtttttaggaggtttggtttacgtttcgaacctacccgtagtacgtacgggacggggtaccgtacccggtaccccggtcggggacccgtaaggggtaaacgttaccgttcggtacccgtacccggttccttcccgttacgcccgttacccgacccggtaaaccgggtcccctaacggtccggttcccccttcccccggtacgtccccgtacccctaccccgtccaacggccgtaccccg

SEQ ID NO: 139744 - DNA, 680 bp, Homo sapiens
  misc_feature: GYAE6OF01AW5ZV.46.67.G01.1.454.CMB.1.raw
  modified_base (220)..(220): a, c, t, g, unknown or other
  misc_feature (220)..(220): n is a, c, g, or t
  modified_base (263)..(263): a, c, t, g, unknown or other
  misc_feature (263)..(263): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtccacatcacttggccggganaaggtcggaacattcgactaccttatttaaagttgtatacaanatagaccagggaccgaccctaagctacctatctatcgctgcactaccgtagtttacgacgtaaacggtcgggtaccctagtcggtaggttcaggtggactaggtggtactcgtaggactagtactttcacctctacacctatcgaattactctacgacgtaacgttgtaaacgttacgtttagaaccttaaactttaactttaccgttacgtaacctaaagttaacgttaaacgtttacgtaaacgttttccggtttacgggaacccgtaaacggggtaactaacccggttaacttaaacgtaaacgttaacgaacggttacgtacggtacgtaccgaaccgtacctagttccttacgttacccttaaccgtaccgttttaccccgtaccccgtacttacgttcgtacggttaaccg

SEQ ID NO: 139745 - DNA, 689 bp, Homo sapiens
  misc_feature: GYAE6OF01BQ0AG.46.67.G01.1.454.CMB.1.raw
  modified_base (121)..(121): a, c, t, g, unknown or other
  misc_feature (121)..(121): n is a, c, g, or t
  modified_base (406)..(406): a, c, t, g, unknown or other
  misc_feature (406)..(406): n is a, c, g, or t
tcagactagcagtacacgaccggtgctcgatttagagtatacatattgggtttggggagtctcggtcaggacacagcatggacatgagggtccccgctcagctcctggggctcctgctacnctggctccgaggtgccagatgtgacatcgagctcgacccagtctccactccctccctgtctgcgaaccggtgggagacgagttcgtaccaccaacttccacgttcggaccgggactaaacggtaccggaactagttacgaacctaacctttaatttaaaagttggtaactacgaaactagtaacggaccggacgggtacccgtaccctaaaggtccttaccgtaatctagtacgctgacctatccgtagttagacgtaaaggtcgggtaccagtcggtacgtcgnggtcggagagtggatcggaggactagtacttacgactcctaactacctagtatacgtaagtcgtaacgtaacgtaaggtagttaaattcgtttaacgacttaacgttattcgagtaacaacgtaattaaacttacgtaacgttttcggtacgaacggaacgtaacctaagtaaaaccttaactaaaacggttaaccgtacgttacggtacgtacgttccacctaaccttagtacgtcccttaggttacctacgttcccgtacccagttacttagcgttaaacg

SEQ ID NO: 139746 - DNA, 641 bp, Homo sapiens
  misc_feature: GYAE6OF01DQ0FH.46.67.G01.1.454.CMB.1.raw
  modified_base (424)..(424): a, c, t, g, unknown or other
  misc_feature (424)..(424): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctcctgtctgcaccgtgggagacagtcgtccaccatcacgttcggccgggacaaggtcggaactattgacacctatttaaatggtatcaacatacgaccgagggaccgccctaagcctactaatctatgctgctatcctaggtttcgacgtaaggtccgggtccagtcgtaggttcagtggcaggtgatcggtggactagtacttcacttcctacaacctactactagtaactcgtgactaacggtagaagttntttacggactttaacttattacgttagtaacgtaacttagtaaacttactaagtttcggtttacgaaccgtaaagggaacctaacgtaaccttaaacgtaaacgttaacgtaacgttagttacggtacctaacggtacctaaaccgtagttaccgttacgttacgtttacctaccgtttacccggtaacccctccgttaacttccggtagttaaccg

SEQ ID NO: 139747 - DNA, 862 bp, Homo sapiens
  misc_feature: GYAE6OF01DA7BP.46.67.G01.1.454.CMB.1.raw
  modified_base (420)..(420): a, c, t, g, unknown or other
  misc_feature (420)..(420): n is a, c, g, or t
tcagactagcagtacacgaccggtgctcgatttagagtatacatattgggtttggggggacctcctgtgcaagaacatgaagcacctgtggtttgtcctcctgctggtggcagcctcccagatgggtcctgtccctggtgccaactgcaggagtccgggcccacgacgtggtgacggtccttcggagaccctgtccctcacctgccgctgtctcgtgggtcgaccctccatccgtaggttaggttcggttttccttcgtggggggtccttacggggggtcccggctaacggtccccgtacccggaaaggggggtaacgggggtccttaaggggaaaacttaccggtaagggttttagggaaagtttcggtccttacgtacagtttacgggtcgggttaaacggtttccttaacgtttaancccggttaccgttactcacgtaaaggtcgtaccggtaactacccaactacttacttccttcggtaccgggaacctccgtacaacgtacctaacgttccttaccggttttcccaagggaacttaacgtcggttacgttaacgtccggtcccggtaaccccggtccgtaacggtaccggtaccggttaacccggggtttaacgttttacgtttaccgtgggttacggacgtagggtacggtaacgtactttacgttaagttgttttaaggttttacgggtagggttttacgttaccggtttaccgaccgtaccggttagaaccgggttcccggggaccggggttacctccccgggaaccccgggttgggaaccggtaggggtaaaccttaggtaccccggtccgttaacccgttcccttaccggttacctccccggtaaacccg

SEQ ID NO: 139748 - DNA, 873 bp, Homo sapiens
  misc_feature: GYAE6OF01ESSGG.46.67.G01.1.454.CMB.1.raw
  modified_base (445)..(445): a, c, t, g, unknown or other
  misc_feature (445)..(445): n is a, c, g, or t
tcagactagcagtacacgaccggtgctcgatttagagtatacatattgggtttgggggacctcctgtgcaagaacatgaagcacctgtggtttgtcctcctgctggtggcacgcctcccagagtcgggtccgtcgtcccgtggtgcaacgtgcgaggacggtccggcccgacgtacgtggtgacggtccgttcggacgtaccctgtcccctcaccctcgcgtctcgtcgtctcggtcgcctccatctagttagttcggtttccgtttccgttcggggtccgtcggggtccgggccgtacggccgtacccgaggggtaacggggcgtaggtaagtaacgtaagttagggtaagttacgtcgtacgttaccgtaagttacggttacgggtaggttaccccgttaactttaaccgtaacggttacccggttccgttaccgttaccgtnaaacggtaacggttacggtaacggttaccgtaaccgtaacgttaaacttcgttaccgttacgggtaaccgtaaccggttacccgtaacggtaccgtaaacgttacccgtaacggtttttacccgttacggtaacggtaacgttactgggtaacggtttacgttcggttacggtacccggtccggtaccggtacggtaaccgtaaccggggttacggtttaacgtttaccgttacggttcgtacggtacgtaacgtaacggtacgttaagtttacgtagttagtttttacggttaggttaggtttacgtttacggtaaccgtaacccgttacggtaacgttaccggtaccggggtaccggtaccggtacccggtacggggtaccggtaacgggtaacgttaccgtacggtaccgtaccggtccgtaccg

SEQ ID NO: 139749 - DNA, 697 bp, Homo sapiens
  misc_feature: GYAE6OF01A274C.46.67.G01.1.454.CMB.1.raw
  modified_base (172)..(172): a, c, t, g, unknown or other
  misc_feature (172)..(172): n is a, c, g, or t
  modified_base (206)..(206): a, c, t, g, unknown or other
  misc_feature (206)..(206): n is a, c, g, or t
  modified_base (429)..(429): a, c, t, g, unknown or other
  misc_feature (429)..(429): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggacgaccctgtccctcacctgcgctgtctctggtncctcatcagtgtgtttctcgtgggctgggtccgnacgcctccgaggggacgggtctaggaatactagttggaagttcgtcctctacattaggtggtacgtttccttaattaaccgacggttccccgttcttcgtacgaaaggtgtcgacgttaccaccgaattctccgttcgtggaccgtaccgtccgagacctaacttccgtacgtttttaccccgaagtaagtactaggtagtttccgtggtcacccggtaccgnttacggaccgtacgggttacgttttactcgtaggtcgacggagacggtacgacttagtttgtagtttagttttggtagttacgtttacttacgaccttaccgtagcgtacgggtacgggtccaccggtcccgtagggccgaaggtacgtaccggtcgtacctccgttctaccgttaccgcccaccgtaacccggccggacccgttacggtcccggttcccgtccccgtacggcccctacccctacccgtaccgaacgtcgtaccccgg

SEQ ID NO: 139750 - DNA, 716 bp, Homo sapiens
  misc_feature: GYAE6OF01AKCRY.46.67.G01.1.454.CMB.1.raw
  modified_base (168)..(168): a, c, t, g, unknown or other
  misc_feature (168)..(168): n is a, c, g, or t
  modified_base (196)..(196): a, c, t, g, unknown or other
  misc_feature (196)..(196): n is a, c, g, or t
  modified_base (199)..(199): a, c, t, g, unknown or other
  misc_feature (199)..(199): n is a, c, g, or t
  modified_base (202)..(202): a, c, t, g, unknown or other
  misc_feature (202)..(202): n is a, c, g, or t
  modified_base (206)..(206): a, c, t, g, unknown or other
  misc_feature (206)..(206): n is a, c, g, or t
  modified_base (217)..(217): a, c, t, g, unknown or other
  misc_feature (217)..(217): n is a, c, g, or t
  modified_base (225)..(225): a, c, t, g, unknown or other
  misc_feature (225)..(225): n is a, c, g, or t
  modified_base (299)..(299): a, c, t, g, unknown or other
  misc_feature (299)..(299): n is a, c, g, or t
  modified_base (645)..(645): a, c, t, g, unknown or other
  misc_feature (645)..(645): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgactatcgagctcgacccagttccnccatccctccctgtctgacacggtgganacngtncacntcactgccganagtcgaantgactacttatttaactgtatacaacagtacgaccgagggaccgccctaagctaccctatctaagtcggtcctncgacttccgtagttttcgacgtaaggtccgggttaccaacgttcggtacgttaccgaaggttcggacgtacgggttacgagttccggtaggggaactacggtttactttaccgacgttacctccgaaccttattaccgtaacttaactacgtctaacgaaccggttagtaactttacgtttcgaaccttaaagttactttacgtagtaaccgtaaataagttaaaccttaacgtacgttttacggtttaaccggaaccggtaacggtaacccgaaacgtttaacccgtaaaaaccttaaacgttaaacgtaaaccgtgttaccggaaccgtacggaccttaaccgnttttaaccgtcgttacccttaactcccgtttacccggttacccgaaatcccggttttagttaaccctacgg

SEQ ID NO: 139751 - DNA, 804 bp, Homo sapiens
  misc_feature: GYAE6OF01DDHE6.46.67.G01.1.454.CMB.1.raw
  modified_base (204)..(204): a, c, t, g, unknown or other
  misc_feature (204)..(204): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggtccttcggacgaccctgtcccctcaccgtgccgctcgtctcgtggtcgcctccatcagtagttgtttctcgngggctgggtccgcacgcctccgaggggacgggctaggaatacagttggaatcgtctctcagttacggtaggtacgtttaccttagtaccgtacgttcccgttactcgtacgaaagtcgtacggacgttaccaaccgtattacgtcctacgtacggaacctccgtaccgaagtaccttaacgtaccgttaccgttttacccgaaggtaacgtagttggttaacgtttccgtagggttcccggaacccggtcggtaccgtacggtaaacccgggtcgggtttttaaccgttttaactttaccggtcgggtacgggaaccgtaaggtaaccggtaccgggttaactttagtttaacgttcggttttaggttttaacgggtagtttacgggtttacttaccggaaccgtaccgtagtacggtacgggaccggggtcctccgggaacccggtcggggtaccgaagggtactaccgttcgtaccgtcccgttaccttccgtaaccgccccttaccgaaccggtaccggtccccttacggttccccgttccccgtttaccccgccgtacccctacccccgtccttaacccgagtcccgtaaccccgg

SEQ ID NO: 139752 - DNA, 807 bp, Homo sapiens
  misc_feature: GYAE6OF01CQDCK.46.67.G01.1.454.CMB.1.raw
  modified_base (194)..(194): a, c, t, g, unknown or other
  misc_feature (194)..(194): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgccaaccggtggganacagtctcaccatcacttggccgggacaacggtacggaactatttcgaactaaccttaatttaaacttggtaatacaaactatacgaaccgagggaccgtccctaagcctacctaagtctagtgtactgctactccgagtttagacgtaaacggttcgggtacccagttcgaggttacgaggtcggtacgagtagggtacgtacgtacggggtactaaggttaacttttccgaaactttcctaaccgtaacctaacgttactaaagttaacgtaccgttacgacccgttaaacggttaaggttaaacgttttaacgtttttaacggaaccctttaaacgttttaactttaaacgttactaaaccgtaaacgtaacgtttaaaacttttaacgtaaagttttcgggttttaaacccggaaccggttaaaacggggaaacccttaaccggtaaaacgtttaaaccgttaaaaaccgtttaaaaccggtactttaacgggtaaccgttaccggtaccgtaaaccgaacccgtttataccgtttacccgttaccgttttaccctaccgttttacccccggtacccctaccgtttaaccgtcgttaacgttaaacccg

SEQ ID NO: 139753 - DNA, 738 bp, Homo sapiens
  misc_feature: GYAE6OF01A8ES5.46.67.G01.1.454.CMB.1.raw
  modified_base (199)..(199): a, c, t, g, unknown or other
  misc_feature (199)..(199): n is a, c, g, or t
tcagactagcagtacacgaccggtgctcgatttagagtatacatattggggtttggggagtctcggtcaggacacagcatggacatggagggtccccgctcagctccgtggggctcctgctactctggctccgaggtcgccagatgtgacatcgagctgaccagtctccatcctcctgtctgcacggtggagacaggtntcaccatccacgttcggaccgggactaacggtccggaactgttacgaactaactttaatttaaagtggtaactacaactagtacgaccgtaggggacccgtaccctaagtcctacctaatctagcgactcgactacttccgtagttcgactaacgggtcgggtacccagtcggagtttcgaggtcgtagtaggtgacgttccgagggtaactaggttcttaccgaaccctctacgaaccttagtacgtaacgttactacgtcggtaacgtaacggtacgttaagtttaacgtttaccgtaacttaaaccttttagttaacctacggtaaacctaaagtaacggtaaactttaacgttacggtttaacgggtttaccgaaaccgggttacggtaaaccgaactaacgttaaaccgttaactaaacgggtattccgggtacggtaccgttacgaacccgtacgttaggttaccgttacgttacccttaccgttaacccgttaccccgtttaccccgtaacgttccttacgggtacttaacg

SEQ ID NO: 139754 - DNA, 810 bp, Homo sapiens
  misc_feature: GYAE6OF01A9FWO.46.67.G01.1.454.CMB.1.raw
tcagactagcagtacacgaccggtgctcgatttagagtatacatattgggtttggggagtctcggtcaggacacagcatggacatggagggtccccgctcagctccgtggggctcctgctactctggctccgaggtgccagatgtgacatcgagctcgacccagtcctccactccctccctgtctcgccgaaccggtgggagacagtcgtccaccatccacgttcggcccgggacaacggtccggaaactacgttcgaaccttaaccttaatttaaagttggtactacaaactagtacgaccgacgggaccgaccctaagcctacctaatctatcgctcgctactcctaggtttcgaacgtaaggtccgggtacctaggttacggtacggttacgtaggtcggtacgtaggtacgtacgtacggtagggaacctaaggtttacctttacctacccgttcctaaccgaacccgtaacgttaccgtaacgtttaactcggttaacgaaccggttaacggtaacgttaaaagtttcgttttaacggtaacctttaaaccgtttaagtttaaccttacggttaaacctaaaccgttaaagttaacgttttaacgttaaccggttttaacgggttttaacccgggaaacccgtaaacgggtaaccctaaaccggttaaaccttaaacggtaaaacttaaaccggtacgttaggtccggtaacgtacccgtaacctaacccgttattaccggtttcgttaccttaacgtaccccgtttccttaccccggaccttaccgttacgttacggttaaccg

SEQ ID NO: 139755 - DNA, 724 bp, Homo sapiens
  misc_feature: GYAE6OF01ALT0X.46.67.G01.1.454.CMB.1.raw
  modified_base (176)..(176): a, c, t, g, unknown or other
  misc_feature (176)..(176): n is a, c, g, or t
  modified_base (197)..(197): a, c, t, g, unknown or other
  misc_feature (197)..(197): n is a, c, g, or t
tcagactagcagtacacgaccggtgctcgatttagagtatacatattgggtttgtcctcctgctggtggcagctcccagatgggtcctgtccctggtgcaactgcagggacgtccgggcccacgactgggtgaggccttcggagacccctgtccctcacctgcgctgtctctggtncctccatcatgtgtttctcgnggggtctgggtccgcagtcctacccggaggggaacggggctaggaatacagttacggaagtgtacctctacattaggtggtacggttccttaacttacacgttccgtctctacgagacgtcgagtacctactatactctctacggaccacgtaccaagtaccgtaattactcgttttacccagtaacgtagtggtaacgttcgtggtaccggccgccggcgtacgacgtacgggttacgtttactacgttgtagcggaggacggtacgtcttaagttacgtggttagttttagggtagtttaggtttaacttaccggtaaccgttaacccgtagaaccggtcccggggtacggggtcccgtacccgggtaccccgggtcggggaacgtagggtaaccgttacgtacgggttcctaacccgtcttacccgtaccgacccttacccggaaccgtacccggggtactaccggttccgttaccccttccccggtcgaccccttaccccggaccttaccgaagtcgtccccg

SEQ ID NO: 139756 - DNA, 875 bp, Homo sapiens
  misc_feature: GYAE6OF01AUJFL.46.67.G01.1.454.CMB.1.raw
  modified_base (330)..(330): a, c, t, g, unknown or other
  misc_feature (330)..(330): n is a, c, g, or t
  modified_base (362)..(362): a, c, t, g, unknown or other
  misc_feature (362)..(362): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactgggtgaggccttcgggagacccctgtcccctacacctggccgctgtctcgtggtcgccctccatcaggttagttcggtttcttcgtggggcgttggggtccgcacgtccgtacccggaagggggacgggtctaggaattacgtagttagggaagttcgtcctctacagtaggtcggtacgttcctattacgagtccgtctcctanagtacgtctagtccactatactctcgcggacncggtccagtactaactcgttacgtttccgaagtaacgtattacggtagttccgtcggtaccgcccggtcgtaccgttacgaaccggtaccgggtttacttttaacgttacggtcggtacggtacggtaaggtaccgggtaaccgttattaaggtttagtttacggttttaacggttttagggtaacgttttagggttttaacccttaccggtaacccgttaacccggttaggtacccgggttccggggtacccggggtcccgttaaccccgggtaccccgggggtacggggaacccgttaaacgggggtaaccttccgggttaacccgggttacccgtacccggtttacccgtttacccggttacccggtacccccgtaccccgggtaaaccccgggtaaccgggtcccccttaacgggttttcccccggtaccccccggtttaccccccggccgtaacccccccttccccggttaaccccaaccggtaaacccgggtccccgtaaacccggg

SEQ ID NO: 139757 - DNA, 660 bp, Homo sapiens
  misc_feature: GYAE6OF01BLQPU.46.67.G01.1.454.CMB.1.raw
  modified_base (252)..(252): a, c, t, g, unknown or other
  misc_feature (252)..(252): n is a, c, g, or t
  modified_base (405)..(405): a, c, t, g, unknown or other
  misc_feature (405)..(405): n is a, c, g, or t
  modified_base (470)..(470): a, c, t, g, unknown or other
  misc_feature (470)..(470): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgacggccttcggagaccctgtccctcacctgcgctgtctcgtggtcgcctccatcagtagtcgtttctcgtggggctgggtccgnagtctccgagggaagggctggaatacagtttggaagttgtctctcagtgtggtacggtttcctagttacgacgtcgtactctacgaagacgtcgagtacactagtactcgtctacggactacgtcaacgactaatcgtacgttttccagaagngttacgagtttcagtccggaccgccgtgttacgaaccgtacgggtctttttaagaccgttggtanacggtaacgtacggaaccgggtcttaaaggtttagtacggtttagttttagggtagtttacgggtttactttccgaacttacccgtaggacgtacggggtaccgggattccccgggaccggttggggaccctaaggggtaacttccgtcggttacccgtaccgttactcccgttagcccgtaaaccccgg

SEQ ID NO: 139758 - DNA, 869 bp, Homo sapiens
  misc_feature: GYAE6OF01DMS1G.46.67.G01.1.454.CMB.1.raw
  modified_base (789)..(789): a, c, t, g, unknown or other
  misc_feature (789)..(789): n is a, c, g, or t
tcagactagcagtacacgaccggtgctcgatttagagtatacatattgggtttggggagtctcggtcaggacacagcatggacatgagggtccccgctcagctccgtggggctcctgctactctggctccggaggtgccagatgtgacatcgagctcgacccagtcctccactccctcctgtctgaccgtaaccggtgggagactagttcgaccaccatcctacgttcggcccgggactaaggtaccggaactacgttacgaacctaacctttaaagttttaaagttacggttaactacaaaacgtagtaaccggacccggtaacggggtacccggtaacccctaagtaccccttaaccctaaagttcccttaagtcggaccgttagacccttaacgttcccggttaagttttcggaaccggtaaacggggttcccggggtacccctaaggttccggtaagggtttccgagggtacggcgtaagggtcggtacgttaccgggtaggaaacccttaggttactttaccgacccgttaccttaccgaacccgtattaacggtaagttaactcgtaccgaacgttaacggttacgttaaagttttacgtttaacgtaacctttaactttacgttaacttaccgtaaactaaacgttaacgttaaactttaaccttaggtttttaccggttaaccggaacccggaaacgggttaaaccaccggttaaaaccttaaacgtaaaaacggtttaccggtaaccgttaggtacgacccgttagaccccttaaccgtntttaccgtttcctttacccgtttaccgttacctttccccccgtaaccgtttaccctaagtttcccgtaacgttaaacccg

SEQ ID NO: 139759 - DNA, 926 bp, Homo sapiens
  misc_feature: GYAE6OF01A3GF2.46.67.G01.1.454.CMB.1.raw
  modified_base (203)..(203): a, c, t, g, unknown or other
  misc_feature (203)..(203): n is a, c, g, or t
tcagactagcagtacacgaccggtgctcgatttagagtatacatattgggtttggggagtctcggtcaggacacagcatggacatgagggtccccgctcagctccgtggggctcctgctactctggctccgaggtgccagatgtgacatcgagctacgacccagttcctccacttccctccctgtctgaccaaccggtggganacgagtcgtccaccatcgtacgttcggcccgggacaacggtaccggaactagttacgaacctaaccttaattttaacgttgtaacttacaaacgtaactacggaaccgagggacccgaccctaacgccttaccgttaatccgtaatcgacgtcgactacgttaccgtaggtttacgacggtaaacggttccggggtaccctaaggttaccggtacggtttccggaagtcggtacgtaaggtaggtaacgttcggtacgggtaacgttacgtaaccgtttaccctaccgtttacccgtaacccgtaacgttaaccttaacgggtaaactttaaccgtacgttaccggttaactaaaccggggtttaagttaaacgttttaccggttttaaacgtaaccgttttaaacctttaacggtttacccgtaacggttaaaactaaaaccgttaacggtttaaaactttaaaccggtttaccggtttttaaccgggggttaacccgggtaaacccggttaaaacgggaaaccgtttaaaccccgggtaaaattttaaacccggtttaaaaaacggtttaaccgggtaaaccgttaacggggttacgtacccgttaaaacccgtaacgtacccgtttaaccgtttacccggttacggttttaacccctttaacgtacccccgttttaacccgttccccctaaaggtttaccttaacccgttagttaacccc

SEQ ID NO: 139760 - DNA, 550 bp, Homo sapiens
  misc_feature: GYAE6OF01BODOL.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccggcaagtcggaacattgactactatttaaatggtatcaacatagaccagggacggccctaagctcctaatctatgctgcatcctagtttcgcaaggtgggtcccagtcgaggttcagtggcagtgatcgtggactagattcactctcaccatctagtaatcgtagcgaacgtgaagttatttgactaacgttattacttagtactaactaagtaaacttacgtaattcggtttaccgacgtaacgggactacgtaaactaactaaaataacgtaatcgacggtctagccgtaactatcgttgtccttactacgtacccttccgactacttctgtaac

SEQ ID NO: 139761 - DNA, 539 bp, Homo sapiens
  misc_feature: GYAE6OF01BV0D5.46.67.G01.1.454.CMB.1.raw
  modified_base (191)..(191): a, c, t, g, unknown or other
  misc_feature (191)..(191): n is a, c, g, or t
  modified_base (325)..(325): a, c, t, g, unknown or other
  misc_feature (325)..(325): n is a, c, g, or t
tcagactagcagtacacgaccggtgctcgatttagagtatacatattgggtttggggagtctcggtcaggacacagcatggacatgaggtccccgctcagctcctggggctcctgctactctggctccgaggtgccagatgtgacatcgagctgacccagtctccatcctccctgtctgcaaccgtggganacagtgtcaccatcacttgccggcaagtcgaacattgacacctattaaatggtatcaacatagaccaggacgccctaagctctaatctatgctgcatccaagtttgacaagtgggtcccagtcgagtcagtggnagtgatcgtgggacagtattcactctcaccatcaagtatctgcaagtgagtattttgactaacgttattactgtactaacagtaattaactaatcgttttacgaccgtaaggactaacgtaacttaacaaactttaaacgaacttaggtacgaccgttagaccacctaattcgtcttacgttcctacgttccttacccgctacttcgtgtaacc

SEQ ID NO: 139762 - DNA, 668 bp, Homo sapiens
  misc_feature: GYAE6OF01ELLAC.46.67.G01.1.454.CMB.1.raw
  modified_base (480)..(480): a, c, t, g, unknown or other
  misc_feature (480)..(480): n is a, c, g, or t
tcagactagcagtacacgaccggtgctcgatttagagtatacatattgggtttggggagtctcggtcaggacacagcatggacatggacgggtccccgctcagctccgtggggctcctgctactcgtggctcggaggtgaccagtatgtagactagtcgacgctacgaccctagtcctaccacttccctcctgtctcgacgtaacggtggacacagtcacactgtctacgtcgccggagtaacggtacgactattacgacttaacttaagtttaagtgtactacaactagtaacgacgacggaccgtaccgtactacctactactactacgtcgtactagtcccaagtttccgacgttttaagcggtaaaactggggtaccccaaggtttccgaagggtttcgacgtaggtcgaagtcggagtctaggggacttacggactttcgactctacaccatacgacgtatctaagtcaacgttntaagtatttacgactaattatactagtactaagtacgaatttacgtaactacgtttacgggaacctaacgggtactaacgtaaacttaacgaaacttaacggaaacgtgtacggcttaacgactaacccgtagttccttacgttaccttactaccttccgtttacccgaccttactcgtacggttacg

SEQ ID NO: 139763 - DNA, 803 bp, Homo sapiens
  misc_feature: GYAE6OF01EOP5X.46.67.G01.1.454.CMB.1.raw
  modified_base (722)..(722): a, c, t, g, unknown or other
  misc_feature (722)..(722): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgaccccagtcctccactccctccctgtctcgaccgaaccggtgggacacagtcgtccaccatcacttcggccgggacaaggtccggaactattcgacctacctttaagtttaaagtggttataccaactagtacgaccgtagggaccggccctaagcctaccgtaatctatgctgcactccgtagttcgacgtaaggttccgggtacctagtacggtaggttcgacgggtcggtacgtagggtacggtacgttacggtacggggaactacggttactttaccctacgttacctacctaacccgtagtaacgttaaacgttactccggttacgaccgttaaacgttagttaaaggtttactttaccgtaacctttaaacgttttacgttaacgttcggtaaaaccctagttaaacgttaacctttaacgttaacggttttaccgggtttaaccggaaccgggtaaaccggtaaccgtaaacccgtaaacctttaaaaccgtaaaacgtttaaaacccggtacgttacggggttaactaccggttaacccggtacttaaaccccggtttntttaaccggttccgttaccctttacccggttaaccccttaccccgttacccctaactttaccgttaccgttaacgtacccg

SEQ ID NO: 139764 - DNA, 840 bp, Homo sapiens
  misc_feature: GYAE6OF01DSGEQ.46.67.G01.1.454.CMB.1.raw
  modified_base (830)..(830): a, c, t, g, unknown or other
  misc_feature (830)..(830): n is a, c, g, or t
tcagactagcagtacacgaccggtgctcgatttagagtatacatattgggtttggggagtctcggtcaggacacagcatggacatgacgggtccccgctcagcctccgtggggctccttgctactcgtggctccggaggtcgccagatgtgacatcgagctcgaccagtctccatccctccgtgtctcgactaccggtgggacgacgtagtcgtaccaacctacgttacaccggtttcggacccgggtactaaacgggtaccggaaacgtactttacggaaccttaaccttttaaagtttaaacggttcggttaactaacaaacgtaagtaccggaaccggaacggggtacccgtaacccgttaaggccttttaaccctaattacgttaacgtcggtccgttacgtaccttaccgttacgtttaacggtttacggtaaacggtaacggggtttaccgggtacctacggttaccggggttacgttaacggtacggttcggggaaccgttagggaggttaccggtacgaggggtactagtttaccgttacctactaccgtactaactaacttacgaatttcctacgtacgtaccgtaaggttaagttacgtttaacgttcgtaacgttaacttacgtttacgtaacttaccgtaaagtacgtttaaacgtttaacttaggttacggtttaccgtaaaccgggaacgacccgttaaacaaaacggtttaaataaaccggttaagtaacgtacggtcgttacacggtacccaaggttccttacggttcctttaccgtactaccccgtttaccgttacccgactttacttaccgnggtttaaccc

SEQ ID NO: 139765 - DNA, 924 bp, Homo sapiens
  misc_feature: GYAE6OF01AR49C.46.67.G01.1.454.CMB.1.raw
  modified_base (180)..(180): a, c, t, g, unknown or other
  misc_feature (180)..(180): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgacggtccttcggagaccctgtccctcaccgtgccgtctgtctcgtgggtcnccctcatctaggttagttcggtttcttccggtggggtcgttcggggtccggcgacgtccgtaccggaagggggaaggggtccttagggaaacttcgtacggtttagggaagtcgttcctctacgagtttacgggtcgggttaacggtttcccttaagtttccgaccgttaccgttctcgtaaccgaaggtcggttcggacttaccaactagttacttccgtacggtacggaaccttacccgtaccgtaacacgttaacttccgttaccgttttccgaagggtaaaccgttgtacggtttacttccgggttacggtacccggacccggtacccggtggttaccggtaaaccggggtccggggttttaacccgtttttaagtacccgggttgggaccgaaccggggttagaacggggttacccggttaatttaagttttacggttacggttttaaggtttttcgggaacggttttacggttttacccgttacggtaaaccccgttacgttaacggtaaccgggtcccggggtaccggggtaccgttaccccgggtacccggtacggggtaccggtaaaggggtaaccgttaccggttacggtacccgtacccggttccttaaccggtccctacccgtaacccggtaacccgggccggtacccttacgggttcccccggtttcccgtacccccgtacgggtaccccccttacccggtacccgaaacgttccccgagggttacccccg

SEQ ID NO: 139766 - DNA, 680 bp, Homo sapiens
  misc_feature: GYAE6OF01CCFAI.46.67.G01.1.454.CMB.1.raw
  modified_base (196)..(196): a, c, t, g, unknown or other
  misc_feature (196)..(196): n is a, c, g, or t
  modified_base (222)..(222): a, c, t, g, unknown or other
  misc_feature (222)..(222): n is a, c, g, or t
  modified_base (440)..(440): a, c, t, g, unknown or other
  misc_feature (440)..(440): n is a, c, g, or t
tcagactagcagtacacgaccggtgctcgatttagagtatacatattggggtttggggagtctcggtcaggacacagcatggacatgagggtccccgctcagctccgtggggctcctgctactctggctccggaggtgccagatgtgacatcgagctgacccagtctccactcctccctgtctgacaacggtgganacagtcgtcacatctactggccgganaagtacggaacattacgactacttaatttaagtgtatacaaacatacgaccgagggaccgaccctaagcctacctaatctatgctgctacgtacctagtttgaacgtaacgggtccgggtacccaggttaccggtaggttacgaggttcggacgtaggtgtacgttcgagggaactaggtactttaccgactcgaacaacgtatacgtaacgttaacncgtacgaaccgttaaggtaacgtaaagttagtttacgaaaccttaacgttttaacttacgttacgaaactaacgtaattaaacttaacgttaaggtttcggttaaccggaaccggtaaacgggtaactaaccgttaaacttaaacgaaaaccgtttaacgacgtaggtacgcttaacgaccctaactacgttactcgttaccttactaacccgttcccaacccgtatacgtcttacgtac

SEQ ID NO: 139767 - DNA, 699 bp, Homo sapiens
  misc_feature: GYAE6OF01ERGAY.46.67.G01.1.454.CMB.1.raw
  modified_base (271)..(271): a, c, t, g, unknown or other
  misc_feature (271)..(271): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgactgggtgacggtcccttcgggacgacccctgtccccctcacctgccggctcgtctcgtggtcgccctccatcgagttagttcggttttctcgtggggctggggtccgnacgccgtaccggaggggagggctaggaatactagtggaagtgtctctctagtaggtggtacgttacctagttaccgacgttcccgtctactacgaagtacggtacgtacgtaccaactatatcctcgtacggactaccgtcaagtacctaattccgttaccgtttcccgagaacgtagtagttacgtttcgtacggttaccgacccggtccgtacgtaccggtaaccggttacgggttagttttaaccttcggtagtacggacgtaaggacggtacgtacttagttagttcgtttaggtttggtacggtttagtttacgttacgaccttaccgtagtaccggtcggtaccggggtccctccgggacccggtgggaccgtaggacttcgtaccggtacctacccgttacctccgtccgccctaacccgg

SEQ ID NO: 139768 - DNA, 797 bp, Homo sapiens
  misc_feature: GYAE6OF01BI8X0.46.67.G01.1.454.CMB.1.raw
  modified_base (212)..(212): a, c, t, g, unknown or other
  misc_feature (212)..(212): n is a, c, g, or t
  modified_base (627)..(627): a, c, t, g, unknown or other
  misc_feature (627)..(627): n is a, c, g, or t
  modified_base (636)..(636): a, c, t, g, unknown or other
  misc_feature (636)..(636): n is a, c, g, or t
  modified_base (659)..(659): a, c, t, g, unknown or other
  misc_feature (659)..(659): n is a, c, g, or t
  modified_base (780)..(780): a, c, t, g, unknown or other
  misc_feature (780)..(780): n is a, c, g, or t
  modified_base (789)..(789): a, c, t, g, unknown or other
  misc_feature (789)..(789): n is a, c, g, or t
tcagactagcagtacacgaccggtgctcgatttagagtatacatattggggtttgggggagtctcggtcaggacacagcatggacatggagggtccccgctcagctccgtggggctcctgctactcgtggctccggaggtgccagtatgtgacatcgagactcgaccctagtctccactccctcctgtctcgaccgtaccgggtggacgtanaggtcgtaccactataccgtacgttcggaccgggactaacggtacgaacgtattacgaaccttaacgtttaaagtttaaggttacggttactaacgtaaactaacggtacggacccggaacggggggttaccccggacccttaagggtcccttaaaaccttaggtacttacgtcggtcgtaccgtactaaccgttccgtttaagttggaaccgttaacgggttccgggaaccctaggttcggggtaacttcgggaaccgggttgaccgttaggtacggtacgttacggtccggggtaaactatttaacggtaccccatttaacggtccccaaagggttaatacgggttaaaccttaccgttgaccggttaaacgaggtttaacgggtaatttacttaccggtaataaacggtttntaccggtanaaccgtaggtaaactcgtttaanacgtttttccgggaacaacgtaacggtacaaacccggtaattaaactaattaaccgggttagacgcttaccggactaacgtacgtaatcgggtactatacgttacctaacccgttcaactntaaaccgtnttaaaccg

SEQ ID NO: 139769 - DNA, 728 bp, Homo sapiens
  misc_feature: GYAE6OF01BZBM6.46.67.G01.1.454.CMB.1.raw
  modified_base (175)..(175): a, c, t, g, unknown or other
  misc_feature (175)..(175): n is a, c, g, or t
  modified_base (211)..(211): a, c, t, g, unknown or other
  misc_feature (211)..(211): n is a, c, g, or t
tcagactagcagtacacgaccggtgctcgatttagagtatacatattgggtttgtcctcctgctggtggcagctcccagatgggtcctgtccctggtgcaactgcgaggacgtccgggcccacgactgggtgaggccttcggagaccctgtccctcacctgcgctgtctctggtncctccatcagtgtgtttctcgtgggtctgggtccgnagcctccgagggaacgggctaggaatactagttaggagttgtctctacagtaggtaggtacgttacctattacacgtccgtctctacgaagtacgtcgtacgtctaacctatacttctcgtacggacctaccgtaccgaagtactaaacttccgttacgtttttacccaggtaagtagtcgttaagtttcgtaggtaccgccgtccgtcgtacgacgtacgggttactttacgttcgtgtcggacgaaggtacgtacgtacttagttaagttggtttaagttttaggtaggttttaggtttacttaccgtaaccgtaaccgttaggtaccgtcggggaccggggtcctacccggtacccgggtacggggaccgtaacgggtacgttacggtacgtacccgtacccgttacgttcccgttaactaccccgtaccgaaccggtaccgtacccgttacccgttcccgttacccctcccggtaccgtaccccgttacccctaccacgaacgtcgtaacccg

SEQ ID NO: 139770 - DNA, 981 bp, Homo sapiens
  misc_feature: GYAE6OF01DLRY0.46.67.G01.1.454.CMB.1.raw
  modified_base (248)..(248): a, c, t, g, unknown or other
  misc_feature (248)..(248): n is a, c, g, or t
tcagactagcagtacacgaccggtgctcgatttagagtatacatattgggtttgggggacctcctgtgcaagaacatgaagcacctgtggtttgtcctctgcgtggtggcagcctccagagtcgggtcctcgtcccgtggtgacaacgtgacgagggacggtccgggcccaaggacgtggtggacggccctttacgggactcccgtcgtcccctcaccgtgccgtcttcgtccgtcgttacgggtccncccctactaagtccgtaaaggtttcggttttcggttttaccgttgggtcgggggtaccgtttccggggggcccggactaacgggcccgttaaccggggaagggggtaaacggggtccgtagggaaaaccttacgtaacggtttagggaagttcggttcctacgtaccgtaaaggtttacggggtacggggttaacctttaccgtttaagtaaccgtaaccggtttccgttactttacccgaaaggtaaacggtaccggtcggtaaaccctaccgtaaaccctaagttaccgttaccgttaaccggtaccggggaaacctacccgggttaacccaagggtaacccttaagttacccggtttaaaccggttttcccaaagggttaacgtaacgttttaggtaaccgtttcgtacggttaccgggtaccccgtaccggttacacgggtaacctaaacgggggttacttttaacgtaccgtcggtacggaccggtagtaacccggagttaacgttacgttaagttggttttaacggtttagggttacgggtttaactttacggttaacccgtaccgttaacccgggtaacgttaggggtaaccccgggacggggttacccgtaaccccgggttacccggggaccggggttaaccggaaaccggggttaacttaccgggttaccgttacccggacccggtttacccgtaacccgttaccgtccccggtaaacccccgg

SEQ ID NO: 139771 - DNA, 744 bp, Homo sapiens
  misc_feature: GYAE6OF01CB8U0.46.67.G01.1.454.CMB.1.raw
  modified_base (146)..(146): a, c, t, g, unknown or other
  misc_feature (146)..(146): n is a, c, g, or t
  modified_base (200)..(200): a, c, t, g, unknown or other
  misc_feature (200)..(200): n is a, c, g, or t
  modified_base (695)..(695): a, c, t, g, unknown or other
  misc_feature (695)..(695): n is a, c, g, or t
  modified_base (706)..(706): a, c, t, g, unknown or other
  misc_feature (706)..(706): n is a, c, g, or t
  modified_base (735)..(735): a, c, t, g, unknown or other
  misc_feature (735)..(735): n is a, c, g, or t
tcagactagcagtacacgaccggtgctcgatttagagtatacatattggggtttggggagtctcggtcaggacacagcatggacatgagggtccccgctcagctccgtggggctcctgctactctggctccgaggtgccagattgngacatcgagctcgacccagtcctccatccctcctgtctgaccaaccggtggganacgagtcgaccacatctacttcggaccgggactaaaggtaccggaactattacgaaccttaacttaattttaaagtaggtacttacaaactaagtaacggaaccgtaacgggacccgtacccgtaagtacctacctaagtactaatcgtactacgactacgtaccgttaggtttacgaacgttaaacgggtccgggtaacctaggttaccggtagggttacgaaggtcggaacgtacggttaggtaagttaccggtaggggtaactaacggtttacttaccgtactcccgtaaacctaccctaagttacgtaaacgttacttcgttaaccgaaccggttaaagggttattaaaacggttttctttaaacggaaccctttaatttaaccggttaacttacgtaaacggaaactaaagtacgttttaattaacggtttaccggttaacgaacggtaacggaactaacgtaataaacgtaaatacggtaatggacctnactacgtactnttctacgttacttcaacttccctacactnttacagtac

SEQ ID NO: 139772 - DNA, 808 bp, Homo sapiens
  misc_feature: GYAE6OF01BGG2B.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtccgggcccacgactggtgaggccttcggagaccctgtccctcacctgcgctgtctcgtggtcgcctcatcagtagtggtttctcgtgggctgggtccgcagcctcccgaggggagggctaggaatacgagttggaagtgtctcgtcagttaggtggtagttcctattacacgtccgtctctgaagtgtcgagtcaccatactctcgtggacacgtcgagacattcgtacgttttaccgagtaacgtagtcgtacgttcgtacggtccgacccgccgtacgtacggaaccggtaccgggttacgttttaacgttacggtacggttacgacgggtaacggaacggttaccggtaactttaacgttttagttacggttttaacggtttttacgggtaacggtttttacgggttttaaccgtttaacccggaacccgttaacccgttaaggtaccggttaccgggggtacccggggtaccctacccgggtacccccgggttagggggtaacccggtaacggggtaaccgtttaccggttaccgggtaacccctaccgggtttcccgttaccggtacccgtaccccgtaaccccgtaaccgggtaacccgggtacccctaccgggttcccgtttaccccccgttccccggtaccggtaccccctaccccgttcccgtaaccgtaaccggtcccgtaccccgg

SEQ ID NO: 139773 - DNA, 769 bp, Homo sapiens
  misc_feature: GYAE6OF01DEX7Q.46.67.G01.1.454.CMB.1.raw
  modified_base (170)..(170): a, c, t, g, unknown or other
  misc_feature (170)..(170): n is a, c, g, or t
  modified_base (190)..(190): a, c, t, g, unknown or other
  misc_feature (190)..(190): n is a, c, g, or t
tcagactagcagtacacgaccggtgctcgatttagagtatacatattgggtttgtcctcctgctggtggcagctcccagatgggtcctgtccctggtgcaactgcaggagtcggtccacgactggtgaggccttcggagccctgtccctcacctgcgctgtctctggtcncctcatcagtgtgtttctgngggctgggtccgcagctaccgaggggagggctaggaatcgagttaggagttcgtctacttcgaagttaggtacggtacggtttacctattacgacgttcccgttactcctacaaaggtcgtacgacgtccaacctatatccgtcgacggacaccggtacaacgtctaaattccttacgttttcccgagaaagtgttcggtaagtttcgtggtccgacccggtccgtacgtacggaaccgtaccggggtttccttttaagttccgtggttacggacggacggtaacggaccggttacgtttaatttagttaggtttacgtttttagggtacgggtttacggttttaacgttaccgtaccgttaacccgttaggtacgttcccggggaacgggggtcccttacccggggaaccccgtcggggtaaccgaacggggttaacgtaccgttcgggtaccgtacccgttaccgttacccttaccggaccccttaacccgaccgggtaccggaccccttacggttcccgttacccccgttcccgtccggtaccctacccctaccgttacccgaacgtccgtacccg

SEQ ID NO: 139774 - DNA, 718 bp, Homo sapiens
  misc_feature: GYAE6OF01A10OL.46.67.G01.1.454.CMB.1.raw
  modified_base (238)..(238): a, c, t, g, unknown or other
  misc_feature (238)..(238): n is a, c, g, or t
  modified_base (311)..(311): a, c, t, g, unknown or other
  misc_feature (311)..(311): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccactcctccctgtctgcaaccggtgggagacagtcgtccacctatctacttggccgggacaagtcggaactnttgaactaccttaatttaaattggtatacaacagtacgaccgagggaccgccctaagctacctatctatgctncactctaggtttacgacgtaaacggtcggggtacccaaggttacggtaggtttaccgaggtcggacgtaaggtcggtacttcggtagggaactacggtattttccacgttctaccaccgtactacgtaaagttactcgtacgacgtaacggtagtaaattacgtttagaacctttaaacgtttacttaaccgttacgtaaccgtaaacgtaacgtaaactttaaccgttaagttttacgggttttaacccggaacggttaaccggaacttaaacccgtaaccgttaaaactaaaacgttaaaccgtaacgttcggtacggtacgtacgtaccctaacgttaaccttacggttaccgttacttacctaccgtttccctaccccgtaaccctagttccgtagttaaccg

SEQ ID NO: 139775 - DNA, 677 bp, Homo sapiens
  misc_feature: GYAE6OF01BP96Q.46.67.G01.1.454.CMB.1.raw
  modified_base (195)..(195): a, c, t, g, unknown or other
  misc_feature (195)..(195): n is a, c, g, or t
  modified_base (222)..(222): a, c, t, g, unknown or other
  misc_feature (222)..(222): n is a, c, g, or t
  modified_base (234)..(234): a, c, t, g, unknown or other
  misc_feature (234)..(234): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtcctccatccctcctgtctgcaaccggtggganacagtcgccaccatcacttggccgganaaggtcggaacntgacacttatttaaagtggtatcaacatacgaccgtagggaccggtaccctaaagtcctaccgtaatctaacgtgacttacgctactccctaggttttcgacgtaaaggtcgggtacccagtcggtaagttcgaagttggcgtaggtggacttcggtagggacctagtacttacgactcgtaccaacctatacctaagttactcgttacgacgtaaccggtagtaaagttacgttttaacgaacttaaacgttttattaccgttacgtactaaacgtaagttaactttaacgtactttacgggtttaaccgaccggaaggtacctaacgtaactaactaaacggttaaaccgacgtgtacgtacgtcgacctaacctagttacgttcgttaccgttacttaccctttaccgttacccccggtatacctttcgtacggttaaac

SEQ ID NO: 139776 - DNA, 898 bp, Homo sapiens
  misc_feature: GYAE6OF01DCNEX.46.67.G01.1.454.CMB.1.raw
  modified_base (237)..(237): a, c, t, g, unknown or other
  misc_feature (237)..(237): n is a, c, g, or t
  modified_base (474)..(474): a, c, t, g, unknown or other
  misc_feature (474)..(474): n is a, c, g, or t
  modified_base (525)..(525): a, c, t, g, unknown or other
  misc_feature (525)..(525): n is a, c, g, or t
tcagactagcagtacacgaccggtgctcgatttagagtatacatagttggggtttgggggacctcctgtgcaaagaacatggaagcacctgtggtttcgtcctcctgcgtggtggcagctccagtagtcgggtcctcgtccgtgggtacacaacgtcggacgagggtccggtccgggacccacggtacggtggtcggaacggtccgttacggaccgtaccctcggtcccacgtccgnggaccgtccgtcggttctcggttcggtccacccgtacaacttacggtaggtttaccggtttccgttttcgtacggggtcgggtccgtttaaccggggcccgagtaccggtacccggtaaccggggaaggggtaacggtccggtaggtaaaccgtaggtaggttaggtacggtcgtcgttaccgtagtaacggttagacggggtttactcgtacgtacgtcgtaccgtcttaccgaanaacgggtctacggtactacactagtacctcgtacggtaacgcgtacgtacngtaccgtattcgttacgttacgacgtaatgttacggtcgtacgtacgtaccgccgttgggaacttacggtaccggttcgttacgttaacggtcgtacgggtgaaaccggtgttaacggtacgttagttaaaccggttttgtttacggtttaagggtttcgtaaggttttaccgggtaaacgttacccgtaacccgttaggtaaaccggggttaccgggacccggggttaccgggaaccggtttccccggggacccgggtttaaaggggaaacccggttccgggtaaaaccgtccggggttttaacccgtacccgttaacccggttttacccgggaaaccccgttttcccgggaaacccgtttaacccccgggg

SEQ ID NO: 139777 - DNA, 674 bp, Homo sapiens
  misc_feature: GYAE6OF01DVT1Z.46.67.G01.1.454.CMB.1.raw
  modified_base (176)..(176): a, c, t, g, unknown or other
  misc_feature (176)..(176): n is a, c, g, or t
  modified_base (215)..(215): a, c, t, g, unknown or other
  misc_feature (215)..(215): n is a, c, g, or t
tcagactagcagtacacgaccggtgctcgatttagagtatacatattgggtttgtcctcctgctggtggcagctcccagatgggtcctgtccctggtgcaactgcaggacgtccgggcccacgactggtgaggccttcggacgaccctgtccctcacctgcgctgtctcgtggtcncctccatcagtagttggtttctcgtggggctgggtccgnacgctccgaggggagggctaggaatacgtagttaggagtgtctctcagtagtggtagttcctattacactccgtctctacaagagtcggagttaccaacattacgtctacgtcggtaaccaccgtaccagtactaaactttaccgtacgtttttaccccgaggaaactacgtagtacgtttcgtcgtacgacccgcgtctacgtaacgacgggttctttaacttacgtacgtaggacgtaagacggtacggtacttagtagttagtttagtttaggtagttgtttacttcgaacctaacccgtgtaacgtccggtacgggggtcctccggtaacccggtgggaacggaacggtaagtaccgttggtaccgtaccgtctaccttacgcccgttacaacccggacggtacccagttcccgtacccttcccgacggccctaacccttcccaacagcgtaccg

SEQ ID NO: 139778 - DNA, 761 bp, Homo sapiens
  misc_feature: GYAE6OF01A0BUK.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgccaaccggtgggagacagtcgtaccaccatctacgttcggccgggacaacggtcggaactattacgaaccttaaccttaagttttaaaacgttggtaactaccaaactaagttaacggacccgaaggggtacccggacccctaagtcctaccttaattctaagtcggtctacgctacttccgtagtttcgacgtaaagggttccgggtaccctagtccggtaggttactaacggtcggtagtaggtacggtagttacggtagggacggtagttaacgtttacctaccttacctaccgtaaccctaattacgtaacgttacgtactacggtaacgtaacgtaaggttaacgttatttacggtaacttaactttacgtttaacttagtactaaactaagttaacgttaacgttaagtttcggtttaccgggtaaccggaacggtaacgtaaccgtaaacgttaaacgtaaaaccgttaaacgtaacgtacggtaggtacctacgtacgtacctagttacgttcgttaccggttacctttaccggaccctttccccggtaaacctgttaccctgggttaaacc

SEQ ID NO: 139779 - DNA, 921 bp, Homo sapiens
  misc_feature: GYAE6OF01CVRGX.46.67.G01.1.454.CMB.1.raw
  modified_base (149)..(149): a, c, t, g, unknown or other
  misc_feature (149)..(149): n is a, c, g, or t
tcagactagcagtacacgaccggtgctcgatttagagtatacatattgggtttgggggacctcctgtgcaagaacatgaagcacctgtggtttgtcctcctgctgggtggcagctcccagatggtctcctcgtccgtggtcactatcgngaggtcggtccggaccacgtcgtggtgacgtccgttacggacctccgtcctcctacctcgtcgctcgtctcctggtacgtcctcctacagttcgtaggtttggtttcgtttaccggtcggggtcgggtcggttacccgggccgacgccgtaccggtaccggggaaaggggggtactaccgttaaagtaaccttaggttacggtaggtcttccgttaacctcgtaactagggtttcgggtacgttaacctttcgttaacttaccgtcccggtttaccttcgtactaaccgggtagttaccgaccgttaaccaaccctaagttaacttcggttacccgtaacgggtaccggaaccctcggtaaccacggtaactttacccggttaccgttttcccgtacggaaagttaaccggtcgtttacggtacgtttcggtaccggacccggttccccgtacggtccgtaaccgggtaccgggttttaaccggtttaccgtttaacggttcggtacggtaacgggtaccgtaaaggttccggtactttaacgtttaaggtttacggtttaacggtttgggttttaacggtggtttttaaaccgtttaccgttaaccccgacgtttaaacccgggtacggtcccggggtacccggggttaccgggtaccccggtcccggggtaccgggtacccggggtaaagttaacccgggtttaagtcccgggttacccgtacccggtttcccgtttaaccgttcccccggtaacccttaacccccgggg

SEQ ID NO: 139780 - DNA, 544 bp, Homo sapiens
  misc_feature: GYAE6OF01A0X87.46.67.G01.1.454.CMB.1.raw
  modified_base (422)..(422): a, c, t, g, unknown or other
  misc_feature (422)..(422): n is a, c, g, or t
  modified_base (492)..(492): a, c, t, g, unknown or other
  misc_feature (492)..(492): n is a, c, g, or t
  modified_base (539)..(539): a, c, t, g, unknown or other
  misc_feature (539)..(539): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacaccttatttaaattggtatcaacatagaccagggaccgccctaagctcctaatctatgctgcatcctagtttcgacgaaaggtcggggtccctagtcgtaggttcagtggcaggtggatcgtagggacagtatttcactctcacatcagtaatcgtgactacgtgaatatttgacttaacttattactntacaactagtaattactagttcgtttacgacctaaggactacgtaactaacaaataacgaatggtacgtntcgactacctatcgtcgttacttactacttccgttcccactacttcngtaac

SEQ ID NO: 139781 - DNA, 881 bp, Homo sapiens
  misc_feature: GYAE6OF01ESRNB.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagcctccccagatcgggtccctgtccctggtgctaactgacagggagtccgggcccacgactgggtcgacggtcctttcggacgaccccttggtccccctcgtaccgttggccgtcgttcggtcctcggtgggtctacccttcctaagtcgtaacggttggtttcggttttccgttacgggtcgggggtcttccgggggtcccgtactaccggtccgttacccgggaagggggtaacgggtccttaagggtaaacctaccggttaaggtttacgggtaacgttcggtaccttacgtaccgtaggttacggtagggttaccggttaccttaacgtttacgtaacgttcccgttcgttacctaacggtaacgtacgttaccgacgttaccaacgttagttacttcgtaacgtcggaaccctacgtctacgaactactcgttaccgtttcctaagacgtgttaggtacgttcgtacgtaccggtaccgtcgtacgtacggaacgttacgttacgtttacgttacgtacggttacgaccggtaacgggtaccgtagttacgtaagtttacgttacgttttaggtttaaccggtgtttttacggtttaaccgtttaccgtaacccgttacccgttaacggtacgggttacccggggttacggggtaccccgttaccggaccccgggttggggtaaacccgtacgggttacgttacccgttacgggtacccgttacccgtttccctacccggtttaacgtcccccgtaaaccccggg

SEQ ID NO: 139782 - DNA, 888 bp, Homo sapiens
  misc_feature: GYAE6OF01CA6PL.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactggcagggaggtccgggcccacgacgtgggtacggacgggtcccgttcgggaacgtcccgttcgtcccctcgaccttggccgcttcggtccttcgttcggtccgccttccagttccgtaaggtttcggtttcgggtttttccgttcgggtcgggggttcgttcggggtcccggcacgtcccgtaccgggaagggggacgggtcgtaggtaatacgtaggttaggtaagtgttcctcgtactaggtagggttaggtacggtttacttacgttacgtaccgttccggttaccttcgtacgtaagtaggtaccgtagtaccaacctacgtacgttacctacgtacgtaccgtaccgtaccgaacgtaacgtaacttccgttaccgttttacccgtaggtaaagtagtttacggtaacgtttcgttcgggtacccggtcccggtccgtacggtacggaccggttacgggttaccgttttacgtacgtgtacggacgtaacgaggtacgttactttagttcgtttaggtttacggtttttagggtaggttttacggtttaacgtttaccggtaaccgtacggttaacggtaccgggtaccggggtcccggggttaccccgggttacccgggttacccgggggtacggggaaccggggttaaacggggttaaccggttaccgggttacgggttaccccggttacccggtttacccgttaccggtttaaccccggacccgttaacccccgggg

SEQ ID NO: 139783 - DNA, 821 bp, Homo sapiens
  misc_feature: GYAE6OF01EF6WC.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgactggtgaggcccttcggacgaccctgtcccctcacctgcgctgtctcgtggtcgccctccatcaggttagttggttttccttcggtgggggtccgttcggggtccggcacggcccgtacccggagggggaacggggctagggaactactagttaggaagtgtctctcgtagttaggtggtacggtttcctaattaccgacggttcccgtctactacgaaggtacgtacggtacgtaccaacctatacttcctacgtacggacctaccgtaccacgtacctaacttaccgttaccgttttacccgtaggtaaacgtagttacggttaacgtttccgtacggtacccggtaccccggtcccggtacgttaccggtaaccggtaccggggttttaacgtttttaacgttaccgttggtcggaaccggtaggtaaccggtacggttacttaagtttagttaggtttaagtttttgggtaagtttcggtttacgtttaccgaacccttaccggttaggaccggtaccgggggaccggggttaccctaccccggggtaccccgggtagggggtacccggtaaaggggtaacccgttaccgggttaccgggttacccgttacccggtttaccccgttacccgttccgtcccccgttaacccccgg

SEQ ID NO: 139784 - DNA, 709 bp, Homo sapiens
  misc_feature: GYAE6OF01EZRYK.46.67.G01.1.454.CMB.1.raw
  modified_base (217)..(217): a, c, t, g, unknown or other
  misc_feature (217)..(217): n is a, c, g, or t
  modified_base (256)..(256): a, c, t, g, unknown or other
  misc_feature (256)..(256): n is a, c, g, or t
  modified_base (311)..(311): a, c, t, g, unknown or other
  misc_feature (311)..(311): n is a, c, g, or t
tcagactagcagtacacgaccggtgctcgatttagagtatacatattgggtttggggggacctcctgtgcaagaacatgaagcacctgtggtttgtcctcctgctggtggcagcctcccagatgggtcctgtccctggtgcaactgcaggagtcgggcccacgactggtgaggtccttcggacgaccctgtcccctcacctgcgctgtctctggtcncctccatcagttagtgtttctcgtggggctgggtccgancgccgtcccggagggaacgggctaggaactacgtagttaggaagttgtccttccnctagttaggtcggtaaggtttccctatttaaccgcgtttacccgtctcctacgtaaacggtcggtcgtaacgtaccacctaatacttcgtcgtacgaaccgtcccgtaccagacctacttccgtttaccgtttcccgtaagaacgtagttagtacgtttcgtccgtacggacccgccgtctacggacccgtacgggtttcgtttaacttcgtcgtggacgaggtacgtcgtacttatttgtacgtttagtttacggttagttcgttttacgttcgaccgttaccgtagtaggtcccgggtacgggtccctaccggggtaccccggtgggacccggtaaggtaccgtaccggtaccggtaccggtaccccttagttaccccttcggcccctaaccccgg

SEQ ID NO: 139785 - DNA, 816 bp, Homo sapiens
  misc_feature: GYAE6OF01EXLSO.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctgctcgaggtgccagatagtgacatcgacgctgacccagtcctaccacttccctccctgttctgaccaccggtagggagacgacggttcgtacaacctatccacttcggccgggacaacggtacggaacacgttacgaacctaccttaaattttaaaacgtttaggttaactaccaaaactaacgtaaacggaacccgaaacgggggtacccggtacccctaaaggtcctttaaccctaaaacgtttctttaaaaacccggttacgtaccgtactacgtaccgttacgttacccgtaaacggtttaacgggtccggtaaaccggtacgggttaccgtacgttacggtaggtcgtacggtacggtacggtacggtcggtacgtacgttacggtacgttacgtaccgttactaccgtacgtacgtaactaacttactacgtaacgtacgtacgtaacgtaacgttacgttaacgtaacacttttacttactacgttacttaacgtaacgtaacttaaacgtaacgttaacgttttacgtaaccgtaacgggtttaaccggtaaccgtaaacggttaaaccgtaaaccgtaaaaccgttaaacgttaacgtttaaaccgtaacgacgttacggtaacgttacgtcgtaccgtaacgttacgttacgttcccttaccctaccttacgttaccgtaccg

SEQ ID NO: 139786 - DNA, 767 bp, Homo sapiens
  misc_feature: GYAE6OF01CFLTJ.46.67.G01.1.454.CMB.1.raw
  modified_base (173)..(173): a, c, t, g, unknown or other
  misc_feature (173)..(173): n is a, c, g, or t
  modified_base (407)..(407): a, c, t, g, unknown or other
  misc_feature (407)..(407): n is a, c, g, or t
  modified_base (522)..(522): a, c, t, g, unknown or other
  misc_feature (522)..(522): n is a, c, g, or t
tcagactagcagtacacgaccggtgctcgatttagagtatacatattgggtttgtcctcctgctggtggcagctccagatgggtcctgtccctggtgcaactgcaggagtcgggcccagactggtgaggccttcggagaccctggtccctcaccgtgcgctgtctcgtggtcncctccatcgagttagttcggtttcttcggtggggctggggtcccgcaggtcccgtccgagggggaacggggtcctagggaactacgtaaggttgggaaacgttcggtcctaccgtcgtaaagttacgggttacggtaacgggttttccctaacgttttaaccggacggtttcccccggttacttcctaacgtaaaaggttcggtccgaacgttacccaaccgtattacgttccncgttacgggacctacggtcccagacctaatctacgttttccaagtagactggtagtcgtgacgacccgtcgatcggaactcgggttactttatcctggtcaggagtaggaccgtnttagttagtacgtttggtttaggacgtttaggttactttacgaaccttaccggtagacgtcgggacgggtccgtaccggtcccggtagggacccggtaacgggtaacttccgtacggtttacccgccgttaccgttacccgtccggtacccacccgtaccggtaccggtccctaacggtttccccgttacccttcccggcggttacccctccccgttaccgaacccgtaaccggtcgtaccccgg

SEQ ID NO: 139787 - DNA, 814 bp, Homo sapiens
  misc_feature: GYAE6OF01C61RC.46.67.G01.1.454.CMB.1.raw
  modified_base (121)..(121): a, c, t, g, unknown or other
  misc_feature (121)..(121): n is a, c, g, or t
  modified_base (237)..(237): a, c, t, g, unknown or other
  misc_feature (237)..(237): n is a, c, g, or t
tcagactagcagtacacgaccggtgctcgatttagagtatacatattgggtttgggggacctcctgtgcaagaacatgaagcacctgtggtttgtcctcctgctggtggcagcctcccagngtcgggtcctgtcccgtggtcgacaacgtgcgaggacggtcccgggacccagacgtggtgaccggtccgttcggactccctcgtccctacaccgtgcgtcttgtctcgtcggtccncctacatcgtagttcggtttcgtttcgtcggtcgggtcgtcggggtccgacgtacggtcccggtaaccggaaggggtaacggtcgtaaaggaacttacgtaggttaggtaacgttcgtcttacgtacgaggttacggttaggttacgtttaccttacgtaaccgtccggttccgtacttacgtacgtaaagtccggtacgtacgtacctaacgttaacttccgtaccgttacgtacggtaaccctaccgttaccacggtaaactacctttaccggtttaaccgttttacccggaaaggtaagttacgttcggttaacgttccggttaacgccggtacccgtcgtacgtacggtaccgtttaggtttacttacggttagtcggtacggtacgaggtaccggtacgttaacttagtttaacggttgtttacggtttaggttacgtttacgttaacgtaccgtaccgtacgtacggtaccgggtcggtcccggtaccgtcccggtaccgggaggtaacggtagtacccgttacggtcccggttaccgtacccttcgtacccgtcctacccggtaacccgg

SEQ ID NO: 139788 - DNA, 889 bp, Homo sapiens
  misc_feature: GYAE6OF01CQN2N.46.67.G01.1.454.CMB.1.raw
  modified_base (229)..(229): a, c, t, g, unknown or other
  misc_feature (229)..(229): n is a, c, g, or t
tcagactagcagtacacgaccggtgctcgatttagagtatacatattgggtttgggggacctcctgtgcaagaacatgaagcacctgtggtttgtcctcctgctggtggcagcctcccagatgggtcctgtccctggtgcaactgcagggacgtccgggccacgacgtggtgacggtccttcgggacgtaccctcggtcccctcaccgtgccgtctgtcctcgtggtcncctcatcgtagttaggttcgtttcttcggtgggggtcgtcggggtccgcgacgtccgtaccggaaggggacgggtcgtacggtaactacgtaggtttaagggtaacggttcgttaccgtaccgtacggtaaggtttacggggttacggggttaaccggttttaccctttaacgtttaaccggtccgtttcccggtacttaccggtaacggtaaacgggtaccggttaacggtaacgtaccctaacctaagttccgttaccgttaccggtaacgggaacccgttacccgtaacgtaccggaacttaaacgtttacccggtttacgtttttacccggaaaggtaaacgttacggttacggtttacgtttccggtacggttacccggaccccggtaccgtacggtaacggttaccggttacgggtttactttaacggttcggtacggtcggacggaggtaccggtacggttacttagtttacgttaggttttacggtttagggttaacggttttcgttaacgttacccgtaacgtaccggttaggacccgggttccggggacgggttacccgtccccgggtaccgggtacggggacgtaacggttaccgttcgtaccggttcccgtaaccgttcccttacccggtccgtccccgtaaccccgg

SEQ ID NO: 139789 - DNA, 609 bp, Homo sapiens
  misc_feature: GYAE6OF01B3LDZ.46.67.G01.1.454.CMB.1.raw
  modified_base (207)..(207): a, c, t, g, unknown or other
  misc_feature (207)..(207): n is a, c, g, or t
  modified_base (283)..(283): a, c, t, g, unknown or other
  misc_feature (283)..(283): n is a, c, g, or t
  modified_base (287)..(287): a, c, t, g, unknown or other
  misc_feature (287)..(287): n is a, c, g, or t
  modified_base (334)..(334): a, c, t, g, unknown or other
  misc_feature (334)..(334): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctcatcagtagtggtttctcgtgggctgggtccgnagctccgagggaggggctggaatacagttggaagtgtctctcagtaggtggaggttcctattacagtccgtctctnaagngtcgagtcaccatatctcgtggacacgtccagcaatctagtttcccngaacgtattgagttctggtcgaccgccgctgaccgtcgggtactttattactggcgcgtagagtaccggtcttattagtgttagttttggagttaggttatttacgactacccgtagtacgtcggacgggtcctccggacccgtcgggaccgtagggtacgtcgtcggtcaccgttcttccgtacgccctaccgaacccgacggtacccctagttcccggttccccttccccgtcggtacccctacccctacccgtaccgtaacgccgtaccccg

SEQ ID NO: 139790 - DNA, 835 bp, Homo sapiens
  misc_feature: GYAE6OF01D1I9K.46.67.G01.1.454.CMB.1.raw
  modified_base (178)..(178): a, c, t, g, unknown or other
  misc_feature (178)..(178): n is a, c, g, or t
tcagactagcagtacacgaccggtgctcgatttagagtatacatattgggtttgtcctcctgctggtggcagctcccagatgggtcctgtccctggtgcaactgcaggacgtccgggcccacgacgtggtgaggccttcggacgaccctgtccctcacctgccgctgtctcgtggtcncctccgatcagttagttggtttcttcgtggggctcggggtccgacagtccgtaccgaaggggacgggctaggaaatacgtagtttcgggaattcgtctactcgagttacgtggtaggttccttagttacacgttccgtctacgtacgtaaggtatacgacgttaccgacctagtacgttcctacgtacggaacctaccgtacccgagtacctaacgttcgtttaacgtttttaccccgagtaaaggttacctaggttacggtttactcgggtaccggaccgtccgtacgttacggacccggttaacgggttacttttagttaaccgttggtcgacggtaacggaaggtaccggttacttagtttacgtttaagtttacggtttttaggacgggttttacggtttacgtttaccgtaaccgtaccgttaacgtcccgggttaccgggaccgggtccgttacccggacccggtacggggacccgtaggtaaccggttacgttacggtacccgtaccgtttccgttacccgttacccggtaccccttaacccggaacccgtacccgggtacccttaccggttccccgggttaccccccgttccccgttaccggtaacccccttccccgttaccccgtacccgaaccggtccgtacccccg

SEQ ID NO: 139791 - DNA, 957 bp, Homo sapiens
  misc_feature: GYAE6OF01B41LF.46.67.G01.1.454.CMB.1.raw
  modified_base (98)..(98): a, c, t, g, unknown or other
  misc_feature (98)..(98): n is a, c, g, or t
tcagactagcagtacacgaccggtgctcgatttagagtatacatattgggtttgtcctcctgctggtggcagctcccagatgggtcctgtccctggtncaactgcaggacgtcgggcccacgactgggtgaggcccttcggacgacccctcggttccctcacctgcgtctcgtctcgtggtcgccctcatcagttagttcggtttctcggtggggtcgtcggggtccgtcgacgccgtacccggaaggggacggggcgtaggaactaacgtagttggaacgttgtctctcgagttaggtggtacgttaccttaagttaccgtacggttccgttctacgtaacgaagtaacgtcgaacgtacctaaccgtattaccgtctacgacggtaacccgtaccgtacagtacctacgttcttaccggtttaccgagtaaactacgttggttaacttcggtcgtacccggtacccgtaccggtaccgtaggtaacccggtacgggttttacttttaaggttaccggttacgggtacgggtaaccggtaagggtaacgggttacccggtttaacgtttaaggttttacggttttagggttttaacggtttttacggggtaccggtttttaaggttttaacccggttttaacccggaccccgttaaacggttaacgggtaaccgggttacccggggggttaccgggttaccccgtttaaccccggggtacccgggtacgggggtaaacccgttaggggttaaacccgttacgttacccggtaaccccgggtttcccgttaaccctttcccccgggtaaaccgttcccccgttaaaaccgggaccccggttaaaccccggtccccggttaaccggtttcccccggttaaccccccgttccccggttaccccggtacccccgttacccccctaacccgtaacccgggtacgtccccgttaaccccggg

SEQ ID NO: 139792 - DNA, 715 bp, Homo sapiens
  misc_feature: GYAE6OF01C5E0V.46.67.G01.1.454.CMB.1.raw
  modified_base (159)..(159): a, c, t, g, unknown or other
  misc_feature (159)..(159): n is a, c, g, or t
  modified_base (194)..(194): a, c, t, g, unknown or other
  misc_feature (194)..(194): n is a, c, g, or t
  modified_base (409)..(409): a, c, t, g, unknown or other
  misc_feature (409)..(409): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcnctgtctctggtgcctcatcagtagtggtttctcgngggtctgggtccgcacgctcccgaggggaagggctggaatcagttggaagttgtctctctaagtaggtggtacggttaccttagttacgacgttcccgtactccgtacgaagtgtccgacgtccacctaattactccgttcgtacggaccaccgttccaacgactaaacgttctaccgttttcccgagaagtactgttagtctgacgaccgcgtnacgaccgtgggtactttagtcgtcgtgtacgagtacggtacgtacttaattacgttagttaggttttcggtaggtttacggtttacttacgaacctacccgtagacggttccggggaccgggtcctaccggtaccccggtggggacccgtaaggggttactacggttccggttacctaccgttaccgttccgttaaccgccctacccgaaccgggtaccggtacccgtaccggtttcccggttacccccgttccccggtaactcccccgttaccccttaccgaacctaccggtaaccggtcccccg

SEQ ID NO: 139793 - DNA, 795 bp, Homo sapiens
  misc_feature: GYAE6OF01C7PHD.46.67.G01.1.454.CMB.1.raw
  modified_base (305)..(305): a, c, t, g, unknown or other
  misc_feature (305)..(305): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcgcctcatcagtagttggtttctcgtgggctgggtccgcagcctcccgaggggaacggggctaggaatacgtagttagggaagttgtctctacagtaggtggtaggttcctaattacagtccgttctctacaagngtcgagtcaacatatctctgacacgtcagacaatctacgtttcccgagaacgtattcgtagtttctaggtaccgtacccggccgtcgtacggaaccggtacggggtttacttttaatttaaccgttggtacggacgggtaacggtacgggtaccggtacgtttaagtttacgtttagggtttacgttttttaggggtaagtttagggttttaactttaccggtaacccgttaacccgttaaggtaaccggttacccggggacccgggggttaccgttaccccgggaacccccgggttacgggggaccccggtaaaggggtaaccttaccgggttacggttacccgtacccggttccctttacccgttaccgccccttacccggaacccggtaacccgggaccccttaccggttccccggtttacccccgttcccccgtacggtacccccttaccccgttacccttacccggaaacgtaccgtacccccgg

SEQ ID NO: 139794 - DNA, 726 bp, Homo sapiens
  misc_feature: GYAE6OF01B0U60.46.67.G01.1.454.CMB.1.raw
  modified_base (293)..(293): a, c, t, g, unknown or other
  misc_feature (293)..(293): n is a, c, g, or t
  modified_base (298)..(298): a, c, t, g, unknown or other
  misc_feature (298)..(298): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagttggtttcttcgtggggctggggtccggcagcctcccgaggggaaggggctaggaatacagttaggaagtgtctctcatggtggtaggttcctattacagtccgtctcncaagngtcgagtcaccatatctctggacaccgtccagactaatctacgttttccagaagtatgtagttctgtcgaccgccgtctcgacgtacgggttcgttttacttacgtgtcggacgaaggacggtaccggtacttagtttagttagtttaagtttttgggtaggtttacggttttacgtttaccgtaacctaaccccgtaggtacgtaccggggtaccgggggtccgttacccgggtaccccgggttacggggacccggtaaggggtaaccttacggtacggtaccgtacccgttccgttacccgttacgtcccctaaccccgtaacccggaacccgggtcccctaaccggttccccggtttccccgttaccccccggtccggtaccccttacccccgttacccctaacccgtaacggcccgtaccccgg

SEQ ID NO: 139795 - DNA, 695 bp, Homo sapiens
  misc_feature: GYAE6OF01EYGFB.46.67.G01.1.454.CMB.1.raw
  modified_base (200)..(200): a, c, t, g, unknown or other
  misc_feature (200)..(200): n is a, c, g, or t
tcagactagcagtacacgaccggtgctcgatttagagtatacatattgggtttgggggagtctcggtcaggacacagcatggacatggagggtccccgctcagctcctggggctcctgctactctggctccgaggtgccagatgtgacatcgagctgacccagtcctccatccctccctgtctgaccaaccggtgggaanacagtcgtaccaccatcgtacgttcggccgggactaacggtcggaaactagttagacctaaccttaattttaaagttggtaatacaactatacgaaccgacgggaccgaccctaagaccttacctatactatcgtctcgactacgtccgtagtttcgacgtaaacgggttcgggtacccctagtaccggtacggttcgacggtcggactagggtacggtacttacgggtacgggaacgtaggttactttaccgtacctacctaccaactagttaactaagttaactaccgtacgtacgtaaggttagtaagttattagtaactaaactttataacgtatacaaactaataacttacgtaagttcggttaccggaacgaacggtaacgtaacgtaactaaacgtaacgtaaacgtaccgtggacgtacgacgtacctaactattctacgttaccttaccgtaccttaccccgtacccgactacttccgtagtaacc

SEQ ID NO: 139796 - DNA, 860 bp, Homo sapiens
  misc_feature: GYAE6OF01AGZ3X.46.67.G01.1.454.CMB.1.raw
  modified_base (211)..(211): a, c, t, g, unknown or other
  misc_feature (211)..(211): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcggcccacgactggtgaggccttcggagaccctgtccctcacctgcgctgctcgtggtcncctcatcagtgttcggtttcttcgtggggccttggggtccgcagtccgtacccggaggggacgggctaggaactacgtagttagggaacttcgttccgtctaccgtagttaggtagggtacggtttaccctattaccgtacgttcccgttcgttctacgaaggtacgtaccggtacgtacccaccgtaattacgttcccttacgtacgggaaccctacccggtaccacgtaacttaacgttccgttaacccgtttttccccgtaaggtaaacgtacggtttacggttaacggtttccgttacgggttacccggacccccggttccgtaccgttaggtaacccggttaccggggttactttttaaacgtcgtagggttcggaccggtacggtacggtaccggtttacgttaagtttaggtttagtttaagggttttttcgggtacgttttagggtttttaccctttaaccgggtaacccttaacccgggttaaggtccggggttacccgggggtaaccccggggttacccggtaccccgggttaaccccccgggttggggggaaacccgttccggggtaacctttacgggttccccgttaccggtacccccgtttacgttcccccgtccggttaccccgtaaccccgggg

SEQ ID NO: 139797 - DNA, 759 bp, Homo sapiens
  misc_feature: GYAE6OF01CICLO.46.67.G01.1.454.CMB.1.raw
  modified_base (713)..(713): a, c, t, g, unknown or other
  misc_feature (713)..(713): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctcgacccagtctccagtccctccctgtctcgacaaccggtgggacgacagtcgtccaaccacgtcctaccgttcggccgggtactaacggtaccgggaaacctagtttcgaaccttaaacctttattttaaaagttcggttaactacaaaactacgtaacggaacccggacggggtacccggtccccttaaaggccttaccctaaagttcctaacgtgtcctgcctattcccgtaggttttacgacgtaaacgggtccgggtaccctagtaccggtacggttcgaggttcggacgtacggttggtactccggtagggaaccgtagttacctttaccaccttaccgtaccaacccgttagtcttaacgtaactttccgtacggaaccgttaacggttacgtaaaggtttactttacgaacttaaaccgttttacttaaccgttggtaaacctacgtaattaaacgtttacttaacgtttcggtttaccgaacggttaacgggacctaacggtaaactaaacgtaaacttaaccgtagtcgtacggtcaccggtaccacgtnttacctgttcccttacgtaccttctcccctagtacttcgtacgtac

SEQ ID NO: 139798 - DNA, 872 bp, Homo sapiens
  misc_feature: GYAE6OF01AQB5P.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtcctggtcgcaactgcaggagtcgggcccacgacgtggtgaggtcccttcggacgaccctcgtcccctcacctggccgtctcgtctcgtcgggtcgccctccatcgtaaggtcggttcggttttccttcggtcgggggtccgttcgggggtcccggacgaccggtcccgtacccgggagggggtaacgggggtcttaaggggaacttactaaggtttacggtaacggttccgttcctaccgtaccgtaagttacgggtaggggttaccggttttaacccgttaattaccggttaccggtccgttaccgtctaaccgaaggtacgtacccggtaagttaccaaccgttactattcccgttcgacgggtaaccctaccgtaccacgttaccgtaaacttccgtttaacccggttttccgaagtaacggttacgtacggttaacggtttgtccggtacccggaaccccgttccggtaccgacggtaacccggtttaccgggtttaagtttaccgttaacgtcggttacggcgtaaacggaacggtcgtacgtttaagttacgtttaggtttacgttttagggttaaccgtttcggtttttaactaccgaaccgttaccgtacggtaccggcgggttaccccggggtcccgtcccggttacccggggtgggtaaccgtacgggtaaccgttccgttaccggacctttacccggaccgtttacccgttcccgccccgtaaaccccggg

SEQ ID NO: 139799 - DNA, 833 bp, Homo sapiens
  misc_feature: GYAE6OF01C1BNL.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcagggacgtccgggcccacggactgggtgacggccgttcggacgacccctgtcccctcacctgccgctcgtctcgtggtcgccctccgatcgaggttagttcggttttcttcgtgggggtcttacggggtccggcgtacgccgtacccggaggggaaggggccttagggaaatacgtagttgggaacgttgtacctctacgagttagggttaggtaccggtttaccttaacttaccgtacgttcccggtctaccgttaacggaaaggtacgttccggtaacgtacctaaccctaatttacgtacccggtttacgaccggggtaacctacccggtacctaacggactaacgttacgtttaccgttttacccgaagaaagttcgtaagtcgtttacgtcggtaccgtacccggcgtacgtagtaacccggtggggtttacctttactacggtggttacggcggttaacggaaggtccggttactttagttacggttagtttaggttttacgggacgtttaggtttaacctcggtaacctaccggttaagcgggtttaaccggggaccccggggtacgtttaccccgggaccccggggttaggggaaccgtaaacggggtactttccccgggtaacggtccccgttaaccggtttaccccctacggtttaccccgcccgttaaacccccggg

SEQ ID NO: 139800 - DNA, 737 bp, Homo sapiens
  misc_feature: GYAE6OF01E2E82.46.67.G01.1.454.CMB.1.raw
  modified_base (206)..(206): a, c, t, g, unknown or other
  misc_feature (206)..(206): n is a, c, g, or t
  modified_base (464)..(464): a, c, t, g, unknown or other
  misc_feature (464)..(464): n is a, c, g, or t
tcagactagcagtacacgaccggtgctcgatttagagtatacatattgggtttgtcctcctgctggtggcagctcccagatgggtcctgtccctggtgcaactgcaggagtcggcccacgactggtgaggccttcggagacccttgtccctcacctgcgctgtctctggtgcctccatcagtgtgtttctgtgggctgggtccggnagcctccgaggggacgggctaggaatacgatggaatgtctctcatgtgagttcctattacacgtccgtctcctacaagtacgtacgacgtacaccatatcgtcgtaggaccacggtccagtacctaacttcttacgttttacccaggtaacgtacttacgtacgtttcgttcggtacggacccgtccgcgtacggaaccgtaccggggtacgttttaacgttacgttggtacggtacggtaacggacggtaaccggtntttaacgtttagttaggtttaacgtttttacgggaggtttaggtttactttaccggaccgttaacccgtagtacgtcgggtaccggggtaccgtaccggtaccccgtagggggtacccgtaagggtaacgtcggttacgtaccgtacccgttccgtccgtaccgtcccgtaccctaaccggaccgggtacccctaccggttcccggtttcccttccccccggttaccgtaccccgacccccgttacccgtacccgtaaaccggtcgtaccccg

SEQ ID NO: 139801 - DNA, 689 bp, Homo sapiens
  misc_feature: GYAE6OF01EKOZL.46.67.G01.1.454.CMB.1.raw
  modified_base (211)..(211): a, c, t, g, unknown or other
  misc_feature (211)..(211): n is a, c, g, or t
  modified_base (673)..(673): a, c, t, g, unknown or other
  misc_feature (673)..(673): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggccctttcggagaccctgtccctcacctgcgctgtctcgtggtcgcctccatcagtagtgtttctgtgggctgggtccgnagctccgagggagggctggaatacagttggaagttgtctctcagtacggtggtacgttcctattacgacgtccgtctctacgaagtgtcgagtcacagtactactcgtggacctacgtaccagtacaagttcgtaccgttttccgaagtaacgtagtgtacgttctggtacgacccgccggtcgttacgaacggttacgggttaccgttttaacgttcgttaggtcggacggtaggaacgtaccggtacttagtttaacgttgtttagttttagggtaggtttggtttacttacccgtaacgtaccgttacggtacgtccgggtacgggcctacccggtacccgggacgggtaccgagggtaactcggtaccgtacgtacccgtcgtacccgttacgtcccctaaccgacccgacgggtacccacgttcccgtcccttccccgaccgtccctacccgtaccnccaacgtccgtacccg

SEQ ID NO: 139802 - DNA, 646 bp, Homo sapiens
  misc_feature: GYAE6OF01DR1Y2.46.67.G01.1.454.CMB.1.raw
  modified_base (367)..(367): a, c, t, g, unknown or other
  misc_feature (367)..(367): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactgggtgaggccttcggagaccctgtccctcacctgcgctgtctctggtcgccctcatcagtagttggtttctcgtggggctgggtccgcagcctcccgaggggagggctaggaatacagttgggaagttcgtctctacagtaggtggaggtttcctattacacggtccgtctctacaagagtacggagttccacctatactctctcggacacggtccagctaatctacgttttcccagtaagntgtagtttctgtcgaccgccgctgacgacgggttgtttaacgttacgtgtacgacgaggtacgacgtcttattacttgttagttttaggagttggtttactttcgacctaccgtagagtccgggacggggtcctaccggcccgtggggaccgaagggtacttcgttacggtccgtaccgtctaccttacgcccctacgacccgtaacgggtcccctacgttcccggttcccctttcccccgcggtacccctaccccgttcccaacccgagtcgaccccg

SEQ ID NO: 139803 - DNA, 836 bp, Homo sapiens
  misc_feature: GYAE6OF01BNP14.46.67.G01.1.454.CMB.1.raw
  modified_base (219)..(219): a, c, t, g, unknown or other
  misc_feature (219)..(219): n is a, c, g, or t
tcagactagcagtacacgaccggtgctcgatttagagtatacatattgggtttgtcctcctgctggtggcagctcccagatgggtcctgtccctggtgcaactgcagggtagtccggcccacgacgtggtgaggtccttcggacgtaccctgtccctcacctgcgtctgtctgtgtcgcctcatctagttgttggtttctcggtgggcgttcgggccgnacgccgtaccggagggaacgggcgtaggtaactagtaggttaggaacgttcgtaccttcgtagtaagttaggtacggtacggttaccttaagttaccgacgttccggttcctacgtacgtaaaggtacgttcggactacctaactacttactccgtcgtagacctaccgtacgaacgactaacgttcgttaccggttaccaggaacgttactaggttacgttcgtacggtaccgacccgtcgtaccggtaacgtaccgggttacccgggtttaacttttaaccggtacggttacggtcgaacgggtaaggtaccgggtaaccggttaattaacggttttaggttaggttttaagtttgggttaacggtttacggttttaaccgtaacgtaacccgttaccggtaaggtcccgggtaacggttccggggtacccgtacccgggttaccgggacgggtaacccgtaaagggtaccggttaccgtcggttaaccctacggttcccgtaacgtcccgtaccgtaacccgaaccgggacccgttaccgaccggtttccccggttacccgtcccccggaccgttaccctacccctacccgtaccgtaacggtccgtaccccgg

SEQ ID NO: 139804 - DNA, 712 bp, Homo sapiens
  misc_feature: GYAE6OF01E1DOY.46.67.G01.1.454.CMB.1.raw
  modified_base (356)..(356): a, c, t, g, unknown or other
  misc_feature (356)..(356): n is a, c, g, or t
  modified_base (553)..(553): a, c, t, g, unknown or other
  misc_feature (553)..(553): n is a, c, g, or t
tcagactagcagtacacgaccggtgctcgatttagagtatacatattgggtttggggagtctcggtcaggacacagcactggacatgagggttccccgctcagctcctggggctcctgctactctggctccgaggtgccaggatgtgacatcgtagctgacccagtctccatcctcctgtctgcaaccggtgggacgtacgacggtgtaccaccgtatcacgttcggccggcaagtccggaactacgttacgacacccttaagtttaaacttcggtaacttccaaacgaacttagtaaccctacggggtaaccgtacccctaaaggtccttaccgtaaaacgttctttaacccggntacgtacgtactacgtacgtacgtacgtaacggtacggtacgtaacgtacggtacgtacgtacggtacggtacgtacggtacggtacgtacggtacggtacgtacgtacgtacgtacgtactactactactactacgtactacgtacgtacgtacgtacgtacgtacgttacgtactacgtaacgtactacgtaacntacgtacgtaacgtactacgttacgtacgtacgtacgtacgtaacgtaacgtaacgtaacgtaacgtaacgtacgtacgtacgtacgtacgtacgtactacgtacgttacgttacgttaccgttaccgttacccgtaccgttaccgtaccgtacgtacg

SEQ ID NO: 139805 - DNA, 634 bp, Homo sapiens
  misc_feature: GYAE6OF01DLALR.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggacaagtcggaacattgactaacctatttaaattggtatcaacatagaccagggaccgaccctaagcctactaatctatgctgctatccagtttgacgaaagtcgggtacccagtcgaggttcagtgcgagtggatcgtgggactagtactttcactctacacctatcgtaagtaacttctacgacgtaacgtagtaaagttatttaacgtaaccttaaacgtttaacttaacgtacggttaacaaacctaagttaaacttaactaagttttacggttttaacccggacccgtaaaacgggaccgtaacgtaaaccgttaaacctaaaattaaaccgaaacgttaggtacggctacgtaccaacgtactttctacgttacctttcaacgtttcccttacccacctactcgttaggtaac

SEQ ID NO: 139806 - DNA, 610 bp, Homo sapiens
  misc_feature: GYAE6OF01DBTFI.46.67.G01.1.454.CMB.1.raw
  modified_base (193)..(193): a, c, t, g, unknown or other
  misc_feature (193)..(193): n is a, c, g, or t
  modified_base (218)..(218): a, c, t, g, unknown or other
  misc_feature (218)..(218): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggnaagtcggaacattgacactatttaaatgtatcaacatagaccaggacgccctaagctactaatctatgctgcatccagtttcgacgtaaaggtcgggtacccaagtcggaaggtttcaggtaggcaggtgtaagtcgtagggaactagtattttcacttctacaacctatactaagttaactctacgtacaacgtagtaaagttattttacggaacttaacgtttattactagtacaaactaagtaaattaacaatttcggtttacgaccgtaaagggactaacgtaacgtaaactaaaacttaacgtaagttggtacggacttagacctaactaagttcttacgttacttacctaactttcccttaccccgacctaacgttctaggtaaac

SEQ ID NO: 139807 - DNA, 752 bp, Homo sapiens
  misc_feature: GYAE6OF01DMFG3.46.67.G01.1.454.CMB.1.raw
  modified_base (175)..(175): a, c, t, g, unknown or other
  misc_feature (175)..(175): n is a, c, g, or t
  modified_base (361)..(361): a, c, t, g, unknown or other
  misc_feature (361)..(361): n is a, c, g, or t
tcagactagcagtacacgaccggtgctcgatttagagtatacatattgggtttgtcctcctgctggtggcagctccccagatgggtccctgtccctggtgcaactgcaggagtcgggcccacgactggtgaggccttcggagacccctgtcccctcacctgcgctgtctctggtncctccatcagtagttggttttcttcgtggggctgggtcccggcagtcctcccgaggggaacggggctaggaatacagttgggaagtcgtctctcatagtggaggttcctattacagtccgtctctacaagagtcgagtcaccatatctgtcggacacgtccagacaactctacgtttccagaacgnttagtagttctaggtacgacccgtccgtcgtacgtaacgtacgggttacttttaagtttacgtaggttcggacggaaggtaacggtaccggtacgtttaatttaagttaggtttagttttttagggtaaggttttaggttttacgttttaccggaaccctaacccgtagtacgttaccgggtaccggggtcccgttacccgggaccccgtcgggggaacccgtagggtaaacttacggtacggttacccgtacccggttaccttacccgttaccgtccccgttaaccccgaacccggtaacccgggtacccctaacggtttcccgttacccccgttccccccggtacggtccccctaccccgttacccctaccgaaacggccgtaaccccg

SEQ ID NO: 139808 - DNA, 691 bp, Homo sapiens
  misc_feature: GYAE6OF01BRSMB.46.67.G01.1.454.CMB.1.raw
  modified_base (204)..(204): a, c, t, g, unknown or other
  misc_feature (204)..(204): n is a, c, g, or t
  modified_base (514)..(514): a, c, t, g, unknown or other
  misc_feature (514)..(514): n is a, c, g, or t
tcagactagcagtacacgaccggtgctcgatttagagtatacatattgggtttggggagtctcggtcaggacacagcatggacatggacgggtccccgctcagcctccgtggggctcctgctactctggctccggaggtgccagatgtgacatcgagctcgacccagtcctccactccctccctgtctgaccaaccggtggganactagtcgtccaccatccacgttcggacccgggactaaggtacgaactgttacgaacctactttaatttaaacgtggtaactacaactaagtacgaccgaagggaccggtaccctaagccttacctaatctatgtctagacctattccgtagtttcgaacgtaacgggtcgggtaccctgtacggtacgttcgagtcggctaggtcgtagtcggagggtactagttcttacgtactcctaccgtactacgtactagttaaccgtcgtacgaacgtaacgtagttaacgttagtttactacttaaactttnttaacgtactaacgtaacgtaactaacttacgtaagtttcgttaacgacgtaacggactaaccgtaaacttaaacgtaaataaccgtagtacgtacggtacctcggtaactaccgtagttaccgttacgttcccttacgtacccttcccttacccgtactcgttcgtaacgttaccg

SEQ ID NO: 139809 - DNA, 736 bp, Homo sapiens
  misc_feature: GYAE6OF01DZ1KY.46.67.G01.1.454.CMB.1.raw
  modified_base (227)..(227): a, c, t, g, unknown or other
  misc_feature (227)..(227): n is a, c, g, or t
  modified_base (282)..(282): a, c, t, g, unknown or other
  misc_feature (282)..(282): n is a, c, g, or t
  modified_base (436)..(436): a, c, t, g, unknown or other
  misc_feature (436)..(436): n is a, c, g, or t
  modified_base (473)..(473): a, c, t, g, unknown or other
  misc_feature (473)..(473): n is a, c, g, or t
  modified_base (524)..(524): a, c, t, g, unknown or other
  misc_feature (524)..(524): n is a, c, g, or t
tcagactagcagtacacgaccggtgctcgatttagagtatacatattgggttgggggacctctgtgcaagaacatgaagcacctgtggtttgtcctcctgctggtggcagctcccagagtcgggtcctcgtccctggtgcaactgacgagggtaggtccgggcccaggactgggtcgaggtccttcggacgaccttgtcccctcacgtgcgtcttgtctcgtggtcnccttacagttctacggtgtttggtttcctcgggtggggtaccgtggggtccgacncggtccgtaccggaagggggaacggggtgtacgggtaaactacgtacggttaggtaacgttgttcctactcgtagttaaggtgggtaccggttccttatacgtacgtccgtcttcgacgagtacgtcgtaacgtcactatactcgtcgagaccncgttcaacgtctaagttcttactttccgaagtacgtntcggttgtctggtcgccgacgcgtcgacgtaggttctttatacgtgtacgngtacgacgttcgtatagttcgttaagtttagttttaggaggttttcgtacggtttcctaaccgtccgtaaggtaccggtaccgggtaccgggtcccggtaccccggtacccgggttagggggaaccgttaaacggggttaacccttacgggttaacccggtcccgtttacccggttaccttttcccggtaacccgtacccggtaaccccggg

SEQ ID NO: 139810 - DNA, 828 bp, Homo sapiens
  misc_feature: GYAE6OF01DGXNO.46.67.G01.1.454.CMB.1.raw
tcagactagcagtacacgaccggtgctcgatttagagtatacatattgggtttggggagtctcggtcaggacacagcatggacatgacgggtccccgctcagctccgtggggctcctgctactctggctccggaggtgccagatgtgacatcgagctacgacccagtcctccactccctcctgtctcgacgaaccggtggacgacagtcaccacctatcgtacgttcggacccggggactaaacggtaccggtaaactacgttacgaacctaacctttaaattttaaacgttaggtaactaacgaaaccagtaaccgaccggtaacggggacccgaccctaacgccttaacctagtacctatcgtctcgactacttaccgttagttaccggtaacgtaacgggttcccgggtaccctaaggttacggttacgggtcgtagggtacggcgtaagggtggtacttcgggaacggtacgttaacgttaacctttccaccgttacgtaccaacccttatacgttaacgttactaccgtaccggtaacgttaacggtacgttaagttttacgttaacgttaacctttaacgttttaacttaccgttaacgtaactaaaaccgttaacgtttaaaactttaacgttaacggttttaccggtaaccggtaaccggtaaacggtacccgtaaacggtaaacttaaaaccggttaaagttaaaccgttcggtaacggttcggaccggtaactaccgtaaaccgtttcgtaaccctttcgtttaaccccttacccgttacccccggttacttaccgtatttacccgtagtccttacgg

SEQ ID NO: 139811 - DNA, 881 bp, Homo sapiens
  misc_feature: GYAE6OF01DKZK3.46.67.G01.1.454.CMB.1.raw
  modified_base (772)..(772): a, c, t, g, unknown or other
  misc_feature (772)..(772): n is a, c, g, or t
tcagactagcagtacacgaccggtgctcgatttagagtatacatattgggtttggggagtctcggtcaggacacagcatggacatgagggtccccgctcagctccgtggggctcctgctactctggctccggaggtgccagatgtgacatcgagctacgacccagtcctccactccctcctgtactcgaccgaaccggtgggacgacgtaggtcgtaccacctataccgtacgttcgggacccgggactaacggtaccggaactacgttacgaacccttaaccgtttaaagttttaaacgttcggttaactaacgtaaacctacggttaaaccgggaacccggaacgggggtaaccccgtaccccgttaaacgtccccgtttaacctaaacgttccttagtaccgtacgtcgtacctacgttacccgttaaggtttacgaaccggttaaacgggttccggggttaccccaggtttacggtacgggttacgacgggttcggacggtaggtacggtacgtacggtagggactacgttacttacgtacctaccgtacctaactcgttaactacggttactacgtacgggtaaaccctaaggtaaggtttaacgttttaacttttaccgaaaccttttaattttaacgttacgtaacgtaaacctaagtaaacgttttaaaccctaggttaacgtttttcggggttaaccccggaaaacggtaaccgggtaacctaaacccggttaaattaaaacccggttaaaagttaacccggnggtttcgggaacgcccgtttaaaccaacgttaccgtagtttaccgttcttacccggttacttaaccccgggtcccctttacccgggaacttgttccggtaacgtttacg

SEQ ID NO: 139812 - DNA, 731 bp, Homo sapiens
  misc_feature: GYAE6OF01A3HWC.46.67.G01.1.454.CMB.1.raw
  modified_base (212)..(212): a, c, t, g, unknown or other
  misc_feature (212)..(212): n is a, c, g, or t
  modified_base (338)..(338): a, c, t, g, unknown or other
  misc_feature (338)..(338): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggccacgactggtgaggccttcggacgaccctgtccctcacctgcgctgtctctggtcncctcatcagtagttgtttctcgtggggctgggtccgcacgcctccgagggagggctggaatcgtagttggaagtgtctctcattaggtggtacgtttcctattacgcgttcccgtctctacgaagngtacgataccacctatactctcgtacgacactcagactaaattcgttaccgttttcccgagtaaacgtgttacgtacggtttccgtcggttaccgaccccgtccgtacgtacggtaaccgtacggggtttacttttattacgttggtccggacgtacggtaacggtaccggttatttaacggtttgttaggttttaagtttttaggggtaggttttacggttttaaccttttaccggaacccgtacccggttagacccgggttaccggggtaccgggggttccccttaccggggaccccggttggggggaacccttaaaggggtaccttaccggtacgggttacccctaccgggtttcccctaacccggtttacccgccccgttaaaccccgg

SEQ ID NO: 139813 - DNA, 736 bp, Homo sapiens
  misc_feature: GYAE6OF01EQSFL.46.67.G01.1.454.CMB.1.raw
  modified_base (178)..(178): a, c, t, g, unknown or other
  misc_feature (178)..(178): n is a, c, g, or t
  modified_base (217)..(217): a, c, t, g, unknown or other
  misc_feature (217)..(217): n is a, c, g, or t
  modified_base (270)..(270): a, c, t, g, unknown or other
  misc_feature (270)..(270): n is a, c, g, or t
tcagactagcagtacacgaccggtgctcgatttagagtatacatattgggtttgtccctcctgctggtggcagctcccagatgggtcctgtccctggtgcaactgcaggagtccgggcccacgactgggtgacggccttcggacgaccctgtccctcactgccgtctgtctctggtcncctcatcagttgttcggttctggtgggcgtcgggaccgnacgcctaccggaggggaacgggtctaaggtaatacgtagtggagtctcgtacngtagttaggtcggtagtttacctaattaaccgacggttcccgtcttccgtaagaaggtcgtacgacttaccaactaagttcctacgtccgtaggaccaccgtacgatactaacgttcttaacgttttccgaagaagttacgttagtaccgtttacgcggtaccgaccgtccgtacggtacggtacgtaacggggtttcttttaacgtaatcgtacgggacgtaggacgtacgtacttagttattgttagtttagtaggtttacttacgtactaccgaactaggacgtcgggaccggtctacccggaccggtaagggacgtaaacggtaccgtttaacggcttaaccgtacccgttaccgtaccgtaccgtaccctaacccggaacccgtacgggtaccttacccggtacccttccccgtacccgcccgtaacccctaccggtccctaaccgagtccccgtaaccgg

SEQ ID NO: 139814 - DNA, 763 bp, Homo sapiens
  misc_feature: GYAE6OF01CXFFG.46.67.G01.1.454.CMB.1.raw
  modified_base (197)..(197): a, c, t, g, unknown or other
  misc_feature (197)..(197): n is a, c, g, or t
  modified_base (200)..(200): a, c, t, g, unknown or other
  misc_feature (200)..(200): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccactccctccctgtctgccaaccggtggganacngtgtaccaccatccacttcggccgggacaaggtaccggaaactagttcgaacctaacctttaattttaaagttggtaataccaaacgtaataacgaaccgaggggacccggtaccctaagccttaccgtaatcctaagtcgactgctatcctagttagacgtaaggtcgggtacccagtcggtagttcgaggttcgagtacggtgtagtcgtagggaactacggtactttccgactctaccgactatactaagttaactcgtacgacgtaacgtagtaagtttacgtttacgtaacttaaacgttttagtaaccttaggttaaaccctaaagtaaaccgtttaaagttttaacccgttaaaagggttttcggttttaacccgggaacggttaaaaccgggtaaccgtaaacggtaaaccgttaaaaccttaaaacgtttaaaccggaaacgtttgggttacggaccttaccgaacccgtaaccgtaacgtttccgttaacggttccttacccgttaacccgtttacccgtaaccccttcgtaacttcccgggttattaaaccg

SEQ ID NO: 139815 - DNA, 884 bp, Homo sapiens
  misc_feature: GYAE6OF01A09Z6.46.67.G01.1.454.CMB.1.raw
  modified_base (150)..(150): a, c, t, g, unknown or other
  misc_feature (150)..(150): n is a, c, g, or t
  modified_base (302)..(302): a, c, t, g, unknown or other
  misc_feature (302)..(302): n is a, c, g, or t
tcagactagcagtacacgaccggtgctcgatttagagtatacatattgggtttggggagtctcggtcaggacacagcatggacatgacgggtccccgctcagcctcctggggcctcctgctactctggcctccggaggtcgccagattgngacactcgagctacgaccctagtcctaccactcccgtcctaggtctacgacgtaaccggtgggacacgtgtctaccacctagtctcgtcgggccggaactacgggtacgaactagtactaaccgttaactttaaagttttaaagtcggttanaaccaacgtaacggtaaccggacccggacgggtacccgtaccctacgtcctaccgtaattcgtactggacctgtaacctcgttaccgttggtttaacgaccgtaacgggttccggaacctattcgggtaagttcgcgtacggtcgtaacggtagtacgtaaccggtacggtaactcgtttacttacccttacgtccgtaccaacgttacttacgttaacgtctacggttacggactttaacggacgtttaacgttattaaccggtacctttaacgtttaaccgtttaccgtacgtaaaccgttaaacggtaccgttttaaacttttacgggttaacccgtttacggggttaacccctaaaaccgggggaacggtttaaaccccttaaaacccggggttttaaacttaaaaacccggttaaaccggttaaacccggttaggttttccccggaaacggttttaacccgaccggtttaaacctaccttttcccggggttaacctttccggttaactttaacccccgggggtttacccctacccggttaccccaccggtttttaaccgtcccggtttaactaacgg

SEQ ID NO: 139816 - DNA, 739 bp, Homo sapiens
  misc_feature: GYAE6OF01BTAEV.46.67.G01.1.454.CMB.1.raw
  modified_base (231)..(231): a, c, t, g, unknown or other
  misc_feature (231)..(231): n is a, c, g, or t
  modified_base (380)..(380): a, c, t, g, unknown or other
  misc_feature (380)..(380): n is a, c, g, or t
  modified_base (648)..(648): a, c, t, g, unknown or other
  misc_feature (648)..(648): n is a, c, g, or t
tcagactagcagtacacgaccggtgctcgatttagagtatacatattgggtttgtcctcctgctggtggcagctcccagatgggtcctgtccctggtgcaactgcaggagtcgggccccacgactggtgaggcctttcgggagacccttgtcccctcaccctgcgtctgtctcgtggtcgccctacatcggtagtagtttcgttttctcggtgggtcgtcggggtccgacncgtccgtacccggaagggggacgggcgtaaggtaactacgtaggttaggaggttctccttctatagttaggtggttacgttaccttaattaccgacgttccgtcttctacgaagtcgtcgataccactatactctgtacgacacgtcanactatcgttactttccgagtagtgtagttagttcgtcgtaccgaccgtcgtacgtaacggtacggtaccggtttacgtttttacgtacgttggtcgacgggaggtaacggccggtttaattagtttagttagttttaggtttggtaggttttagtttacttaccggtaacctccggttagtaccgtcggggtaccggtccgtacccggcccgggtagggaccgtaaggttacgtacgttccggtaccgtaccgttctacccggttacnccccgtaccgaacggtacccgtcccgtccggttcccgttccccctaccggtcccgtaccctaccccgttcccgaagtaccgccgtacccgg

SEQ ID NO: 139817 - DNA, 772 bp, Homo sapiens
  misc_feature: GYAE6OF01DVWBT.46.67.G01.1.454.CMB.1.raw
  modified_base (184)..(184): a, c, t, g, unknown or other
  misc_feature (184)..(184): n is a, c, g, or t
  modified_base (737)..(737): a, c, t, g, unknown or other
  misc_feature (737)..(737): n is a, c, g, or t
tcagactagcagtacacgaccggtgctcgatttagagtatacatattgggtttgtcctcctgctggtggcagctcccagatgggtccctgtccctggtgcaactgcagggtacgtccggggcccacgtactgggtgaggtcccttgggacgccctgtaccctcacctgcgtctgtctctggtcncctcatcgtagttagttcggtttctcggtcgggtcgtcgggtcccgcacgtccgtaccggggaagggggaacgggtctaggtaactacgtaggttagggaacgtcgttcctacgtataggttaggttacgggtacgtttacctaagttaccgtacggttcccggtacttcgacgtaaggtcggtacgtacgtaccactagttactccgtcgtacggacccaggtccaggtactacttccgttacgtttccgataacgtacgttgtacgttcgacgtaccgccgggactcgtaacggtcggaccgtttatttacgtgtcggagtacggaggtaccgtacgttactttagttagttagtttaggttaggttagggtttacggtttacgttccggttaacctaccgttggtaccggtaccggggtccgggtccggtacccgtaccgggtaccgggacggtacggttacgtccggtacgtccctaccggtccgtacccgtccgtaccccgtaaccggtacccgacccggtactcccggttcccgtcccggttccccnccgtaccctccccgtaactccggactcggtacccg

SEQ ID NO: 139818 - DNA, 822 bp, Homo sapiens
  misc_feature: GYAE6OF01B7QAX.46.67.G01.1.454.CMB.1.raw
  modified_base (179)..(179): a, c, t, g, unknown or other
  misc_feature (179)..(179): n is a, c, g, or t
  modified_base (226)..(226): a, c, t, g, unknown or other
  misc_feature (226)..(226): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactgggtgaggccttcgggacaccctcgtccctcaccgtgcgtctgtctcgtggtcncctcatcgtagttacgttcggtttctggtcggggtcgttcggggccncgtacgtccgtaccggaagggggaaggggtcctaagggtaaactactaggtttacgggaacgttcgtcctaccgtgaaaggttaggtacggggttaaccgttttaccttaacgttacggtaccggttccgttcctacgtaaccgaaaggtcgtaccggtaacgtaacctaaccgttattacttccgtcgttaacggacctaccggttacaacgacttacgttacttaccggtttaccgaggaaaacgtggttacgttaaccggttcgtcggaacccggtacccgccggtctaacgggtaccggtacgggtttactttaacgtggtgacggacggtaaggtacggtagtctttaaagttggttagttttaaggtttggaaggttttagttaacttaccggaccgttacgaggtacgtccggggtacggaccgttacccggaccggtacgggaaccggtaggtacgttccggtcgtaccccgtccttaaccgtcccttaccgtaccccgaccggaacccgggtacccgtccttacccggttccccgaccccttcccgacccgtccctaaccccctacggaactaccggccgtacccgg

SEQ ID NO: 139819 - DNA, 598 bp, Homo sapiens
  misc_feature: GYAE6OF01EWZJ8.46.67.G01.1.454.CMB.1.raw
  modified_base (320)..(320): a, c, t, g, unknown or other
  misc_feature (320)..(320): n is a, c, g, or t
  modified_base (341)..(341): a, c, t, g, unknown or other
  misc_feature (341)..(341): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggccttcggagaccctgtccctcacctgcgctgtctctggtgcctccatcagtagtggtttcttgtggggctgggtccgcagctcccgagggaagggctggaatacagttggaagtgtctctcagtagtggagttcctatacagtccgtctctcaagagtcgagtcacatatctcgtggacacgtccgancatctacgtttcccagaagtntagagtttacgtgtacgaccgccgtctcgacgtacgggtctttagtactgtgcgagagcgtactattatgtagttttggagttaggttatttacggacctaccgtagtacgtcgggtaccgggctacggaccccgtggggacctaggggtaactacgtacgtccgaccgtcttccgttagacccgtacccaacggaccggtaccacggtccgttccctccccgtcgtacctccccttacctccgaacgtcgtacccg

SEQ ID NO: 139820 - DNA, 676 bp, Homo sapiens
  misc_feature: GYAE6OF01BDMV0.46.67.G01.1.454.CMB.1.raw
  modified_base (135)..(135): a, c, t, g, unknown or other
  misc_feature (135)..(135): n is a, c, g, or t
  modified_base (194)..(194): a, c, t, g, unknown or other
  misc_feature (194)..(194): n is a, c, g, or t
  modified_base (226)..(226): a, c, t, g, unknown or other
  misc_feature (226)..(226): n is a, c, g, or t
  modified_base (629)..(629): a, c, t, g, unknown or other
  misc_feature (629)..(629): n is a, c, g, or t
  modified_base (648)..(648): a, c, t, g, unknown or other
  misc_feature (648)..(648): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtncagatgtgacatcgagctcgacccagtctccactcctcctgtctcgcaaccggtggganacagtcgtacacatctacgttcggccgggtanaacggtacggaactagttacggaactaaccttaagtttaaagttggttaactacaaactagtaacgaccgaacgggtaccggacccgtaacgtctacctaatctaactcggtctacgtcacttccgtagtttacgacgtaaggtccgggtacctagtcggtaggttcgacggtgcgtaggtggatacggtgggtacgagtttacttcgaacttctacgtaacctataccgtaagtacttacgtacgtaacgtaacggtagtaacgttaatttagaaacctttaacttacgttaacgtacgtaactaaacgtattaaacttaactaacgtttacgttacggaaccgtaacggtacctaaacgtaactaaacgtaaacgtaactacgtacgtacgtactacgaanaccttatactcgtacttcncgttacctccctatacgttctagtaacg

SEQ ID NO: 139821 - DNA, 806 bp, Homo sapiens
  misc_feature: GYAE6OF01EPBVC.46.67.G01.1.454.CMB.1.raw
  modified_base (196)..(196): a, c, t, g, unknown or other
  misc_feature (196)..(196): n is a, c, g, or t
  modified_base (233)..(233): a, c, t, g, unknown or other
  misc_feature (233)..(233): n is a, c, g, or t
tcagactagcagtacacgaccggtgctcgatttagagtatacatattgggtttggggagtctcggtcaggacacagcatggacatgagggtccccgctcagctccgtggggctcctgctactctggctccgaggtgccagatgtgacatcgagctcgacccagtcctccactcctccctgtctgcaaccggtgganacagtgcaccatcacttgccgggacaagtcggaactntgacctacttaatttaatggtatacaacatacgaccagggaccgaccctaagcctactaatctatgctgactactccgtagtttacgacgaaacggttcgggtacccctagttcggtaggttaccaaggtggaccgtaggttgggattccggtaggggacctaaggttactttaccgaccttctacccgtaacctacgtttaaccgtaagtttaacgtccgttacggtaaccgtaacgggttaacgggttaaactttaacggtttttacggaaaccttttaaaaccgttttaaccgttttaaccttaaacggttaaccctaaaacgttaacgtttaaaaaccgttttaaaccttaaacggtttttaccggggttttaacccggaaaccccgggtaaagggtaaacccgtaaacccggtttaaaaccttaaaaccgttaaaaaccgtttaaacgtaaaccggttacggtaccggttacgtaccggtaacctaacccgttacttaccgtttcggtttaccctttacgtaaccttttccccgtacccccgtattaaccgttcgttaaacgtaaccg

SEQ ID NO: 139822 - DNA, 730 bp, Homo sapiens
  misc_feature: GYAE6OF01BPZW6.46.67.G01.1.454.CMB.1.raw
  modified_base (165)..(165): a, c, t, g, unknown or other
  misc_feature (165)..(165): n is a, c, g, or t
  modified_base (376)..(376): a, c, t, g, unknown or other
  misc_feature (376)..(376): n is a, c, g, or t
tcagactagcagtacacgaccggtgctcgatttagagtatacatattgggtttgggggagtctcggtcaggacacagcatggacatgacgggtccccgctcagcctccgtggggctcctgctactctggctcggaggtgccagatgtgacatcgagctcgacccngtcctccactccctccctgtctcgaccgtaaccggtgggacgactagtcgtaccacactacacgttcgggccgggacaacggtcggaaactagttacgaacctaacctttaattttaaaagttggttaactaaccgaaagtagtaaccggaccggtaggggaacccgtaccccgttaaagcctaccctaaatcgttaacgtgacgtacctntacggttacctaggttttacgacgtaaacggggttcgggtacccaagtcgggtagttacaggtcgaacgtggtagacgtcggtagggactagtactttacactacttacaccgtaagtctaaactaacgttctacggtaactaacggttagtaagttaacttttgaaaccttaaatttacgttaagtactaaccgtaaacaggttaaactttacgtaacttttcggttaaccggaacggtaacggacctaaacgtaaacttaaacgttaaaccgaaaggtacgtaggttaggacctagaccctaacgtatacctcgttacctctaccgttcctacccgatctaccgtagtaccg

SEQ ID NO: 139823 - DNA, 779 bp, Homo sapiens
  misc_feature: GYAE6OF01B4IBZ.46.67.G01.1.454.CMB.1.raw
  modified_base (135)..(135): a, c, t, g, unknown or other
  misc_feature (135)..(135): n is a, c, g, or t
  modified_base (472)..(472): a, c, t, g, unknown or other
  misc_feature (472)..(472): n is a, c, g, or t
  modified_base (709)..(709): a, c, t, g, unknown or other
  misc_feature (709)..(709): n is a, c, g, or t
tcagactagcagtacacgaccggtgctcgatttagagtatacatattgggtttggggagtctcggtcaggacacagcatggacatgagggtcccgctcagctccgtggggctcctgctactctgctccggagtcnccagatcgtcgacatcgagctacgaccctagttctccacttcccttcccgtagtccgtagccgaaccggtggacacgtacgtcgtacacctatctacgtcggaccgggactaacggtacggtaactagtttacggaaccttaacgttaagttttaaagttggttaacctaacaactaagtaaccggaaccggtaacggggaacccggtaaccccgttaaggtacctttaacccgtaagttaccggtaacggttcggtaccgtaccgtacgttaccgttaccgtaggttttaaccggacgttaaacggggtccggtacccgtagtaccgtagtttcgngtaggtactggtggtacttacggtacgtagtacgtacgttccactaccgtcgaacgttgtacgtaagtagtcctacggtacgaagtacgttaacgttagttccgtaaacttacggtttacttacgtaacgtacgtaaataacgtaatttaaccgttacggtttacggtaacggttacgaaacgggtcctaaaacgtaaccgttaaataaaccgttaacggtaacgtcgttaaccggnttaccggaaccgttactaggttacttacggtaccttcctacggtccctacgtaccttatggtacttaccg

SEQ ID NO: 139824 - DNA, 719 bp, Homo sapiens
  misc_feature: GYAE6OF01DHE2C.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgactaccgtgggagacagtcgtcacctatcctacttcggaccgggacaacggtacggaactagttacgaacctaaccttaattttaaacgtggttaacttaccaaaactacgtaacggaacccggaacggggtaacccggacccttaaagcccttaaccttaattaccgttaagtcggtacttcgactacgttacccgtaagtttacggaaccgtaaacgggttcgggtaccctaggttccgtaacgggttcgaaggtggtacgtaggtcggtacgtacggtacgggtaacgtaacgtacttttaccgacttaccgtacctaacctactaccgtaacgttaactcgttacgacgtaacggtagtaaagtttcgtttacgtaacttaacgtttactacgtataacgtaactaagtaaattactagttacgttacgaccgtaagtacctaaacgtaactaaactaaacgtaacgtagtcggtacgctacgtacactactcgttcttcttactacttcccgttaccacgttactcgtcgtaacg

SEQ ID NO: 139825 - DNA, 736 bp, Homo sapiens
  misc_feature: GYAE6OF01DIVLV.46.67.G01.1.454.CMB.1.raw
  modified_base (112)..(112): a, c, t, g, unknown or other
  misc_feature (112)..(112): n is a, c, g, or t
  modified_base (132)..(132): a, c, t, g, unknown or other
  misc_feature (132)..(132): n is a, c, g, or t
  modified_base (230)..(230): a, c, t, g, unknown or other
  misc_feature (230)..(230): n is a, c, g, or t
  modified_base (240)..(240): a, c, t, g, unknown or other
  misc_feature (240)..(240): n is a, c, g, or t
  modified_base (385)..(385): a, c, t, g, unknown or other
  misc_feature (385)..(385): n is a, c, g, or t
  modified_base (472)..(472): a, c, t, g, unknown or other
  misc_feature (472)..(472): n is a, c, g, or t
  modified_base (733)..(733): a, c, t, g, unknown or other
  misc_feature (733)..(733): n is a, c, g, or t
tcagactagcagtacacgaccggtgctcgatttagagtatacatagttgggtttggggagtctcggtcaggacacagcatggacatggacgggtccccgctcagcctccggnggggcctcctgcctactcgnggctacggaggtcgccgaagatgtacgatacgacgacgcgtaccgacccgacgttccacctctcccgtcgtcgtcacgacgtaaccggtggactacgngtacaccacnctacgtcgtcggaacggacaacggtactaagtactacgtaacttaacttaagttaacgttacgtaacaacaagtaaccgaaaggaaaccggaccggggtaaccctaaccgtacgttaccttacgtaaactcttacggtcgtacgntaaccgttaccgtaacgttaccgtaagtaaccggttacgggtcccggaactggttacggggactacggaggtacgtcggagttacgngtacggtacgggtaactcaacggtctaccttaccgaataacgtacctaggtaaatcgtaacgtacgtaacggtatagttacttaacgtacgtaacttagtacgtaactagtaactaacgtaattaaacgttcgtaccgtacgttacggaacgtaaacggactaaactaaacgtaactaaacgaacggtcgttcgaggtacctaagaaccctttcgacttcggtcctacttcgtaccccgttacacgtaccttgtaaacgtntcg

SEQ ID NO: 139826 - DNA, 556 bp, Homo sapiens
  misc_feature: GYAE6OF01B1S67.46.67.G01.1.454.CMB.1.raw
  modified_base (193)..(193): a, c, t, g, unknown or other
  misc_feature (193)..(193): n is a, c, g, or t
  modified_base (216)..(216): a, c, t, g, unknown or other
  misc_feature (216)..(216): n is a, c, g, or t
  modified_base (371)..(371): a, c, t, g, unknown or other
  misc_feature (371)..(371): n is a, c, g, or t
  modified_base (395)..(395): a, c, t, g, unknown or other
  misc_feature (395)..(395): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgccaaccgtggganacagtgtcacatcacttgccggnaagtcggaacattgactacctatttaaattggtatcaacatacgaccagggaccgaccctaagctctaatctatgctgcatccagtttcgacgtaaggtcggggtaccagtcgaaggttcaggtcggcagtggatcgtggactagtattcactcncacatcatatcgtgacaacggttnaagtatttcgactaacttattctagtactaacgtagtaactttactaagttcggtttacgaccgtaaggacacgtaactaaacctaagtaacgactggtcgtactgacctactactcgttctaccttaccacgtttccctacccgacttcgtcctagtaac

SEQ ID NO: 139827 - DNA, 862 bp, Homo sapiens
  misc_feature: GYAE6OF01AO5QN.46.67.G01.1.454.CMB.1.raw
  modified_base (545)..(545): a, c, t, g, unknown or other
  misc_feature (545)..(545): n is a, c, g, or t
  modified_base (842)..(842): a, c, t, g, unknown or other
  misc_feature (842)..(842): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactgggtgaggcccttcgggacgaccctgtcccctcacctgcgcttgtctcgtggtcgccctccagtcaaggttagttcgggttttcttcggtgggggccttcgggggtcccggacacggcccgttacccggaaggggggaaacgggggtcctaagggtaaacttaccgtaggtttaggggtaaacggttccgttccttacttacgaacggtttaggttgggtaacggttttcccttaacgttttaaccgacgggtttcccttccttaccgttaccgaaaaggtacgttccgagttaacccaccctaagttacgttctaccgacggaacctaacgttcccgaagtaccaaacgtttcctaaccgttttttcccgaagaaacgtacgttcggaacgtttcgtacggccgaacccggtctaccgnggtaacccgtacgggttacttttaacttcgtgtacggaaccggtaggaacgtaaccgtagtttaacgttagttgtttaacggtttggtaacgtttagtttaacgttaccgtaccgtaaaccggttagtacgtaccggtacggggtccctaccggacccggtacggggaccgttaacggggaacttacgggtgtacctacccggacttaccgtaccgccccgtaacccgaccggtaaacccggtccctacgttccccggttaccccgttacccgtcccgggaccccttacccgtaccncccgaaacggccgtacccgg

SEQ ID NO: 139828 - DNA, 845 bp, Homo sapiens
  misc_feature: GYAE6OF01CHPFC.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggcccttcggacgaccctgtccctcacctgcgctgtctctggtcgcctccatcagtagttggtttctcgtgggcgtgggtccgcacgcctacccggaggggaacgggtctaggaacttacgtagttgggaagttcgttccttctacgtagttaggtacgggtacggtttccttaagttaccgtacgttcccgttctacgtacgaagtacggtacgacgtaccaacctagttacttccgtcgttacggaccgtaccgtccacgtacgtaacttaccgttacgttttacccgagtaacgtagttacgtacgtttcgtaggttcccggacccgtcccgtcgtacggtaccggtaccgggtttacgttttaacgttcgttcggtacggtacgaacggtacggtaacggttacctttaagtttacggtttagttttaaggtttttagggtaaggttttacggttttaacgttaaccgtacccgttaacccgtagtaccgggttaccgggtaccggggtacccgttacccgggtacccgggtacggggtaccggaacgggttacgttacgttaccgggtacctacccggttaccttcccggtaccgtccccgttaacccgaaacccggtacccggtacccgtacccggtttccccgttcccgttaccccccggtcgtaccccttacccccgttaccgtaacccgtacggacccgttacccgg

SEQ ID NO: 139829 - DNA, 990 bp, Homo sapiens
  misc_feature: GYAE6OF01ATZMV.46.67.G01.1.454.CMB.1.raw
  modified_base (193)..(193): a, c, t, g, unknown or other
  misc_feature (193)..(193): n is a, c, g, or t
tcagactagcagtacacgaccggtgctcgatttagagtatacatattgggtttgtcctcctgctggtggcagctcccagatgggtcctgtccctggtgacaactgcaggacgtccgggccacgacgtgggtagaggtcccttacgggacgaccctcgtcccctcaccgtcgccgtctgttccgtcgtcggtcnccctactatcgtaaggttcgttcggttttcgtcggtcggggtccgttcggggtaccgcacgtccggtaccggaagggggaacgggtcgtaaggtaactacgttaggttagggtaacgttcgtctacgtactaaggttaggtcggttaacgtttactaacgttacgtaccggttcccgttacctaccgtaacgtaaagggtacgtaccggtaacgtacccgaaccttacttacttccgtacggtaccgacctaccggtacacggtaacctaacttccgtttaaccgttttaccgaagtacgttaagtcggtttacgttcgtacggtaccggacccgttaccgacggttaccggtaaccggggttaaccggttttacgtttttaacgttaacgggtacggtacggtaacggtagtaaccgggtacgtttaacttttaagggttacgtttagggtttttaaggttttaacgggttaagtttttaccgggttttaacctttaacccgggaaccccgtttaacgggttacgggtaaccgggtaccccggggggtaacccgggttaccccgttaaccccgggggtaaccccggggtagggggtaaacccgttaaggggtaaccgttttacccggacccggttacccggtttaacccttcccgggttacccgtaacccggtcccccgtaaacccggtaacccgggtccccggttaaccccggttcccggtcccgtttacccccccgtcgtacccccgtaacccgtacccccttaacgtacgaaacccggttcccgtaacccggg

SEQ ID NO: 139830 - DNA, 692 bp, Homo sapiens
  misc_feature: GYAE6OF01CTFDD.46.67.G01.1.454.CMB.1.raw
  modified_base (259)..(259): a, c, t, g, unknown or other
  misc_feature (259)..(259): n is a, c, g, or t
  modified_base (318)..(318): a, c, t, g, unknown or other
  misc_feature (318)..(318): n is a, c, g, or t
tcagactagcagtacacgaccggtgctcgatttagagtatacatattgggtttgtcctcctgctggtggcagctcccagatgggtcctgtccctggtgcaactgcaggagtccggcccacgactggtgaggccttggacgaccctgtccctcacctgcgtctgtctcgtggtcgcctccatcagtagttgtttctcgtgggctcgggccgcagcctccgaggggacgggctaggaatcgtaagttggaagtcgtactcntagtcgtggtagttacctatacgtagtccgtctctacagtcgtcagtcactatactctntacggacacgtcagtacaactcgttactttaccgagagtatgacgttcgacgaccgacctcgcgtacgacgtacgggttactttaagtcgtgtcggacgagaacgtacggtatagttataggtttatttagggacgtttaggtttacgttaccgacctaaccggtacgtaggtccgggaaccgggtccgtacccggtacccgggttacgggaccggtaacggtaacgttaccggttacggttacccgtaccggttactaacccgttacccgcccttaacccgaacccggtacccgggaccttacggtccccggttacccctcccccggtacgtaccccctacccgtacccttaaccggaactccggtaccccgg

SEQ ID NO: 139831 - DNA, 756 bp, Homo sapiens
  misc_feature: GYAE6OF01DF2BJ.46.67.G01.1.454.CMB.1.raw
  modified_base (226)..(226): a, c, t, g, unknown or other
  misc_feature (226)..(226): n is a, c, g, or t
  modified_base (367)..(367): a, c, t, g, unknown or other
  misc_feature (367)..(367): n is a, c, g, or t
  modified_base (422)..(422): a, c, t, g, unknown or other
  misc_feature (422)..(422): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcgaggagtccgggcccacggacgtggtgacggtccgttcgggaacgtcccttcgtccctcacctgcgtctgtctcgtggtcncctacagtctaggttaggttcgtttcttcggtggggccgttcggggtccgctacgtccgtaccggaggggaagggctaggaactagagttggaacgtgtctcatagttaggtggtacgttaccttagtcacgttccgtctntacgagcgtcgactcacctaattctaccgtcgtaacgggcctaaccgtcgtaaanacctaacttccgtttaccgtttacccgtaaggaacgtagttacgggttacctttcggttacggtcccgtacccgggtccgttacgtacgggtaacccggttacgggtttacgtttttaacgtagtccggtaggaaccggtagtaacgcggtttaacttaattaggttagttttacgtttgggtaacgggttttaattcccgttttaacgaccgtaaccgttaggacggttcccggggaacggtcccgttacccggccccggggtagggtaaccggaaggttacgtcgttaccggtacccgtacttccgttacccgttagtcccctaaacccggg

SEQ ID NO: 139832 - DNA, 709 bp, Homo sapiens
  misc_feature: GYAE6OF01A1E7H.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgacgctcgaccctagtcctcctatcccttcctgtctcgacgacggtgggacacgcgttgccaccatctacttcggccgggacaacggtccgaatacgttacgactaaccttaatttaacgttgtactacaactatacgacgacggtaccgcctaacgtctaccgtaatctagtacgctgtactacttaccttacggttacgtaacgtaaacggtccggggtaacccagttaccggtacggtttagacgggtcggtacgtaacggtacggttacgtcggtacgggtaactagttacttacaccgtttaccacgtaacctacgtagtaacgtaacttcgtaacggactaacgtaagttagttaacgtttaacgtaacgtttaacttacttaacggttactaactaacgtaactaacttactaagtttaacggtccggtaaccgaaggaacctaacgtactaaaactaaacgttaacacggttacgacgtacgtagaccctactacgttacgttacgtaccttacctacgttccctacgtacccttataacggtattaaccg

SEQ ID NO: 139833 - DNA, 577 bp, Homo sapiens
  misc_feature: GYAE6OF01DLYWG.46.67.G01.1.454.CMB.1.raw
  modified_base (178)..(178): a, c, t, g, unknown or other
  misc_feature (178)..(178): n is a, c, g, or t
  modified_base (382)..(382): a, c, t, g, unknown or other
  misc_feature (382)..(382): n is a, c, g, or t
  modified_base (569)..(569): a, c, t, g, unknown or other
  misc_feature (569)..(569): n is a, c, g, or t
tcagactagcagtacacgaccggtgctcgatttagagtatacatattggggtttgggggagtctcggtcaggacacagcatggacatgagggtccccgctcagctcctggggctcctgctactctggctccgaggtgccagatgtgacatcgagctgacccagtctccatcctccctntctgcaaccggtgggagacagtgtcaccatcacgttggccgggactaagtccggaaactattgacctaaccttaattttaaaattggtaatacaacagtaagaaccagggaccggccctaagctacctaatctatgctgcactcctagtttagactaaaggtcgggtaccctagtcgaggttcaggtgacagtgatcgtggacngtattcactctacactatactaagtatctagacaagtagaagttatttacgacttaattactacttacgactaacaataaattactaagttcgtttacgaaccgtaaggtactaacgtaacttaaacaaagttaacgaattcggtagctagacgtactatcgtctactacgtacttccctaccactntctgtaac

SEQ ID NO: 139834 - DNA, 634 bp, Homo sapiens
  misc_feature: GYAE6OF01BIOXC.46.67.G01.1.454.CMB.1.raw
  modified_base (416)..(416): a, c, t, g, unknown or other
  misc_feature (416)..(416): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgcgaaccggtgggagacagtcgtcaccatccacttcggccgggacaaaggtccggaactattcgaacctaccttaattttaaacttggtaactacaaactaagtaacggaaccgacggggaccggccccttaagcctacctaatcctatgctgctactcgtagtttcgacgtaaagggtcgggtacccagtcggtagttcgaggtggacaggtggatcggtaggactagtacttcnctctccacatactaagtactgacgtactaacggtagtacgttagtttacgacttaactttacttacgtacgtacctaagtaataacgttaactagtttcgttacggaccgaacggtactaacgtaactaaacgtaaacttaacggacgttggtacgtacctagacctaaccgattcgtcttaccttactacgttccctacccgtctacttctgtaacc

SEQ ID NO: 139835 - DNA, 818 bp, Homo sapiens
  misc_feature: GYAE6OF01EGT6M.46.67.G01.1.454.CMB.1.raw
  modified_base (192)..(192): a, c, t, g, unknown or other
  misc_feature (192)..(192): n is a, c, g, or t
  modified_base (212)..(212): a, c, t, g, unknown or other
  misc_feature (212)..(212): n is a, c, g, or t
  modified_base (248)..(248): a, c, t, g, unknown or other
  misc_feature (248)..(248): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggccacgactggtgacggccttcggagaccctgtccctnacctgcgctgtctctggtcncctccatcagtagtgtttctcgtgggctgggtccgnagctccgagggagggcgtgaatacattggaagtgtctctctattaggtggtacggttccttaagttacgacgttccgtctactacgaagtacgtcgaagtccaacctaatactacgtacgttcggaacctaccgtaccaaggtactaacttaccgtacgttttaccctaggtaaacgtagttggtaacgtttcgtacggttaccgaccggtccgtaccgtacggtaaccggtaaccggggtttacgttttaacgtttaaccgtggttacgaccgggtaaggtaacggtaaccgggttaacctttaagtttaacggtttaacggttttaaggttttttaacggggttaacgggtttttaaggtttttaacccgggttttaacctaaccccggttaaccccgttaaggtaacggttacccgggggtaacccgggggtacccgttacccccgggtaaaccccgggtgggggttaaccccggtaaagggggtaaacccgttaaccggttacccggtacccggttaaccccggtttaccttaaccccgttaaccggtaccccctaaacccccggg

SEQ ID NO: 139836 - DNA, 714 bp, Homo sapiens
  misc_feature: GYAE6OF01A564X.46.67.G01.1.454.CMB.1.raw
  modified_base (707)..(707): a, c, t, g, unknown or other
  misc_feature (707)..(707): n is a, c, g, or t
tcagactagcagtacacgaccggtgctcgatttagagtatacatattgggtttggggagtctcggtcaggacacagcagtggacatgagggtccccgctcagcgtcctggggctcctgctactctggctccggagtgccagatgtcgacatcgagctcgacccagtcctcctactccctcctgtctcgcctaaccggtggacgactagtcgtccactatctacgttcggaccgggacaaggtccggaactagttcgaacctaaccgtttaagttttaaagttggtaactaccaaacgtagttaacgaccggtacggggtacccgaccctaagccttacctaagtcctaagtcgactacgtcctaacttcgtagttacacggtaacggtcgggacccttaggtaccggtacgttaccgtacggtcgtacgtagggtacgtacgtcggttaggaacttacgtacttccgaccttctaccgtaacgtctaacgtaacgttactacggtacctaacggtaacgttagtaaagttactttcgaaccttaactttacgtccgttacgtaacacgttaagttaacttacgttaacgtttcggttaaccgaacgtaggaccttaaacgtaacctaataaacgtacgacgttgaccgtagtacacgtacgttactacgttcgtacgtaccttacgtacccttaccggattccgttntagtccc

SEQ ID NO: 139837 - DNA, 622 bp, Homo sapiens
  misc_feature: GYAE6OF01AOLAN.46.67.G01.1.454.CMB.1.raw
  modified_base (209)..(209): a, c, t, g, unknown or other
  misc_feature (209)..(209): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtgggctgggtccggnagcctcccgaggggacgggctggaatacagttggaagttgtctctcagttaggtggtaggttccttattacacgtccgtctctacaagagtcgagtccaccatactctcgtaggaccacgtccagacaatcttacgttttccctagaacgtatagtagttctcggtcgacccgccgctacgacgtaccgggtcgtttattacgtgtcgcgagagtacggtctattagtagttagttttggtagtttggttactttcgacctaccgtagtacgtcgggacgggcctccggacccggtacgggccgtaaggtactacgtcggtctaccgtcttactcgcccgtaccgacccgtacggccctacgtcccgttcccgttccccgtcgtaccctacccctaccgacccagccgtaccg

SEQ ID NO: 139838 - DNA, 665 bp, Homo sapiens
  misc_feature: GYAE6OF01C5KN0.46.67.G01.1.454.CMB.1.raw
  modified_base (151)..(151): a, c, t, g, unknown or other
  misc_feature (151)..(151): n is a, c, g, or t
  modified_base (201)..(201): a, c, t, g, unknown or other
  misc_feature (201)..(201): n is a, c, g, or t
  modified_base (247)..(247): a, c, t, g, unknown or other
  misc_feature (247)..(247): n is a, c, g, or t
  modified_base (392)..(392): a, c, t, g, unknown or other
  misc_feature (392)..(392): n is a, c, g, or t
  modified_base (429)..(429): a, c, t, g, unknown or other
  misc_feature (429)..(429): n is a, c, g, or t
  modified_base (508)..(508): a, c, t, g, unknown or other
  misc_feature (508)..(508): n is a, c, g, or t
tcagactagcagtacacgaccggtgctcgatttagagtatacatattggggtttgggggagtctcggtcaggacacagcatggacatgagggtccccgctcagctccgtggggctcctgctactctggctccggaggtgccagatgtgacntcgagctcgacccagtcctccatccctcctgtctgaccaaccggtggganacagtcgtcaccaatcaacgttggcccggataacggtacggaactnttacgaacctaaccttaattttaaagtagtaactacaaactagtaacgaaccgaagggacccgtaccctaagaccttaacctaatctagtcactgaccactaccgtagttcgaacgtaaggtcggtaccctagtcgtacgttagnggtagcgtagtgtaatcggtaggatacgtactttacnctacacaacctagtacctagttaacctgtacgtaacgaacgtagtaaacgtttattaagtaaccttaaatttacgttanaaccgtataaaacgaagtttaacttaacgtttaagggttcgttaacggaaccggtaaaggaacctaacgaacttaaactaaagttacgaagttcggatcctacgaacctacctagttcgtacttcgtactacttccccgacctgaactgttaagacc

SEQ ID NO: 139839 - DNA, 918 bp, Homo sapiens
  misc_feature: GYAE6OF01DOI78.46.67.G01.1.454.CMB.1.raw
  modified_base (154)..(154): a, c, t, g, unknown or other
  misc_feature (154)..(154): n is a, c, g, or t
  modified_base (175)..(175): a, c, t, g, unknown or other
  misc_feature (175)..(175): n is a, c, g, or t
  modified_base (274)..(274): a, c, t, g, unknown or other
  misc_feature (274)..(274): n is a, c, g, or t
tcagactagcagtacacgaccggtgctcgatttagagtatacatattgggtttgtcctcctgctggtggcagctcccagatgggtcctgtccctggtgcaactgcaggagtccgggcccagactggtgaggtcccttcggacgccctgtccctnacctgcgctgtctcgtggtcncctacatctagtgttggtttctcggtgggctggggccgcacgtcctaccggaaggggacggggtctaggaattactagttaggaagttcgtccgtactntaagttaggtcgggtacgtttacctacttaaccgtacggttcccgtttctacgtaacggaaggtacgtccggtaactacccaacgtctttactccgttacgtacggaacccgtctacgacgtaactactttcggtttaccgttaccgtagtaaacgtcgttagtacgttcgtaacgggcccggtaacccgtcgtacggtacggtaacccggtcgggttttacttttacgtaacggtcgggtaacggtacgggtaacgtacgggtacgtttaacgttagtttacgttaaggttttggtttaacgggtttacggtttacggttttaaccgtttaccgtaacccgtttaaccggtacggttaaccgggtaccccggggtaaccggggtccccgtaacccgggttaccccggggaccggggttaccggtaaacggggttacccgtttaaccgggttaccgggttaaccccgtcccggtttaacccgttaaccccgggtaccctacccccggtaaccgtaaacccggggtaccccgggtaacccgtttacccgggttcccccccggttacccctttcccccggtaccccggtaacccccctttaccccttacccggtaaaccccgtaaccccgggccttaaccccgggg

SEQ ID NO: 139840 - DNA, 802 bp, Homo sapiens
  misc_feature: GYAE6OF01AQ2WM.46.67.G01.1.454.CMB.1.raw
  modified_base (195)..(195): a, c, t, g, unknown or other
  misc_feature (195)..(195): n is a, c, g, or t
  modified_base (786)..(786): a, c, t, g, unknown or other
  misc_feature (786)..(786): n is a, c, g, or t
tcagactagcagtacacgaccggtgctcgatttagagtatacatattgggtttggggagtctcggtcaggacacagcatggacatgagggtccccgctcagctcctggggctcctgctactctgactccgaggtgccagatgtgacatcgagctcgacccagtcctccatccctccctgtctgacaacggtgganacagtcgcaccatcacttcggccgggacaaggtcggaactattcgactaccttaatttaaagttgactacaactatacgaaccgacgggacccgtaccctaagtcctacctaattcctagtcgctcgactacttaccgtaggtttacgaacgtaaacgggttccgggtaccctaaggtacggtacggtttacgacggttcggacgtacggttagggaacttcggttaagggactaagtttcgtttacccaaccgttccgtaaccgtactaacgttacgttaacgtttacgttccggtacgtaaaccggttaacggtttaaggttaaaccgttttagttttaacgaaaccttttaacgttttaacttaaccgttacgttaaacctaaacggtaagtttaaacttttaacgttaacggtttttaacccgggtttaaccggggaaacccggtaaaccggtaaaccgtttaaaacgtaacccctttaaaaggttaaaacccgtttaaaggtccgttaacgggtcgtaaccgttaccgaacccgtaaccttacgttccggtttacttacccgttactacccgtttccaacccgttntacgtattacggtaac

SEQ ID NO: 139841 - DNA, 762 bp, Homo sapiens
  misc_feature: GYAE6OF01A18PU.46.67.G01.1.454.CMB.1.raw
  modified_base (717)..(717): a, c, t, g, unknown or other
  misc_feature (717)..(717): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctcgacccagtctccatccctcctgtctgcaaccggtgggagacagtgtccaccatcacttcggccgggacaaggtccggaactagtttcgaacctaacctttaaatttttaaaagttcggtaacttaccaaaactaagtaacggaacccgaacgggggaacccggtacccctaaacggccttacccttaaacttcctaacgttcgaccttcggacctaacgttacccgtaggttttacgaacggtaaaacgggttccggggtaccctaacgttacggtaacgggtttcgagggttcgggacgtagggtcggtacgtcggtagggaacgtagttactttccgactcctacacctactacgtaagttaactcgtacggaactacgttagtaaacgtttacgtttagaaccctttaactttacgttaccgttacgttaacgaaacgtaacgttaactttaacgttaacgtttcggttttaccggaaccgaacgggaacctaaccgtaacttaaacgtaaaacttaacgtacgtacggtagccgtacgtacctaccgtattaccgttnttcccttattaccttcccttacccgactacgttcgtacgtaaccg

SEQ ID NO: 139842 - DNA, 791 bp, Homo sapiens
  misc_feature: GYAE6OF01DMSGQ.46.67.G01.1.454.CMB.1.raw
  modified_base (242)..(242): a, c, t, g, unknown or other
  misc_feature (242)..(242): n is a, c, g, or t
  modified_base (558)..(558): a, c, t, g, unknown or other
  misc_feature (558)..(558): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgacaactgccaggacgtccgggcccaacggactgggtagacggtccctttacgggacgtaccccttgtccccgtacaccttggccgccgttggtcctcgtggtcncctccaatcgagttaggtggttttctcggtcggggtcttacgggggtccgagtacgcccggttaccgaaggggaacgggcgtagggtaactacgtaggttaggtaagttcgtacttcgtaccgtagttacggtagggttaacgtttacccgttagtttaaccgacggttcccgtcttccgtacaacgtacggtcgtaacgtccaacctattacgtccgttacgttacggaacctacgttacgactacctaatccgttacgttttacccgaggtaagttacgttagttaccgtgttacgtccgtaaccgtccgtacncggtaacgtaccgggttacgttttataccgtaggtcgaacgtagaacggtacggtacttaagttacgttggtttagtttacggtagttaccgtttacgttaccgacttaccggacgttacggtacgggtaccgggtccgtacccgggtaccccgggtagggtacccggaaggttacgacccgttacggtccccttaaacgtccccgttaaccgtcccgcccgttaaccccggg

SEQ ID NO: 139843 - DNA, 753 bp, Homo sapiens
  misc_feature: GYAE6OF01DD2RO.46.67.G01.1.454.CMB.1.raw
  modified_base (213)..(213): a, c, t, g, unknown or other
  misc_feature (213)..(213): n is a, c, g, or t
  modified_base (302)..(302): a, c, t, g, unknown or other
  misc_feature (302)..(302): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggccacgactggtgaggccttcggagacccctgtccctcacctgcgtctgtctcgtggcncctcatcagttgtgtttctcgtgggcgtgggtccgcagtccgtaccgaggggacggctaggaatacgtagttaggacgttcgtcctctnagttaggtcggtaggtttaccttaagttaccgagttcccgtctctacgaaggtacgtcgacgtaccacctatactcgttacgcgtaactaccgtaccgaatctaactcgttaccgtttcccaagtaacgtagtcggttacgtttacgtcggtaccgacccggtcccgtacgttacccggaacggttaccgggtttacgttttaacgtacgttacggtcgaccggaaggtaaccgggtaccgtacttaacgttttaggtatttacgggtttttaggagttttacggttaactttacgtaccctaccgttaaggaccgttcggggtacccggtaccggttacccgggtacccgggttaccggggtaaccggtaacggggtaaccgtttcccggttaccgggtacccgttaacccgttcccgttaacccgttcccgtacccgtaaaccccccgg

SEQ ID NO: 139844 - DNA, 629 bp, Homo sapiens
  misc_feature: GYAE6OF01EQWM8.46.67.G01.1.454.CMB.1.raw
  modified_base (217)..(217): a, c, t, g, unknown or other
  misc_feature (217)..(217): n is a, c, g, or t
  modified_base (459)..(459): a, c, t, g, unknown or other
  misc_feature (459)..(459): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacactatttaaatgtatcaacatagacaggacgccctaagctcctatctatgctgcatcctagtttcgactaaacggtcggggtacccctagtacggtagggtttccaaggttggacgtaggttagggacgttcgtaggggactagtatttccactcgtcaaccatactagttaactcgttgacaacggttagtaaagttattttcgacttaactttactttaacgtntacgaaactagtaaattacgtaatttggtttaccggacgaaacgggtacctaacggtaacttaaacgtaaagttaaacggtaactcggtagtacgttacgactaaccgtattacgttcgttaccgtttacctaaccgttcccttaccccgtccttacttccctgttaacg

SEQ ID NO: 139845 - DNA, 709 bp, Homo sapiens
  misc_feature: GYAE6OF01B3T3B.46.67.G01.1.454.CMB.1.raw
  modified_base (249)..(249): a, c, t, g, unknown or other
  misc_feature (249)..(249): n is a, c, g, or t
  modified_base (672)..(672): a, c, t, g, unknown or other
  misc_feature (672)..(672): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccggcccacgactggtgaggccttcggacgaccctgtccctcacctgcgctgtctcgtggtgcctcatcgagtgtgtttctcgtggggctgggtccgnagctaccgagggagggctaggaatacgagttggaagtgtctctcagtaggtggtacggtttacctagttacacggttccgtctctacaagtagtcgagtcacgtatacgtctcgtggaccacgtccagactaatctacgttttcccaggtaacgtagtagtacgtttcgtaggtacgtacccggccgtacgtacggtaaccggtacggggtttaccgttttaacttcgttggtacggacggtacggtacggtaccgggttacttaagtttaacgttcggttttaaggtttttagggtaggttttggtttttaaccgtttcgtaacccgttaaccgtaggtaaccggttccggggaccggggtcccgtacccgggtacccgggttcggggaccggtaaacgggtacttacgggtcggttacccncccggttaccgttacccgttacgccccttaaccccgg

SEQ ID NO: 139846 - DNA, 573 bp, Homo sapiens
  misc_feature: GYAE6OF01DZ7ZL.46.67.G01.1.454.CMB.1.raw
  modified_base (219)..(219): a, c, t, g, unknown or other
  misc_feature (219)..(219): n is a, c, g, or t
  modified_base (230)..(230): a, c, t, g, unknown or other
  misc_feature (230)..(230): n is a, c, g, or t
  modified_base (409)..(409): a, c, t, g, unknown or other
  misc_feature (409)..(409): n is a, c, g, or t
  modified_base (450)..(450): a, c, t, g, unknown or other
  misc_feature (450)..(450): n is a, c, g, or t
  modified_base (533)..(533): a, c, t, g, unknown or other
  misc_feature (533)..(533): n is a, c, g, or t
  modified_base (563)..(563): a, c, t, g, unknown or other
  misc_feature (563)..(563): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttggccggganaagtcggaacnttgacacttatttaaatggtatcaacatagaccgaggggtaccgccctaaagcctactaatctatgactgctatccgtaagtttcgactaaaggttcgggtacccaagtccggtaaggttcaggtggactaggtggatcgtgggacagtactttcacttcacacgatacgaatacttcngaccgtaagtgtaaagttattttcgaactaactttatactntacaagtataacttacagttacgttcgacgaaggtacagtactaacaaagttaaccgatggtagactcgctaactattcggtnttaccttctaacttcccggttacccacttntccgtgtaac

SEQ ID NO: 139847 - DNA, 580 bp, Homo sapiens
  misc_feature: GYAE6OF01E5ASN.46.67.G01.1.454.CMB.1.raw
  modified_base (354)..(354): a, c, t, g, unknown or other
  misc_feature (354)..(354): n is a, c, g, or t
  modified_base (542)..(542): a, c, t, g, unknown or other
  misc_feature (542)..(542): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgccaaccggtgggagacagtgtcaccatcacttggccgggcaaggtcggaacattgactacctatttaaatggtatcaacatagaccagggacgccctaagctcctaatctatgctgcatcctagtttgacaaaggtcgggtcccagtcgaggttcaggtggcaggtggatcgngggacagtatttcactctcacctatactaagttaatcgtgacgtaacgtgtaaagttattttagacttaaactttattaacttgtacaaactaagtaacttaactaagtttacggtttacggaaccgtaacggactaacgtaactaaactaaagttaaacgactggtagctacgtacacctatacgtnttacctactacgttccctcccgactacttcgtagtacg

SEQ ID NO: 139848 - DNA, 613 bp, Homo sapiens
  misc_feature: GYAE6OF01A0EM2.46.67.G01.1.454.CMB.1.raw
  modified_base (210)..(210): a, c, t, g, unknown or other
  misc_feature (210)..(210): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttggagaccctgtccctcacctgcgctgtctctggtncctcatcagtagtgtttctcgtggggctgggtccgcagcctccgagggagggctaggatacagttggaagtgtctctcataggtggaggttcctatacagtccgtctctacaagtagtcgagtcacctatatctcgtgacaccgtcagtctaactctacgttttacccgagtaacgtgtgtacgttcgtgtcgacccgtccgtcgttacgacgtacgggtcttttacgtacgtgtcgcgtaggacgcgtacttagttagtgttacgttttggagtttacggtttacgttacgaccgtaccgtagtacgtacgggaccggggtccgtaccggacccggtcgggacgtaacgggtacgttacggtcggtaccgtacccgttactccttacgtcccgtaaccccgg

SEQ ID NO: 139849 - DNA, 990 bp, Homo sapiens
  misc_feature: GYAE6OF01CO1S2.46.67.G01.1.454.CMB.1.raw
  modified_base (198)..(198): a, c, t, g, unknown or other
  misc_feature (198)..(198): n is a, c, g, or t
  modified_base (221)..(221): a, c, t, g, unknown or other
  misc_feature (221)..(221): n is a, c, g, or t
tcagactagcagtacacgaccggtgctcgatttagagtatacatattgggtttgtcctcctgctggtggcagctcccagatgggtcctgtccctggtgcaactgcagggagtcgggcccagactgggtgagggtccctttgggaacgcccgttcgtcccctcacctcgcgcttcgttctccgtgggtctccctaccgntcgtagtggttgttttctccggngggtcgtcggggccgcgacggtccgtaccggaaggggaacgggtcgtagtaaagtagtagttaggacgttcgtcctactagtagtggtagtacggtttaccttagtacgtaccttccgtactacgtacgaaaggtacgttcgaacggtacccaactacttaacggttccctaacggttaacccgggaacctttaccggaccgtaacgtaccgttaaaaccttttcccggtttaaaccggtttttacccgaaaagggtaaacgttagtttaccggtttaacgtttccgggttacggttaccccggaaacccgggttcccccttaaggggttaaccccggtaaacccgggggtttaacgggttttttaccctttttaaagtttcccggttaggaacccgggagtaaacgggtaaccgggttaaccgggtttattttaacgggtttaagtttacgggtttttaaaggttttacggggttaaacggtttttacggttttaacccgtttaaaccggttaaccccgtttaaacgggtaacgggttaacccggggtttaccgggggaacccgggttacccggttccccggggtaacccgggtacccgggggtaacgggtaaacgggttccgttaaacccggtcgggttaccccgttaccggttaccgtaaccctttcccggaacccttacccgaaccggtacccgtacccgttcccggttccgtacccccttccgaaccccgtccgtaccctacgtaacgacggtccctacccggg

SEQ ID NO: 139850 - DNA, 965 bp, Homo sapiens
  misc_feature: GYAE6OF01BJFC0.46.67.G01.1.454.CMB.1.raw
  modified_base (717)..(717): a, c, t, g, unknown or other
  misc_feature (717)..(717): n is a, c, g, or t
  modified_base (950)..(950): a, c, t, g, unknown or other
  misc_feature (950)..(950): n is a, c, g, or t
tcagactagcagtacacgaccggtgctcgatttagagtatacatattgggttgggggacctcctgtgcaagaacatgagacacctcgtggtttgttcctcctcgtcgtcggtgggcacgcctcccacgagtcgggtccgtcgtccgtcggtggacactacgcgaggacggtccgggcccgacgtacgtggtggacggtccgttacggacgacccgtccgtccctaccgaccgtcgcgcttcgtctcgtcggtcgtacctcctatacggtagttggtttcggtttcttcggtcggggtcgtaccggtccggcgacgccgtaccggaacggggtagggtacgtacgtaacgtacgttaggttacgggtaacggtcttaccgttccgtaggttaaggttaacggggttacgggttaaccggttttaaccctttaacggtaacgtttaccccggttcgttacctaccgtaaaggaacgttaacggtccgtacgttaaccaacctaagttacctcgtacgtcggtaaccgtaaccgtcgacgtaacctaacgtttcccgtttaaccgttacgtaagtaaaggtacgtacggtttcggttaaccttcgggcccctaccgggtcccgtaggttaaccccgggtaacgggtttacccgggttttaacgtttaagttaccgggcggttaaacgcggggtaaaacgttaccggttaacccgggtttnttttaaaggtttagggtttacgggtttttaaagggttttcgggtaaacggggtttttaaccccgtttatttaaccccgggaacccgaaccggttttacgggaacggggttccccggggggttacccggggtaccccttaaccccgggttcccgggaggggtaaaccggtaacggggttacccttacgggtaccccggtttacccgtacccgttaaccgcggtttaaacccccncggtaaacccccggg

SEQ ID NO: 139851 - DNA, 777 bp, Homo sapiens
  misc_feature: GYAE6OF01BJ59D.46.67.G01.1.454.CMB.1.raw
  modified_base (181)..(181): a, c, t, g, unknown or other
  misc_feature (181)..(181): n is a, c, g, or t
  modified_base (212)..(212): a, c, t, g, unknown or other
  misc_feature (212)..(212): n is a, c, g, or t
  modified_base (258)..(258): a, c, t, g, unknown or other
  misc_feature (258)..(258): n is a, c, g, or t
tcagactagcagtacacgaccggtgctcgatttagagtatacatattgggtttgggggaccctcctgtgcaagaacatgaagcacctgtggtttgtcctcctgctggtggcagctcccagatgggtcctgtccctggtgcaactgcaggagtccgggcccagactggtgacgccttcgganaccctgtccctcacctgctctgtctctggtncatccatcgagttagttcggtttctcggtgggtctcggggtcccgnacgtccgtacccggagggggaacgggtcctagggtaacttagtacgttagggtaacgttgtacgttctacgtaagttacgggtgggtacggtttccctaagttaacctacggttcccgtcctaccgtagacggttagtaccggtacgtaccaactagtactccgtcgtacggaacctaccgtaccagtactaacttccgttaccgtttaccgaagtaagtagttacgttacgtttcgtacgtccgggacccgtccggtacgtaacggtaacggtaccggggtttaactttagttaccgttaggtcgggtacgtaaggtacggtacggttacgtttatttaacggttagttttaggttttacggtaggttttacgttacgtttaccggaccttaaccggtaagttccgggtaaccgggtaccgggggtccctacccggtacccgggtacggggtaaccggacgggttaaactccgggttacggtaccccttaggttcccttacccgttcccgtaaccccg

SEQ ID NO: 139852 - DNA, 809 bp, Homo sapiens
  misc_feature: GYAE6OF01CZC1N.46.67.G01.1.454.CMB.1.raw
  modified_base (391)..(391): a, c, t, g, unknown or other
  misc_feature (391)..(391): n is a, c, g, or t
tcagactagcagtacacgaccggtgctcgatttagagtatacatattgggtttgggggacctcctgtgcaagaacatgaagcacctgtggtttgtcctcctgctggtggcagcctcccagatgggtcctgtccctggtgcaactgcgagggagtccgggcccacgacgtggtgacggtccttcgggacgaccctcgtccctcacctgcgctgtctcgtggtcgcctccatcgagttagttggttttctcggtggggtcgttcggggtccggactcgtccgtacccggaagggggacggggtcgtagggaattaccgtaggttagggtaacgttcgtctactacagtaggtggtacgttactagttacgtacgtccgtactcgtacgtaagngtacgtacgtaccacctattactcgtacgtacggaacctccgtcaacgtactaacttccgttaccgttttacccgaagtaacgtagttacggtcgtttacgtacggtccggaccccgccgtaccggtacgtaaccgggtacggtttacgtttaacgttcgtcgggtcggacgaaggtacgtcggtactttagttagttgtttaggttttagggtaggtttcgtttaacgtttaccggtaacccttaccggttaaggtacccgggttaccggggtacccgggggttaccctaccccggggtaccccgggtagggggtaacccggtaaacgggggttaaccttacccgggttacccgggtttacccgtaacccccggttttccgtttaaccccggttaccgtccccccgtaaaccccggg

SEQ ID NO: 139853 - DNA, 798 bp, Homo sapiens
  misc_feature: GYAE6OF01EHV1W.46.67.G01.1.454.CMB.1.raw
  modified_base (206)..(206): a, c, t, g, unknown or other
  misc_feature (206)..(206): n is a, c, g, or t
  modified_base (254)..(254): a, c, t, g, unknown or other
  misc_feature (254)..(254): n is a, c, g, or t
tcagactagcagtacacgaccggtgctcgatttagagtatacatattgggtttgtcctcctgctggtggcagctcccagatgggtcctgtccctggtgcaactgcaggagtccgggcccagactggtgaggccttcggagaccctgtccctcacctgcgctgtctctggtcgcctcatcagtagtggtttctgtgggctgggccgnagctccgaggggaggggctaggaatactagttaggaagtgtctcgtanagttacgtggtagttacctattacagtcccgtctactacaagtgtcgacgtacaaccatatctacgtcggtaaccaccgttccaagactaaacttccgttaacgtttttcccagaaagtacgtagtacgtttacgtggtacgaacccgccgtacgtaggtaaacgtaccggggttacgtttttaaagttaccgttacgggttaggaccgggtaaggaacggtaccggtactttaagttttaagttagtttaaggtttttacggtaaggttttacgggtttaactttaccgtaaccctaacccgttagtacggtaccgggtaccgggggtacctaacccgggaccccggtaggggaacccggaaggggttaaacgtaccggttacggtcccgtacccggttaccttacccgttaaccgccccgttaaccccaaccgggaaacccgggtacccccgttacggttacccccgttacccccgttaccccccgtccgggtaaccccctaaccccttacccccgtaacggtaaacgtccgtaaaccccgg

SEQ ID NO: 139854 - DNA, 845 bp, Homo sapiens
  misc_feature: GYAE6OF01EDOUK.46.67.G01.1.454.CMB.1.raw
  modified_base (127)..(127): a, c, t, g, unknown or other
  misc_feature (127)..(127): n is a, c, g, or t
  modified_base (212)..(212): a, c, t, g, unknown or other
  misc_feature (212)..(212): n is a, c, g, or t
  modified_base (543)..(543): a, c, t, g, unknown or other
  misc_feature (543)..(543): n is a, c, g, or t
  modified_base (775)..(775): a, c, t, g, unknown or other
  misc_feature (775)..(775): n is a, c, g, or t
tcagactagcagtacacgaccggtgctcgatttagagtatacatattgggtttggggagtcgtcggtcaggacacagcatggacatgacgggtccccgctcagctccgtggggctcctgactactcnggctccggaggtcgcagatgtgacagtacgacgctacgacccagtcctccacttccctcctgtctacgacgaacgtgggacacgngtcgtacacctacgtacctacgttcggacccgaagtaaggtaccgggaatacgttacgacctacttaatttaaacggttcgtaatacctaaagacgtaacgaaccggaacggggtaaccccaccgtaagtaccttaacgttaaacgtccgtaagttcgaccgttacgaacttaccgtttacggttaacggttaaaccgaaggttaaaacccgggtccgggttaaccctaaacggtttcgggttaccgggttgaaacgggttcggaaaccggttaggggttagtaacgtaaggttcggggaacctttaaacgtttaccgtactaccccgttnttaacccaacgtacgttaagtaacgtttacgactacggtaaccgttaactaggttaaactacgttaacgtacctttaatttacctagttaacgttacaaacgtttaacgttaacttaacgttagttaacccggtttcggaaacccgtaaaggaaccccgtaaaactaaaccgttaaaacgttaaacgttaaacggtacgtgggttaacccaggttaaaccgacccgtttaanaccggttactttcccggttacttagttaacccccgttacgtcccccgtaatccgtttaacgcgtttaaac

SEQ ID NO: 139855 - DNA, 729 bp, Homo sapiens
  misc_feature: GYAE6OF01DWPDU.46.67.G01.1.454.CMB.1.raw
  modified_base (98)..(98): a, c, t, g, unknown or other
  misc_feature (98)..(98): n is a, c, g, or t
  modified_base (153)..(153): a, c, t, g, unknown or other
  misc_feature (153)..(153): n is a, c, g, or t
  modified_base (302)..(302): a, c, t, g, unknown or other
  misc_feature (302)..(302): n is a, c, g, or t
  modified_base (499)..(499): a, c, t, g, unknown or other
  misc_feature (499)..(499): n is a, c, g, or t
tcagactagcagtacacgaccggtgctcgatttagagtatacatattgggtttgtcctcctgctggtggcagctcccagatgggtcctgtccctggtncaactgacaggagtccgggcccagactggtgaggccttcggagaccctgtccctnacctgcgctagtctctggtgcctccatcagtagtggtttctcgtgggctgggtccgcagcctacccgaggggaacgggcctaggaactacgtagttaggaagttcgtctacgtcagtacgtggacggtttcctagttacagtcccgttnactacgaagagtccgagtccacctaatcttaccgtcgtcgggaacctaccggtacacggtactaacgttcgttacgttttccccgagtaagaccgttagtacgttctcggtaccgccgcgtctacggaaccgtcgggttacttagtacgtgtcggacgagtacggacgtacgttattagtcgtttagtttacgggtntttaggttacttacggtaacctaccggtataccgggttaccgggaccgggttcgtaaccggtcccggtcggggtaaccgtaagggttaccgtaacgtccggttaccctaccggtccgttacccgttaccggccctacccgaaaccggtaccgtacccggttaccggttcccgttaaccccgttccccggaacgtcccccgtacccttaccccgcgaaggtcctaccccgg

SEQ ID NO: 139856 - DNA, 963 bp, Homo sapiens
  misc_feature: GYAE6OF01EWT6Q.46.67.G01.1.454.CMB.1.raw
  modified_base (157)..(157): a, c, t, g, unknown or other
  misc_feature (157)..(157): n is a, c, g, or t
tcagactagcagtacacgaccggtgctcgatttagagtatacatattgggttggggagtctcggtcaggacacagcatggacatggacgggtcccgctcagctccgtggggctcctgctactctggactcggaggtcgccagagtgtgacagtcganctacgacctagtcctaccacttccctcctgtctacgaccgaacgggtacggatacgtaggtctaccaactactaccgtacgttccgggaccgggactaacggtaccgtaaatacgtacgtaacttacgtttaaagttaagttgtaactaacctaatagtaaccggaaccgaggggtacccgacctaagtccttaacgtatacgtaacgtcgtactacgtacgtaaccttcgttacggtacgtaacgggtaacgggttcccggtaaccgtacggtaacggttacggttacggtaacgggtcggtaacggtacggttaacgggtacgtaccgggttaagggtaaacttaaccggtttacttaacccggtacctttaaccggaacccttaacgtaacgttaaaccgttaacggtttaacccgtttacccggtaaacggttaaaacgttaacgggtttaagttttaaaacccgtttcggttttaaaacgttaaacctttaaaaccggtttttacaaacccggtttaacggtaaaaaccctaaacggttttaacgtaaaacccgggtttttaaccgttaccgttttaaccgggggtttaaccccgaaaaacgggttaacccggtaaacccgtttaaaacgtaaaaccggtttaaaagttaaaacccgggttaaacggtaaccgtttcggggggaccgttaaaccctaaccggttaacccgtaccgttttaagtcccctttacgttaccgttaacccgtaccccctttacgggttaaccccttaccttagggttaacccttggtaaaacccg

SEQ ID NO: 139857 - DNA, 898 bp, Homo sapiens
  misc_feature: GYAE6OF01BEIZW.46.67.G01.1.454.CMB.1.raw
  modified_base (533)..(533): a, c, t, g, unknown or other
  misc_feature (533)..(533): n is a, c, g, or t
tcagactagcagtacacgaccggtgctcgatttagagtatacatattggggtttggggagtctcggtcaggacacagcatggacagtggacgggtccccgctcagctccgtggggctcctgctactctggctcggaggtgaccagtatggtagacatcgagtcctacgacccagtcctcctactcccgtccctagtcctcgaccgaaccgggtagggagtactaaggttcgtaccaactactaccgtacggttcgggccgggtaactaaagggttaccggaaacttagttaacggaaccttaaccgttttaagttttaaaacggttcggtaacttaacaaaccgtaagtaccgtaaccggaacggggtaacccgtaacccgtaaggtacctaccttaaagttcctaagtcgtacgtcgactacttcgtaggttacaacggtaaacggtccgggtacacggtttaacgacggtttaagcggttaggacgtaaggtacggtacgtcggtacggaagtactaacgttctacgtacncctaacctagaccgtagtactacgacgtaactaacggttaagttaacgtaattacggtaacttaaccgtttaaacttacgggtttaaactaacccggtaaacgttaaacgttaaacgtttaacccggtaacggttttacccgggtttaacccgaaaacccgggttaaaccgggtaaccgtaaaccgttaaaccgttaaaccggttaaaaaacggtttaacccggtaaacggttggtaacggttaacccgtaaccggtaacttaaacccggttccttaaacgtttaacggttccctttaaacccggttacccttaaccccttaaaccccggtacgttaacccgttaggttaaaccgggtttaaccc

SEQ ID NO: 139858 - DNA, 953 bp, Homo sapiens
  misc_feature: GYAE6OF01DSD61.46.67.G01.1.454.CMB.1.raw
  modified_base (434)..(434): a, c, t, g, unknown or other
  misc_feature (434)..(434): n is a, c, g, or t
  modified_base (448)..(448): a, c, t, g, unknown or other
  misc_feature (448)..(448): n is a, c, g, or t
tcagactagcagtacacgaccggtgctcgatttagagtatacatattgggtttgtcctcctgctggtggcagctcccagatgggtcctgtccctggtgcaactgcagggagtccgggcccagactgggtgaggtcccttcggacgacccctgtccctcacctgccgctgtctctggtcgcccttccatcgtagttacggttggttttctcggtgggggctcggggtcccggctacggccgtacccggaagggggaacggggtctagggaaactacgtagttgggaagttcgtcctctacagttaggtgggtacggtttcctagttaacgacgttcccgtctccgtacaaacgtcgtaccgtacgttcaacctaattatcctcgtaggacctaccgtaccacgacaacgttacttacgttttcccgagtaacgtnttaggcgttttacnggtacgacccgtccgcgttacggaccggtacgggtttccgtttaactttacggtcggttacggacggtaaggtacggaccggttaaccgtttaagtttaagttaggttttaaggttttttacgggtaggttttacgggtttttaaccgttttacccggtaacccgttaaccccggttaaggttaccgggttacccggggtaaccgggggggttacccctacccggggttaccccccgggtaggggggtaccccggtaaacggggtaaaccgttacccggttacgggtaacccgtttaccccggttaccctttacccgggtttaaacccgtacccccgttaaccccggttaaccccggtaaaccccggggttccccggttaaccccgggttttcccccgggtttaccccccgtttaccccccccggtcccggggttaacccccttaacccccccgttaaccccccggttaaccggtaaaacccgtccccgggttaaaccccccggg

SEQ ID NO: 139859 - DNA, 853 bp, Homo sapiens
  misc_feature: GYAE6OF01EYYPE.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtccgggcccacgactggtgaggccttcggagaccctgtccctcacctgcgctgtctcgtggtcgcctcatcgtagttagttcggtttctcgtcggggtcgttgggtcccggcacgtcccgtacccggaagggggtaagggtccgtaggtaactacgtaggttggagttcgtctctacgagtaggtaggtacggttaccttaacgtacgtacgtcccggttcttacgtacgaaggtacggttacgtacgtaccacctaacgttacttccttcgtacggtaccgtaccgtccaagtactaaccttccttaccgttttcccagtaacggtactacgttacgttctggtaccgacccggccgtcgacgtaacccggtcgggtttctttaacgttcgtagggtcggtacggacggtaacggtaccgtttcttaaacggtttatagggttttacggtttttaggtagggtttttaccggtttaccgtttaccgaacccttaacccggtacgggtaccggttaccggggtacccgggtccggttaaccccggtcccgggtaccggggtaacccggtaacgggtaaccgttccgggtaccgttacccggttaccgttacccgtttacccggtcccgttacccccacggtaaccccggtaccggtccccgtttaccgtccccgggtttacccccggtttcccacccgggtaccccttaccccgtaccctacccggaacgccccggtaaccgg

SEQ ID NO: 139860 - DNA, 688 bp, Homo sapiens
  misc_feature: GYAE6OF01ALMVY.46.67.G01.1.454.CMB.1.raw
  modified_base (191)..(191): a, c, t, g, unknown or other
  misc_feature (191)..(191): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtggganacagtgtcaccatcacgttcgccgggacaaggtcggaactagttcgaacctaccttaatttaaagttggtatacaacatacgaccgagggaccgaccctaagctacctaatctatgtctcgacactcgtagtttcgacgtaaaggttcgggtaccctagtcggtacgttacgaggtcggcgaggtacggtagtcggtagggactaacggtactttaccacttcctacaccgtatactaacgtacttctacgacgtaagtagtaagttacgttagacttaaacttacgttaacgtcgtaaccgtaactaagttaactttaactacgtttggtttaccggaaccgtaacggtaaccgtaaccgtaaacttaaacctaaaacgttaaccggtacttacggtacggtaccgtaacgtaccgtaaccgtactttacgtcgtttaccttacgttaccttaccccgttaccccgtaacctacggttccgttaaacgttaaccgg

SEQ ID NO: 139861 - DNA, 712 bp, Homo sapiens
  misc_feature: GYAE6OF01AQQ15.46.67.G01.1.454.CMB.1.raw
  modified_base (320)..(320): a, c, t, g, unknown or other
  misc_feature (320)..(320): n is a, c, g, or t
  modified_base (704)..(704): a, c, t, g, unknown or other
  misc_feature (704)..(704): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccactcctccctgtctgccaaccggtggacgacagtcgtccaccatccacgttcggccgggtacaacggtcggtaacagttcgactaccttaatttaaagttgtatcaaacatacggaccgagggaccggaccctaagcctacctaatcctagtcnctcgctacgtccgttaggtttacgaaccgaagggttcccgggtaccctagttacgggtaggtttaccgtaggtcggactaggtcggtagtcggtagggactagttctttaccgcttaccctacaaccctagtaccgtaaacgttactacgtacggtaaccgtaacggtagttaaacgtttacgttttacgaaccttaaacgtttttaccttaacgttaccgtaaacctaacgttaaacgttaactttaacgttaacgttttcggtttaccgaacgggtaacggtaaccgtaacgtaaactaaacgttaaacgtaaccgtaacgtgacggtcctacgtaccgtactcgtacgtcgttctactagtttccccctccgtaactcttntcgtaacc

SEQ ID NO: 139862 - DNA, 720 bp, Homo sapiens
  misc_feature: GYAE6OF01BG483.46.67.G01.1.454.CMB.1.raw
  modified_base (171)..(171): a, c, t, g, unknown or other
  misc_feature (171)..(171): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtncctcatcagtagtggtttctcgtgggctgggtcgcagctccgagggagggctaggaatacagttggaatgtctctcatagtgagttctatacagtccgtctctacaagtgtcgagtcaccatatctcgtggacacgtaccagacaatctacgttttcccagaagtatgtagttctaggtcgaccgccgacgtacgacgtacggggttacttttaagttaacgtgtacgacgagtacgacggtacttaagttagttagtttagtttagggtaggtttaggttttaactttaccggtaacctaccgtaagtacggtaccgggtaccgggggtaccgtacccggtaaccccggttagggggacccggtaaagggttaacgtaccgggttacggttaccgtaacccgttcgttaacccgttacgtaccccttaaccgaacccggtaacccgggtaccccgttacgttaccccgggttccccgtttaccccccggtaccggttacccctaacccccgttacccctaacccgtaaacggtccccgtaaaccccgg

SEQ ID NO: 139863 - DNA, 841 bp, Homo sapiens
  misc_feature: GYAE6OF01C5Q5U.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctcgacccagtcctccactccctcctgtctcgaccgaaccggtggacgactagtcgtaccacctactcctaacgttcggacccggggactaacggtaccggaaactacgttacgaccttaaacctttaagttttaaacgttaggttaacttaaccaaaaccgtaacgttaaccggaacccggtaaccgggggtaaccccggtaacccccgtaaacgtaccccttaaccttaacttccgttaagtaccgtccgtagaccctaacgttacccgtaggtttacgaacggtaacgggttccgggtaccctaggttccggtacggtttcgaggtacggacggtacgggtaggtacgttacggtacgggtaacttaacgttaccgtttaccaccttaccgtaccctaacgtactacgtaacgttaccgtcgtaaccggtaacgtaaggttaagttaacgtttactttacggtaaactttaacttttaaccgttaacgttacgtaaaccgtaacgttaaacgtttaactttaaacggttacgtttaacccgggtttaaccgaaccggtaaacggaacctaaccgtaaacctaaacgttaaacgttacgaacgttgtaacgtaccgtagacccttactacgttccttcgttaccttacccactttacccccgtactccgttaactccgttataaccg

SEQ ID NO: 139864 - DNA, 716 bp, Homo sapiens
  misc_feature: GYAE6OF01CO0DL.46.67.G01.1.454.CMB.1.raw
  modified_base (201)..(201): a, c, t, g, unknown or other
  misc_feature (201)..(201): n is a, c, g, or t
  modified_base (499)..(499): a, c, t, g, unknown or other
  misc_feature (499)..(499): n is a, c, g, or t
tcagactagcagtacacgaccggtgctcgatttagagtatacatatttgggtttgggggagtctcggtcaggacacagcatggacatgagggtccccgctcagctcctggggctcctgctactctggctccgaggtgccagatgtgacatccgagctgacccagtctccatccctccctgtctgcaaaccggtgggagacnggtacgtccaacctatcaaccgttggacccggggataaacgtcggaaactagttgaaccaacttagttttaaactggtaactacgaaactagtacgaaccaggggtaacccggaccctaaggtcctaccttaagtcctagtacgacttcgacgtactacctagtttcggaaccgtaaaaggtcgggtaacccctagtccggaacggtttccaacgggttaggaccgtttaagttcgggaacgtacggttacgggaacacggttactttaacgccttacgtacactagtccaagtaacncgtacgtacaagttcgaacgttagttaacgaccttaaactttcgtaatacggtaactaaacgtaataacttaacctaagtttacgtttaccggaacgtaacggaccgtaacgtaacttaacgtaaaacgtaacgtacgtgacggtactaccggcctaacctgtaccttgttaccttccgttaactacccgttaccctacgtccgtataacggttaac

SEQ ID NO: 139865 - DNA, 810 bp, Homo sapiens
  misc_feature: GYAE6OF01DRRUD.46.67.G01.1.454.CMB.1.raw
  modified_base (178)..(178): a, c, t, g, unknown or other
  misc_feature (178)..(178): n is a, c, g, or t
  modified_base (214)..(214): a, c, t, g, unknown or other
  misc_feature (214)..(214): n is a, c, g, or t
  modified_base (257)..(257): a, c, t, g, unknown or other
  misc_feature (257)..(257): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactgggtgaggtccttcgggacgaccctcgtccctcacctgcgctgtctctggtcncctcatcagtgttgtttctcgtgggctcgggtccgnacgccgtaccgaggggacggctaggaatcgagtggagtgtctncatggtggtacgttctattacagtccgtctctacgaagtgtcgacgtccaacctagttacttccgtcgtcgggaacctaccgtccagactaacttcgtttaccgttttacccgagtaaggttcttaggtacggtttcctaggtcccgtaaccggtccccgtagtacggtaacgggtacccgggtttcgtttttaaacgtccggttggtaccggtacggacggtacggacgggttactttaaggtttagtttacggtttaaggtttttacgggtaggtttttacggttttaaccgtttaccggtaaacccttacccggtaaggttacccggggttacggggtacccggggttacccacccggggttacccgggtaccggggggtaaccgtaaacggggttacttaacccggttccggtaacccgttacccggttccgtttaccccttaggccccccttaacggaaacccgggtaccgggtccccttaggttaccccggttccccttaccccgcgtaccccgttacccctccgtaacccgaggtccctacccggg

SEQ ID NO: 139866 - DNA, 880 bp, Homo sapiens
  misc_feature: GYAE6OF01BSZUR.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcggcccacgactggtgaggccttcggagaccctgtccctcacctgcgctgtctctggtcgcctccatctaagtgttcggtttcttcgtcggggtcgttggggtcccggcacgtccgtacccggaaggggaaggggtctaggtaatacgagtttggaagttgtctcgtcagtaggtggtacggttcctattactacgtcgtctctacgaagacgtcgacgtacaacctagtactctgtacgacgtacctacacgtacctaagtccgttaacgttttcccaagtaacgtagtaggttacgtttacgtcgttaaccggacccgtaccggaccgttacggtaacccgggtaccgggtttaaccgtttttaaacgtttaccggttacggtacggtacgggtaacggtaacggtaaccgggttattttaacgtttaggtttaaggtttacggttttttaggggttaacggttttaacgggtttaaccgttttaccggtaaacccgttaaccgtttaacgggtaccggttaccggggtaccgggtcccgttaaccccgggtacccggtacggggtacccggtaaacggggtaaccgtttaccggtcggtaacccgttacccggtttacccgttacccgttaccggtacccgttaacccccggaaccgtaaccccgggtcccttacccgggttcccggttacccccccgttccccggtacccggtaccccttaacccccgttaccccgttaaccccggaagtaccccgtaaccccgg

SEQ ID NO: 139867 - DNA, 634 bp, Homo sapiens
  misc_feature: GYAE6OF01E151Q.46.67.G01.1.454.CMB.1.raw
  modified_base (220)..(220): a, c, t, g, unknown or other
  misc_feature (220)..(220): n is a, c, g, or t
  modified_base (304)..(304): a, c, t, g, unknown or other
  misc_feature (304)..(304): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccggtgggagacagtgtcaccatcacttggccgganaagtcggaacattgacaccttatttaaattggtatacaacagtaacgaccgagggaccggaccctaagctcctaatctatgctncactctagttacacgtaaagtcgggtacccagtcggtagttacgaggtcggacgtggtacggtagtaccggtagggaactagttaactttcaccttcctacaacctatactaagtactcacgtactaagtagtaagttacttttcgaacttaaacttacttagtactaacaaacgtaagttaacttaacgtaagtttcgtttacggaaccgaacggtaacctaaacgtaaactaaactaaacgttaaacgaacgttgtacgtacaccgacctactatcttcgttaccttactacccgttccctaacccgctaagttccgtaagttaaccg

SEQ ID NO: 139868 - DNA, 964 bp, Homo sapiens
  misc_feature: GYAE6OF01DQISL.46.67.G01.1.454.CMB.1.raw
  modified_base (141)..(141): a, c, t, g, unknown or other
  misc_feature (141)..(141): n is a, c, g, or t
  modified_base (249)..(249): a, c, t, g, unknown or other
  misc_feature (249)..(249): n is a, c, g, or t
tcagactagcagtacacgaccggtgctcgatttagagtatacatattgggtttgggggacctcctgtgcaagaacatgaagcacctgtggtttgtcctcctgctggtggcagcctccagagtcgggtcctcgtccgtggtnacaactggcgagggtacggccgggacccacggtacgtgggtacggacggtcccgttacggacgtcccctcgtcccctacaccgtgccgtcttcgtactcggtggtccnccctactacgtcgttaggttcggtttcggttttccgtacgggtcggggtcgtacggggtccgactaccggtccgtaccgggaagggggaacggtctaagggaatacggtaggttaggtaacggttcttcctaccgtagtaaggtttacgggtacggttaccgtttaacgttaacgttaaccggtccgttttcccggtacttaccgaaggtaacgggttactaccggtaaccttaaccaccgttaagtaccgtttcccgtaggtaacggtaacccacccgggttacaaggtaacccttacgttttacccgtaccgtttaaccgaaggtaaagttccgtagggttttacccttaggtaccgggtaccccggaccggtttaccgtcggttaaacccgggtaccggtttaaccgggttttaacgtttaggttaccggttacccgggtggaaacggttcggtaaacgttcgttaacgttttaagttacggtttacgtttttagggttacgggttacgttttaaggttaacccggttctaaaccggtacccggtaaggtcccggggaaccgggtcccggggtttaaccccgaccgggttaccccgggggtaggtaaaccccggggtttaagtaaccccgggtttacgtaaccccggggtttacccttacccgggtttacccggtttaacccccgtaccgtacccccgggttaaacccgggg

SEQ ID NO: 139869 - DNA, 855 bp, Homo sapiens
  misc_feature: GYAE6OF01DWPBT.46.67.G01.1.454.CMB.1.raw
tcagactagcagtacacgaccggtgctcgatttagagtatacatattggggtttggggagtctcggtcaggacacagcatggacatgacgggtccccgctcagctccgtggggctcctgctactctggctccgaggtgccagatgtgacatcgagctcgaccagtcctccactcccttcctcgtctcgacgaaccggtgggagaccagtcgtaccactactcgtaccgttcggacccgggactaacggtcggaaactacttacggtaaacctaaccgtttaaattttaaaagttcggttaaactaaccttaaaccgaagttaaccggaaaccccggtaaaccgggggaacccggtaaccccctttaaaggtccccgttaaacccgttaattaccttaacgtcggtaacccgttcgtacccgtaaaccgtttccggttaacggtttaggaacccgtaaagggggtttcccggaaccgtacggttaaccggtaggttacgaaggtcggacgtaaggtacggtactcgggtacggtaacagttactcgactcacctacgtatactagtacgttccagtaccgaagttacgtaactttagtaacgttaactaaaccgttttgttaacgtacgtaactaacgtaaacgttaactttacgtaacgtttaaccgggttacgaaacccggttaacggaacgtaaacccggttaaacttaaaaccgtaaaacgttaaccgtaacggttaggtaccctaaaccgggttaaataccccgtaaccttaagttttacccctcggttaacttaccgtttaccccgttcccggttaaaccctaccggtaactttaccggagtttaacccg

SEQ ID NO: 139870 - DNA, 705 bp, Homo sapiens
  misc_feature: GYAE6OF01BFSJE.46.67.G01.1.454.CMB.1.raw
  modified_base (219)..(219): a, c, t, g, unknown or other
  misc_feature (219)..(219): n is a, c, g, or t
  modified_base (238)..(238): a, c, t, g, unknown or other
  misc_feature (238)..(238): n is a, c, g, or t
  modified_base (251)..(251): a, c, t, g, unknown or other
  misc_feature (251)..(251): n is a, c, g, or t
  modified_base (257)..(257): a, c, t, g, unknown or other
  misc_feature (257)..(257): n is a, c, g, or t
tcagactagcagtacacgaccggtgctcgatttagagtatacatattgggtttgggggacctcctgtgcaagaacatgaagcacctgtggtttgtcctcctgctggtggcagcctcccagatgggtcctgtccctggtgcaactgcaggagtccgggcccacgactgggtgacggtccttcggacgaccctgtccctcacctgcgctgtctcgtggtcncctcatcagtgtgttctgngggctgggccgcncgtccnccgagggaggcgtgatactagtgagtgtctctctagtaggtaggtacggttaccttactactcggtccgtctctacaagtacgtacgtacgtacactatactcgtcgtgacgtaccgtacacgactaactacgttacgttttaccgtagtaatagggggggggggggttatacggttacgtcggtacgtacccgtaccgtcgtacgtaccggtacgggttacgttttacgttacgttcggtacggacggacggtacggtacggtacgttagtttacgtttgtttaacggttttagggttacggtttacggtttaacgtttaccgtaccgtaccgttacggtacgggtacgggtaccggggtaccgtacccggtacccgggtacggggacggtacggtacgtacggtacggtaccgtaccgttacccgttccgttccgtcccgtacccg

SEQ ID NO: 139871 - DNA, 731 bp, Homo sapiens
  misc_feature: GYAE6OF01EEPQY.46.67.G01.1.454.CMB.1.raw
  modified_base (98)..(98): a, c, t, g, unknown or other
  misc_feature (98)..(98): n is a, c, g, or t
  modified_base (199)..(199): a, c, t, g, unknown or other
  misc_feature (199)..(199): n is a, c, g, or t
  modified_base (329)..(329): a, c, t, g, unknown or other
  misc_feature (329)..(329): n is a, c, g, or t
  modified_base (722)..(722): a, c, t, g, unknown or other
  misc_feature (722)..(722): n is a, c, g, or t
tcagactagcagtacacgaccggtgctcgatttagagtatacatattggggtttggggagtctcggtcaggacacagcatggacatgagggtccccgntcagctcctggggctcctgctactctggctccggaggtcgccagatgtgacatcgagctacgaccagtctccatcctccctgtctcgacaaccggtggganactaggtctcaccatcgacttcggccggacaagtaccggaactattcgactaacctttaatttaaacgttggtactacaactagtaacgaccgagggaccgtaccctaagtcctactaatcctatgtctnacgtactaccgttaggtttacgaacgtaacgggttcgggtacccagttacggtaggttcgacggtggactaaggtggacttaggacgggaactaacggttattttacccaaccgttccgtaaccaaccctagttaaccgtaattaacgttcgtacgtaaccggtaacggttaggtaaacgttttacttacgtaacgttaaactttacgttacttaacgtaaccgtaaagtaacgttaaactttaaacgtagttttacggtttaacccggaacgaacgggtaccaacggtaaacttaaacgaaagttaaccgtcgttgccgttatactaccgtaccgttattaccgtttcggtacccttactacgtttcccctacccgtaactacgtttaccgngtttaaccg

SEQ ID NO: 139872 - DNA, 856 bp, Homo sapiens
  misc_feature: GYAE6OF01DJSHT.46.67.G01.1.454.CMB.1.raw
  modified_base (135)..(135): a, c, t, g, unknown or other
  misc_feature (135)..(135): n is a, c, g, or t
  modified_base (230)..(230): a, c, t, g, unknown or other
  misc_feature (230)..(230): n is a, c, g, or t
  modified_base (844)..(844): a, c, t, g, unknown or other
  misc_feature (844)..(844): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtnccagatgtgacatcgagctcgaccctagtctccactccctcctgtctagaccaccggtggagactagtctaccactatcgacgttcggcccgganaacggtcgaactagttcgtaactaacctttaattttaacgtaggtactacgaaactagtaacggacccgtacggggaacccggtaccctaagtccttaccttaataccgttatcggtcttacgacttacctacgtttacgtttacggaacggttaacgggttccgggtacctacggttacggacggtttacgtaggttcgaggtacggtagtcgttacggtaacggacttaggttacctttaccggaccttaaccgtccgtaaacccgttagtaacgtttaaacgtcgttaaccgtacggtaaccgttaaacggtttaacgtaaagttttacgtttaactaaccgtttaaccttttaacgttaccgttaacgtaaaacccggtaactttaatttaaaccggtttaacttaaccggggttttacgttaaacccgggaacggttaaacgggtaccctaaaaccggtaaacgtttaaaaacgtaacggtttaaaccgtcggttaaacggttccggtaccttaaaggtacccgttacccgtttaatttacccggttccgtttaacctttcctaacccgttttaccggttaaccccctagtttaaccgttaaccggttntttaaaccccgg

SEQ ID NO: 139873 - DNA, 719 bp, Homo sapiens
  misc_feature: GYAE6OF01ASNWT.46.67.G01.1.454.CMB.1.raw
  modified_base (278)..(278): a, c, t, g, unknown or other
  misc_feature (278)..(278): n is a, c, g, or t
  modified_base (697)..(697): a, c, t, g, unknown or other
  misc_feature (697)..(697): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtcctggtgcaactgcaggacgtccggcccacgacgtggtgacggtccttcggacgacccgtcgtcccctcaccgtgccgtcttcgtcctcgtggtcgccctcatcgtagttaggttcgtttcttcggtggggtccgtcggggtccggcncgtccgtaccggaggggacgggcgtaggaactacgtaggttaggtaagttcgttacttccgtacgaaggttacggtacgggttacgttttacccgtatttaaccgtacggttcccgttactaccgtaaccgtaaggtaccggttaccgacgtcctaaccgtattacgttccgtcgtacgacctaccgtacacgtactacgtacgttaccgtttccaagacgttatcggtacgttctggccgtccgtcgtcgtacgtacgggtcggttaactttacgtcgtcggtcgacgtagcggtaacgtcttagttagttagttgtttaggtgtttacgttactaccgacctacgttcgacggtccggggaccggtccgtacccggacccggttgggaccgtagttacgtcgaccgttccaccgttnccggttaccgcccgtaacccgg

SEQ ID NO: 139874 - DNA, 949 bp, Homo sapiens
  misc_feature: GYAE6OF01CPTIO.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctccagatcgggtcctcgtccctggtgccaacgtgcgaggacgtccgggcccacgacgtggtgacggtccttcggacgtcccttcgtcccctcacccgtggccgtccttggttcctcgtcgggtcctccctccattccgtaggttaggtttcggttttcttcggcgggggtcgttcggggtcccggcacgtcccgtacccggaagggggtaacgggccgttaggtaacttacgtaggtttacgggtaacgttcgttccgttaccgttacgtaaggtttacggggtacggggtttaccggttttaccctttaaaccgtttaaccgtaccggtttccccggtttacttaccccgttaaggtaaaacggttaccggttacccggtaacgttacccgtaaacccgttaacttaccgttacccgtttaacgtacccggggttaaaccacccggtttacccgaaacgtacctaaaccgtttccgttttaaccggtttttccccgaaggtaaacgtacgttaggttacgtttcgtcgggtacgtaccccgggctaccgggttacgtaaccggtttacgggttacgtttacgtacggtggtacgacggtacggtacggtaacgtctttaaggttacgtttaggtttaaggttttttacggtagggtttaacgtttaacgttaccgtaacccgtaccgttaggttaccgggtcccgggtacccggggtcctttaaccccggggaaccccgggtgggtaaccggtaacgggtttaacgtcccggttcggttacccccgtacccgttttcccggttaccgttaacccccggtcccgttaacccccggg

SEQ ID NO: 139875 - DNA, 776 bp, Homo sapiens
  misc_feature: GYAE6OF01DWGP0.46.67.G01.1.454.CMB.1.raw
  modified_base (222)..(222): a, c, t, g, unknown or other
  misc_feature (222)..(222): n is a, c, g, or t
  modified_base (633)..(633): a, c, t, g, unknown or other
  misc_feature (633)..(633): n is a, c, g, or t
tcagactagcagtacacgaccggtgctcgatttagagtatacatattgggtttgggggacctcctgtgcaagaacatgaagcacctgtggtttgtcctcctgctggtggcagctcccagatggtcctgtccctggtgcaactgcaggagtccgggcccacgtactgggtcgaggccttcggagaccctgtcccctcaccctgccgtctgttctcgtcggtcncctccatccgaagttcgttggttttccttcgtgggggtctcggggtaccgctacgccgtaccccggaagggggaacggggccgtagggaaacttaccgtaagtttagggaaagtttggtccttctacaagttaggttgggtaacggtttaccctttaagtttacgacggttcccggttccttacgtaccgaaaaggtacgtaccggtacgttaccaacccgtattaactccgttccgttacgggaaccctaccggttacccaaagtaccctaaacgttacccgttaaccggttttttaccccgaaggtaaaccgtagttacgggttacgtttacgtcggtaccgaacccgtccgtacgtacggtacgtaccgggttcgtttaactacgtggtcgacgagtacggtaccgtnttaagttgtagttaggttttaggagtttgtttacttcgaacctacccgtagtacgtccgggacgggtcctaccggcccggtgggaccgtagggtaaccttcggtacgtccgtacccgttctaccgtccgtcccgtaacccggg

SEQ ID NO: 139876 - DNA, 737 bp, Homo sapiens
  misc_feature: GYAE6OF01B0ZT4.46.67.G01.1.454.CMB.1.raw
  modified_base (193)..(193): a, c, t, g, unknown or other
  misc_feature (193)..(193): n is a, c, g, or t
  modified_base (199)..(199): a, c, t, g, unknown or other
  misc_feature (199)..(199): n is a, c, g, or t
  modified_base (235)..(235): a, c, t, g, unknown or other
  misc_feature (235)..(235): n is a, c, g, or t
tcagactagcagtacacgaccggtgctcgatttagagtatacatattggggtttggggagtctcggtcaggacacagcatggacatgagggtccccgctcagctcctggggctcctgctactctggctcgagtgcaagatgtgacatcgagctgacccagtctccactccctccctgtctgcaaccggtgganacagtntccacatcacgttcggccgggacaaggtcggaactnttacgaacctaccttatttaaagtggtatacaactagtacgaccgagggaccgaccctaagcctacctaatctatcgctgactactccgtagtttcgacgtaacggtcggtccagtcggtaggtcaggtcgcgtagtgactggacggactagttacttcgactcgtacacctagtacgtaattaactcgtacgacgtaacgttaggtaaagtttgtttaccgtaacgtttaacctttacgttaacgttacgtaaccgtaaactaacgttaaactttaacgttaacgttttacgggttttacccggaaccgggttaaacggtaacccgtaaacgttaaaccgttaaaacgttaaaaccgttaaacggtaaccgttacggttaacggtaccctaaccggtacccttaaaccgttacgttaccggtttaccttacccgtttaaccctaacccgtttttaccccgtacccccttaacgtttaccgttacgttaaccgttaaaccgg

SEQ ID NO: 139877 - DNA, 751 bp, Homo sapiens
  misc_feature: GYAE6OF01CL00A.46.67.G01.1.454.CMB.1.raw
tcagactagcagtacacgaccggtgctcgatttagagtatacatatttgggtttggggagtctcggtcaggacacagcatggacatgagggtccccgctcagctcctggggctcctgctactctggctccgaggtgccagatgtgacatcgagctcgacccagtcctccactccctcctgtctcgaccgaacggtgggacgacgagtcgtacaccatccacgttcggccgggactaacggtacggaactattacgacctaaccttaagttttaaagtggtactacaacagtaacgaccgaacggggaccgtacccgtagccttacctatactagtcgctacgtctacgttcctaggtttcgaacggtaacgggttccggggtaccctagttaccgtacgggttacgaggtcggacgtacggtggtacgtcggtaacgggtacgtacgttactttacccgactcctactaactacttacgaagttacgtcgttacgaacgtaacggtaagtaacgtttacgtttctaacttaactttacttaccgttataacgaaactaacgttaacgttaacttaggtttacggtttaccggaacggtaaaccggtaacctaacgttaaacccgttaaaacgtaaacgttaacgtaacgtacggttcgtacccgttacgacccttaccggtactttcgttcccgttaccttaacccgttaccgttcccgtttacccgacctttaacgtccttaagtacccg

SEQ ID NO: 139878 - DNA, 752 bp, Homo sapiens
  misc_feature: GYAE6OF01BAXHU.46.67.G01.1.454.CMB.1.raw
tcagactagcagtacacgaccggtgctcgatttagagtatacatattggggtttggggagtctcggtcaggacacagcatggacatgagggtccccgctcagctccgtggggctcctgctactctggctccggaggtgccagatgtgacatcgagctacgacccagtcctccactccctccctgtctgacgaaccggtgggacgacagttcgtaccaaccagttccacgttcgggcccgggacaaacggtaccggaaactattacgaaccttaacctttaaattttaaaacgttggtaactacctaaacgtaagttaaccggaacccgaacgggggtaacccgaccccgttaaacgccttacccttaaactctaacgtcgctgacctactaccctaggtttacgacgtaaagggttccggtacctagtcggtacgttcgaaggttggacgtaggtagtactcgtagggacctagtacttacgactactaccactataacagtaactcgtacgtaacgtaagtaacgtaagttacgtttacgtacttaactttacgttaactagtaactaacgtaagttaactttaacgtaatttacgggtttaccgaacggaaacgggtaacccgtaactaaacgttaaacgtaaacgttaaacggtaactaggtacgaccttaccggaactaccgttaattcccttaggttcccttaactaccgttaccccgttacctacccttagtaccgtagttaaccg

SEQ ID NO: 139879 - DNA, 834 bp, Homo sapiens
  misc_feature: GYAE6OF01B26JX.46.67.G01.1.454.CMB.1.raw
  modified_base (224)..(224): a, c, t, g, unknown or other
  misc_feature (224)..(224): n is a, c, g, or t
tcagactagcagtacacgaccggtgctcgatttagagtatacatattggggtttgggggacctcctgtgcaagaacatgaagcacctgtggtttgtcctcctgctggtggcagctcccagatgggtcctgtcccgtggtgcaactgcagggagtccgggcccacgactgggtgacggccttcggacgaccctcgtcccctcacctgccgtctgtctcgtggtcncctcatcgagttggttgtttcgtcggtggggtcgtcggggtccggcacgtcccgtaccgggtagggggaacgggtcgtaaggtaactaacgtaggttaggaacgttcgtcttacgtactaggttaggttacgggttacggtttaccttaagtttaacgtccggtttcccgtactacctacgtaagggtacggttaccggtaactacccacctaattaccgttcgttacggaccggtacctaccgtaccacgtaacttaacttccgttaaccggttttaccgaaggttaatcggttaacgttcggttaccgtgggtacccggaccccgggttcgtaccggttacggaaccggtttaccgggtttaacgttttaacgttcgggttggtacccgggaggtaacgggaccggttacttacgttaatttcgtttaggttttaggttttacgggtaggtttttcgttaacgttccaaccggttcggtaaacgtcgggggtaccgggtacccgggtcgtacccccgggtccggggttagggaccggttaaggtaccgttaccgtccgggttaccccgtacgtttacccgacccggtttacccgcccgttaaccccgg

SEQ ID NO: 139880 - DNA, 655 bp, Homo sapiens
  misc_feature: GYAE6OF01BOUH0.46.67.G01.1.454.CMB.1.raw
  modified_base (174)..(174): a, c, t, g, unknown or other
  misc_feature (174)..(174): n is a, c, g, or t
  modified_base (302)..(302): a, c, t, g, unknown or other
  misc_feature (302)..(302): n is a, c, g, or t
tcagactagcagtacacgaccggtgctcgatttagagtatacatatttgggtttgtcctcctgttggtggcagctcccagatgggtcctgtcccctggtgcaactgcaggagtccgggcccacgactggtgaggccttcggagaccctgtccctcacctgcgctgtctctggtncctccatcagtagttggtttcttcgtggggctggggtccgcagcctcccgagggaaggggctggaatacagttggaagttgtcctctcagttaggtggaggttcctattaccagtccgtctctcaagngtcgagtcaccatatctctggacactccagctaatcctagttttcccagaacgtatgtagttctggtcgacccgcgctcgacgtacggttcgtttatacgtgtgacgagacgacgtactagtttatcgttagttttaggagttggtttacttcgtaactacctagtacgtacgggccggggtctaccggtaccccgtggggtccgaagggtacttacggttcggtacccgtaccgttacctaccgttaccgcccgtaccgaaccgaaccgggccctaacggttcccggttcccgttccccccgtcggacccctaccccgttaccctaacccgaactccgacccttaccccggg

SEQ ID NO: 139881 - DNA, 820 bp, Homo sapiens
  misc_feature: GYAE6OF01C884U.46.67.G01.1.454.CMB.1.raw
tcagactagcagtacacgaccggtgctcgatttagagtatacatattgggtttggggagtctcggtcaggacacagcatggacatggacgggtccccgctcagctccgtggggctcctgcctactctggctccgaggtgccagatgtgacatcgagctcgacccagtctccactccctccctgtcctgaccgtaacgggtgggacgactagtcgtaccaaccactctaccgttcgggcccgggtactaacgggtaccggaactacgtttacgaaccgtaacctttaagttttaaagtaggttaactacaaactagtaaccgaaccggacggggtacccgaccctaagtcctaacctatactagtacgtctcgcctactccgttaggttcgaacggtaacgggtcggtaccctaggtaccgtaggttcgaggttgacgtaggtgtacgtcgtagggtaacctagttccttcgactcctacgactacgtacgtaatacctcgtaacgtaaccgtaaggtagtaacgttttaacgttctaaccttttaaattacgttaccgtaaacggtacctaaaacgttaacgttaaccttttaagaccgggttttacggttaaccgggaaccggtaaccggtaaacctaaccggttaaaacttaaaacgttaaaacccggttaacgtccggtttaaagggtccccttaaacggacccgtaacccgttaaacccgtacttttacccgtttaccgttacccgtttacccgtttaacccccgtttaccgtaccccccggtttaaatttcccgtacgggttccgttaaaaccgg

SEQ ID NO: 139882 - DNA, 724 bp, Homo sapiens
  misc_feature: GYAE6OF01A49A9.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcagggagtccgggcccacgacgtggtgaggccttcggagtaccctgtccctcacctgcgctgtctcgtggtcgcctccatcagtagtcggtttcttcgtggggctgggtccggcagctcccgagggtaacgggctggaatacagttaggaagtgtctctcatggtggtaggttcctattacacgttccgtctctcaagagtcgactcacatatctactggacctacgtccagactaattctacgttttcccgagtaagtacgtggtacgtttcgtacggtcgacccgtccgtcgttacgacggtaccgggttcttttaacgttaacgttggtacggacggtaaggtcggtaaccggttacgtaattttacggtaggttttaacgtttttgggtaagggttttcggttttaacggtttccgaaccgttaccccgttaaggtaccgttaccgggtaccggggggtacccttccccggggaccccgggtttaccgggggacccgaacggggttaacttacccggtcgggttaaacccgacccggtttcccgtaaccccgtttccggtaccccgtaacccccgg

SEQ ID NO: 139883 - DNA, 872 bp, Homo sapiens
  misc_feature: GYAE6OF01DBMJ1.46.67.G01.1.454.CMB.1.raw
tcagactagcagtacacgaccggtgctcgatttagagtatacatattgggtttgggggacctctgtgcaagaacatgaagcacctgtggtttgtcctcctgctggtggcagcctcccagatgggtcctgtcctggtgctaactgcaggagtccgggcccagactggtcgagtccttcggataccctgtccctcaccgtgcgtctcgtctcgtggtcgccttccgatcagttaggttcggttttcctacggtggggtccgtcggggtccgatacgccggtaccgtaaggggagggcgtaggaactacgtagttggtaagttcgtctactctagttaggttggtacggtttccttaagttaccgtacggttccccgttaccgttacgtaccgtaaaggtccggttacgtacgttaacccgtaaccttagttaaccgttcgttaacccggtacgggtaacccctaccggtacccctaaggtacctaacggtttaccctttaccgggttttttaacccaggtaaaccgtagtttacgttaccgttttacgtaccggttaccggacccgtcccggtacgttacggtaaccggttaccggggttacgttttttaacctacgggttcggtaccgggtacgaacgggtacggtaccggtacgttttaagttacgttacggttttagttttaaggggtacgtttttagggttactttacccggtaaccgttaccctagggtaacccggttccggggggtaacccggttccggtaccccggtaaccggggtcgggtaccgggttaaccgggtaatttacccccgggtgtaacccccggttacccttggttcccccgttaaccggtcccccttaaaccccggg

SEQ ID NO: 139884 - DNA, 1000 bp, Homo sapiens
  misc_feature: GYAE6OF01C0W00.46.67.G01.1.454.CMB.1.raw
tcagactagcagtacacgaccggtgctcgatttagagtatacatattgggtttgggggagtctcggtcaggacacagcatggacatggacgggtccccgctcagctccgtggggctcctgctactctggctccggaggtgccagatgtgacagtcgagctcgaccctagtcctccactccctcccttgtctcgaccgtaaccgggtgggacgacgaggttcgaccacctactaccgtaccggttccgggacccggggaactaaaccgggttaccggaaacttacgttaccgaacctttaaaaccttttaagtttttaaagttacggttaactaacctaaaaccgtaacggtaaccggtaacccgggaaccgggggtaaccccggtaaccccgttaacggtaccccttaacccgttaaacttacgttaacgttcggtaccgttacggaaccttaccgtttaccggttacgggttttaacggtaaccgggttaaaccgggggtttcccggggttaaccccgtaaggtttacccgggggtacgggtttacggtaacgggttaccgggtacggttagggtacgggttaccggttacccgggttaggggtaaacctacggtttaacctttaccctaacccgttcctaaccgtaaccttacgtaacgttaacgtaacttcggtaaccgtaacggtaacgtaaggttaactttcgtttaaacgtaactttaacccgtttacttaacctaacggtaactaaacggttaacttaaacgtttaacggttacgggttttacccgggttaaccggaaaccgggttaaaccgtaaccgttaacgttaaaccttaaaacgttaaaaccgggtttacgtacgggtccgggttaaaccaccgtaccggtaaccctaaccgttttaggttaccccttttaaacgttttccctaaaccccgtttcccgtttaaccccccgggtttaccaccgtttctttaaacccggtacgttaaccg

SEQ ID NO: 139885 - DNA, 709 bp, Homo sapiens
  misc_feature: GYAE6OF01CFEXC.46.67.G01.1.454.CMB.1.raw
  modified_base (209)..(209): a, c, t, g, unknown or other
  misc_feature (209)..(209): n is a, c, g, or t
  modified_base (314)..(314): a, c, t, g, unknown or other
  misc_feature (314)..(314): n is a, c, g, or t
  modified_base (349)..(349): a, c, t, g, unknown or other
  misc_feature (349)..(349): n is a, c, g, or t
  modified_base (389)..(389): a, c, t, g, unknown or other
  misc_feature (389)..(389): n is a, c, g, or t
  modified_base (424)..(424): a, c, t, g, unknown or other
  misc_feature (424)..(424): n is a, c, g, or t
  modified_base (483)..(483): a, c, t, g, unknown or other
  misc_feature (483)..(483): n is a, c, g, or t
  modified_base (689)..(689): a, c, t, g, unknown or other
  misc_feature (689)..(689): n is a, c, g, or t
tcagactagcagtacacgaccggtgctcgatttagagtatacatattgggtttggggagtctcggtcaggacacagcatggacatgacgggtccccgctcagcctccgtggggctccctgctactcgtggctccggaggtgccagatgtagacatcgagctagacccagtcctccgatccctccctgtctcgacgaacccgggtggganaccgtagtcgtaccaacactctaccgttcggaccggggactaacggttaccggaaacctagtttacgaaccctaactttaattttaaacgttggtaactacgaanaacgtacgaccggaaccgggtaccgaccccgtaancccgttacctaagtctgtacgctgcctacttacctggttnaccgaagggttcggtaccctagttacgtaggttcnggtcggagtagtaggctagtcgggactagttcttacgccgttataccctactaaacgtnttaaagtaccgttacgtcgtaaccgttaacgttaacggtaatttacgttacgtaactttaacgtttattcgtaagttaaccattaagtaacttactagtttcgttaccgagtaccgactacgaagttaactaagacgtcggtcgtagtacctacgaactccctagttcgtagttccctttacccgaccttacccgttccccgttanacccgttgtttaccgtaacg

SEQ ID NO: 139886 - DNA, 775 bp, Homo sapiens
  misc_feature: GYAE6OF01A09BM.46.67.G01.1.454.CMB.1.raw
  modified_base (196)..(196): a, c, t, g, unknown or other
  misc_feature (196)..(196): n is a, c, g, or t
  modified_base (263)..(263): a, c, t, g, unknown or other
  misc_feature (263)..(263): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtcctccatccctccctgtctgcaaccggtggganacagtgtccacatcacttggccgggcaagtcggaatattgaacctacttatttaaagtgtatacaanatacgaccgagggaccgacccgtaacgctacctaatactagtacgtctcgacgactccgtagtttacgaacgtaacggtcgggtacccgtagtaccggtaggttacgaggtacggacgtacggtggtacgtccggtagggtaaccgaagttactttccgtaccgtccttaccaaccgttaacctactaaacgtaacttaccgtacggttaaccgtaacgttacggtaaagtttacgttttacgtaaccgtttaaaacctttaactttaacgttaaccggttactaaaccgtaaagttaaacgtttaagttaaacctttacgggttttacccggaaccggtaaacgggaacctaaaccggttaaaaccttaaacgttaaaaacgttaaaccggttaacgttacgttacgggaaaccggtacctaaccgtaccgttacgttaacgtttcgttaaccgttaccgttacgttaccccgtttaccccgaaccgttaccctaagttaaccgttaaccg

SEQ ID NO: 139887 - DNA, 609 bp, Homo sapiens
  misc_feature: GYAE6OF01DJPS3.46.67.G01.1.454.CMB.1.raw
  modified_base (191)..(191): a, c, t, g, unknown or other
  misc_feature (191)..(191): n is a, c, g, or t
  modified_base (194)..(194): a, c, t, g, unknown or other
  misc_feature (194)..(194): n is a, c, g, or t
  modified_base (218)..(218): a, c, t, g, unknown or other
  misc_feature (218)..(218): n is a, c, g, or t
  modified_base (229)..(229): a, c, t, g, unknown or other
  misc_feature (229)..(229): n is a, c, g, or t
  modified_base (367)..(367): a, c, t, g, unknown or other
  misc_feature (367)..(367): n is a, c, g, or t
  modified_base (403)..(403): a, c, t, g, unknown or other
  misc_feature (403)..(403): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaacggtggganacngtgcaccatcacgttggccggtanacggtcgaacngttagacctacttaatttaagtggtatacaactagtaacgaccgagggaccgccctaagcctactaatctagtcgtctcgctacgtcctaggtttagacgtaacggtcgggtaccagtcggagttcgagtggcgtagngtaatcgtaggactagttcttacacgttcactacgntacgtatactcacgaacgtagtagtagtttattacgtaacttacgtttatagtactaacaagtaattaacttacgtagtttcggtaacgacggtaaacgactacgtaaactaactaaataccgtagtcggttagacctagacccgtacttgtacgtttcgttaccttacgttccttacccgttacccgattctccgtagttaaccg

SEQ ID NO: 139888 - DNA, 859 bp, Homo sapiens
  misc_feature: GYAE6OF01ES2BC.46.67.G01.1.454.CMB.1.raw
  modified_base (521)..(521): a, c, t, g, unknown or other
  misc_feature (521)..(521): n is a, c, g, or t
tcagactagcagtacacgaccggtgctcgatttagagtatacatattgggtttggggagtctcggtcaggacacagcatggacagtggacgggtccccgctcagctccgtggggctcctgctactctggcctcggaggtcgccaggtatgtcgaactagtccgagcctaccgaccctagttcctacctaccgtccctcccgttgtctacggaccgtaacgggtgggaacgtaccgtggtacgtaccctacgacttaccgtaccggttccgggaccgggtactaacggtaccggaacttagttaccgaaccttacgttttaaagttaacgttcgtaactacaactaggaaccggaccgtaccggaccgtaacctagtacctacgtaatctacgtcacgtcgtactcgtacgttagtacaacggtaggtacccgggtactaggttggacgttcggtaggtacgtagtaggttcgacggtggtacgtacgtacgttacctcgtactacctacgactaaccggtnttaacggtacttcgtaacgtacgtaacgggtttaactacgtttaacggtaaccttaacgttaacgtttttaccgtaacggtttaacgtaaaccgtttaaaacgtaaccggttttaacttaacggtttaaccgttttacgggtaacccgggttaaaccggtaaccggtaacccgggtttaaacctaaacgtttaaaacggttaaaacccgttaacgggttaaaccgggttacggtaccggtttaacccgacgttaccctttacgggtaacccttcggtttacccttacccgttttcacggtttacccctacccggttattaccgttacggttctaaccg

SEQ ID NO: 139889 - DNA, 755 bp, Homo sapiens
  misc_feature: GYAE6OF01A584Q.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggaggtcgggcccacgacgtgggtgagggccttcgggacgacccctgtcccctcacctgccgctgttcctgtggtcgccctccagtcgagttaggttggttttcttcggtggggccgtggggtccgacgcgcccgtaccggaagggggaaggggtcgtaggtaactacgtaggttaggaagttcgtcctctacagttagggtcggtaggtttaccttaagttaaccgcggttccttctacgtacgaacggtacgtcgacgtactaaccgtaatcttcctacgtacggaaccgtacccgtaccgacgtacctaaccttcgttaaccgtttaccgtaagaagttagtcggttaacgtttccggtacggtaccgtaacccgggcctcggaacgtaccgggtaccgggttttactttcgttaaccgtgggtcgacgtcggaacgtacggttaacttagtttgttagtttaggttaggtagttacgttacttacgtaccctagtacgcggtcgggacgtccgtaccggccggtacggacgtaaggaccttcggcttacccggcttccgtccgtacgtcccgaacctacgggaccgtcgcccgttcccggtccccgtccctcccgtccctaccctacccgacgcgtcctacccgg

SEQ ID NO: 139890 - DNA, 846 bp, Homo sapiens
  misc_feature: GYAE6OF01AGBSJ.46.67.G01.1.454.CMB.1.raw
  modified_base (179)..(179): a, c, t, g, unknown or other
  misc_feature (179)..(179): n is a, c, g, or t
  modified_base (244)..(244): a, c, t, g, unknown or other
  misc_feature (244)..(244): n is a, c, g, or t
  modified_base (259)..(259): a, c, t, g, unknown or other
  misc_feature (259)..(259): n is a, c, g, or t
  modified_base (438)..(438): a, c, t, g, unknown or other
  misc_feature (438)..(438): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgacggcccttcgggacgacccctgtcccctcacctgcgctgtctctggtcncctccatcagtagttgtttctcggtgggctgggtccgcagcctccgaggggagggctaggaatanagttggatgtctctnagtagtggtacgttcctaattacgacgttcccgtctctacgaagacgtcgacgtccaaccgtattacgtcttacgacggaacccgtacgtacccagtacctaactttccgttaccggtttttacccaaggtaaacgtcttaggtttaacggttcgttcggtaccgaccccgggtcccgngttaaggaacccggttacgggtttacgttttaactaccggttggtcggaacggtaggaacgtacggttctttaagttgttaggttttaggttttaggaggttttacggtttaaccgtttaaccgaccccgtaaccgttcggtaccgggtacccgggggtaccggggtccccgttaaccccgggttccccgggtacggggtaaccccggtaaacggggttaacgtttacccggtcggttaaccccgggtacccgtttcccgttaccccggtaccggtaccccctaaccccggtaacccggtaacccgggttcccccgttacgggtttcccccgggtttacccccgttccccccgtaccggttacccccgtaccccctacccggtaaaccccgaagtccccggtaccccg

SEQ ID NO: 139891 - DNA, 847 bp, Homo sapiens
  misc_feature: GYAE6OF01DVHND.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtccgggcccagactgggtgaggcccttcgggacgacccctgtcccctcacctgccgctgtcctctggtgcctccatcagttagttggtttcttccgtggggctgggtccgcagcctccgagggggaacgggctaggaaacttacgagtttcgggaagtcgttcgtctcaagttagttaggtacggtttccttaagttacctacggttcccgtctctacgaacgtagtcgaggtccaacctaatctctcgtcggacctaccgtacgagcctaatactacgttttacccagtaacgtaatcgtagtttcgtacggttacggacccgtccgtccggtacgaaccggtacgggttaccgttttaagttaccgttaggtacggtccggaaaggtacgggtaccggtactttaagtttaacgttggttttagtttttaacgggtaggtttcggttttaacgtttccgtaacccgttaaccgtaacggtacgggttaccgggtaccgggggtacccttaacccgggaccccggtacgggggtaaccccgaacggggttaaacgtttccggtacgggttaccctacccggttcccgtttacccttaccggacccccttacccggaaacccgggtaacccgggtaccccgttacggttcccccgggttttaccccctccccccgggttaccggtacccccgttaaccccccttacccgtaaccccgtaaacgccggtaaaccccgg

SEQ ID NO: 139892 - DNA, 739 bp, Homo sapiens
  misc_feature: GYAE6OF01ADHUY.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggcctccgaggtgccagatgtgacatcgagctcgaccctagtcctccactccctccctgtctgaccgaaccggtgggacgacagtgtccactatcacgttcggccggggactaacggtaccggaactagttacgaacctaaccgtttaattttaaaagttcggtaactaccaaacgtaagtaacgaccggtaacggggacccgtaccctaagtccttaccgtaatccttaagtcgtcttcgacctacgttaccgtaggtttacgacggtaaggtccgggtaccctagtacggtacggttcgtaggtcggacgtaggtacggtactcggtacgggaactacgttacttccgacctccgtaccacgtactacgtaagttactcgtacgacgtaacgtaggtaacgttacgttacgtaaccttaactttacgttacgtacgtaactaaacgtacttaacttaacgttagttccggtttaccggaaccggtaacggtacgtaaaccttaacgtaaaccttaaacgtaacgtaacgttgtacggtcgtaccgtaactaccgtagttctccgttccgttaactaccgtttccccgtacccctattacccgtgtacgttaccg

SEQ ID NO: 139893 - DNA, 784 bp, Homo sapiens
  misc_feature: GYAE6OF01D6WN9.46.67.G01.1.454.CMB.1.raw
  modified_base (776)..(776): a, c, t, g, unknown or other
  misc_feature (776)..(776): n is a, c, g, or t
tcagactagcagtacacgaccggtgctcgatttagagtatacatattgggtttgggggagtctcggtcaggacacagcatggacatgagggtccccgctcagctcctggggctcctgctactctggctcgaggtgccagatgtgacatcgagctacgacccagtctaccactccctccctagtctgaccgtaaccggtgggaagacctaggtctaccacctatacctacgttcgggaccgggactaaggtaccggaaactacgtttacggaaccttaaccttttaaagttttaaacgttcggttaactacctaaacgtaacgtaccggtaacccggaacggggtaacccggtaccccgttaaaggtccttaaccgttaacttacgttaacgtcggtactacggacctacgttaccggttaagttcgaacggtaacggtcgggtacctaggtcggtaggtacgtacggtaggctaggtagtacgtacggtacgggtactacgttacgttccacgtacctacgtaacctactaacgtacgtactcgtacggaataacggttcgttaagtttacgtttacgaactttaccttagtttaacgacgtaacaacgttaattaaccgtttaacggtagttttccggtaaccgaaacggttacggaaacctaacgttaaacttaaactaaacgttaaccggtagttacgttacggaccttacgtaacccgttaactcgttacgtttccgactttacacccgtttcccaccgtacgttatccgtntaaaccgg

SEQ ID NO: 139894 - DNA, 893 bp, Homo sapiens
  misc_feature: GYAE6OF01EIT9R.46.67.G01.1.454.CMB.1.raw
tcagactagcagtacacgaccggtgctcgatttagagtatacatattggggtttgggggacgtcgtcgggtcaggacacaggcatggacatggacgggtcccgctccagcctcctcgggctcctgctactctggctccgagtgccagactcgtgacatcgagctacgacccacgtcctccgacttccctccctcgtacgtacgacgaaccggtggacgacgtacgtcgtccactacgtacgtacgttcggaccggtactaacggtaccggaacctaacttacgtaacctttaacctttaagttttaaacgttcggtaactacaaacgtacgtaccggaacccggaccgggggtaacccggtaccccttaaggttccttaaccgtttaactaccgtttaagtacgtaccgttagaccgtaaccgttaccggttaacggttttacgaacgggtaaacgggttccgggtacccttaaggtacggttacggttacgtacggtcgtacggtcggtacgtaccgttacgggacggaacctagtttcctaacctacgttcccacgtaacccagttacgtaaacggttactacgtacgaacgtaacggtacggtaaagtttacgtttacgaaacttttaaccgtttagtttaaccttacggtaaccttaaacgttaacgttaaacttttaacgtaaaccggttttcggtaacccgtaaccgggttaaacggtaaccgttaaccgtttaaacgtaaaccgtttaaaaccggtaaccgtttaaacggtcggttaaaccggtacccgtaccgtaaaccgtacccgttagttacccgttaccgttacccttaaccgttacccttaccccgttacccgtactttaacgtttccgtaccgttaaccc

SEQ ID NO: 139895 - DNA, 728 bp, Homo sapiens
  misc_feature: GYAE6OF01BSXZ1.46.67.G01.1.454.CMB.1.raw
  modified_base (188)..(188): a, c, t, g, unknown or other
  misc_feature (188)..(188): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcacgtgganacagtgcacatcacgttcgccgggacaacgtcggaactgttacgaccaaccttaatttaaagttggtaatacaactagtacgaaccgagggaccgaccctaagccttacctaatctacgtgcgtcgactactaccgtagtttacgacgtaaaggttccggggtacccaagttcggtaggttcgaaggtggacgtaggtcgatcggtagggaactagttactttaccgacttcctacgactacgtactaagttactcgtagaccgtaacgtagtaagttgtttacgaactaactttacttacgttaagtacctaaataacgttaactttaacgtaacgtttcggttaccggaaccgtaaacgggtacctaacgtaacttaaacgttaaacgttaaaccgtacgttacgggtacgttacgtaaccgtaccgtaccgttactaccggtttaacgtttacccgttaacccgttaacccgttttaccccgggttaacccccgttacccgtttaaacggtttcccgttaaaccgtttaaaccccgg

SEQ ID NO: 139896 - DNA, 766 bp, Homo sapiens
  misc_feature: GYAE6OF01E2V1G.46.67.G01.1.454.CMB.1.raw
  modified_base (329)..(329): a, c, t, g, unknown or other
  misc_feature (329)..(329): n is a, c, g, or t
  modified_base (336)..(336): a, c, t, g, unknown or other
  misc_feature (336)..(336): n is a, c, g, or t
  modified_base (377)..(377): a, c, t, g, unknown or other
  misc_feature (377)..(377): n is a, c, g, or t
  modified_base (440)..(440): a, c, t, g, unknown or other
  misc_feature (440)..(440): n is a, c, g, or t
  modified_base (622)..(622): a, c, t, g, unknown or other
  misc_feature (622)..(622): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtccctcacctgcgcctgtctctcggtcgcctccagtcagttagttggtttcttccgtgggggtcctggggtccggcaggccgtcccgaggggtaaggggcctgggaactacgattgggaatgtctctcatgtggaggtttccctattaccagtccgtctctcaagcgtcaacttccacgatntcctcgngaccacgtccagctaattccgtagttttacccctggaacgnttacgaggtttcgtcgttcgaaccggcccggtctcgtaacgtaccgggtcgtttaagttaccngggttacgcgtacggacgtaccggtccgttattacttaggttaagtttttcggtaaggtttcggttaacttttccggtaaccgtaccccttaggtacgtccgggtaacgggggcccgttaccgggtacccccgtacgggggtacccgtacggggttaaacgtaccgttacggggttaccccncccgggttacccttaccccggtttacggaccccttaccccggtaaccctaaccgggggcccccttaaggttaccccccgggtacctttcccccccgtacccgggccctaacccccgtcccttcccggaaaacgccgggtacccg

SEQ ID NO: 139897 - DNA, 766 bp, Homo sapiens
  misc_feature: GYAE6OF01CH2XI.46.67.G01.1.454.CMB.1.raw
  modified_base (557)..(557): a, c, t, g, unknown or other
  misc_feature (557)..(557): n is a, c, g, or t
  modified_base (721)..(721): a, c, t, g, unknown or other
  misc_feature (721)..(721): n is a, c, g, or t
  modified_base (751)..(751): a, c, t, g, unknown or other
  misc_feature (751)..(751): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagactgtacgacatcgagctcgaccctagtcctccactcctcctgtactcgccgtaacggtgggacgactacggttgtaccaacctactacgtacgttcggaccgggtactaacggtccggaaactagttcgaaccttaaccgtttaattttaaacgtggttaactaacctaaacgtacgttaaccggaaccggtaacggggtaccccggtaccctaaacggtccttaaccttaacgttacttagtcgtaccttcgtaccgtacgttccggtaaggtttacggaaaccggtaacggggttacccgggtacctacggttaccggtacggttacgtacggttagggtccggtaaggtcggtaacgtacggtcggtacgtaacgtactttacgtactacctcaccgtactacgtagtaacctnacgtacgtaacgtaggttaacgttagttacttacgttaacttacgtaccgttataccgaacttaacgtaactttactaacgttaggtttacgaaccggtaacgtaacgggaacttaacggtaaactaaacgttaacgtacggtactcggtaactcgaacgtacngtaaccttcgttactcgtaccgtccttacncgttaactcgtgtac

SEQ ID NO: 139898 - DNA, 675 bp, Homo sapiens
  misc_feature: GYAE6OF01ASICX.46.67.G01.1.454.CMB.1.raw
  modified_base (196)..(196): a, c, t, g, unknown or other
  misc_feature (196)..(196): n is a, c, g, or t
tcagactagcagtacacgaccggtgctcgatttagagtatacatattggggtttggggagtctcggtcaggacacagcatggacatgacgggtccccgctcagctccgtggggctcctgctactctggctccgaggtgccagatgtgacatcgagctgacccagtctccatccctccctgtctgcaacggtggganacgagtgccacatcacgttcggccggacaacggtcgaactattgactaccttaatttaaagtgtatacaactagacgacgagggaccgtaccctaagcttaccgtaatctatcgatcgcactcctaggtttagacgtaaaggtcgggtaccagtcggtaagttcagtcgacgtagtacggatcggtaggattagtactttcaactcctacaaccagttacgtaagttattccgacgtaacgtaacgtagtaaacgttactttacgatttaaacttacgttaacgtacgtaaactaacgaaagttaaactttaaggtaacgttttacggtttaacccggaacgaaacgggtaaccaaaccgttaaaccgttaaaacgttaaaacgtaaaccggtagttcggtaggtcctaaacgacgtaaaccttacgttcgttacgttacctacttaacgtcccgttacccgaacttgtacgtacgtac

SEQ ID NO: 139899 - DNA, 1021 bp, Homo sapiens
  misc_feature: GYAE6OF01ANG1H.46.67.G01.1.454.CMB.1.raw
tcagactagcagtacacgaccggtgctcgatttagagtatacatattgggtttggggagtctcggtcaggacacagaatggacatgagggtccccgctcagctcctggggctcctgctactctggctccgaggtgccagatgtgacagtcgagctacgacccagtcctcctactccctccctgtctcgaccgaaccggtgggacacgtagttcgtaccacctatccgtacgttcgggacccggtaacgtaacggtaccggtaactacgttaccgaaccttaaccgtttaaagttttaaacggttaggttaacctacctaaaaccgtaacgttaaccggaaccggaaccggggtacccgtaaccccgttaagtaccctttaaccgtaacgttaccgtacgtaccgaccggttaccgttaccgtaaccgtttaccggtttaacggtttaaccgggtaaccggggtttaaaccggggttccccgggttaacccgttacgggttaaccggggttcgggttaaccgacggggttaccggtaccgggttaacggttacgtaacggttccggggtaaccggtaacggtttacggtttaacctttacccgtacccggttaacgttaacccgggaaccttaaccggttaacgggttaaactttaccggtcgtaaaccggttaacggttaacggtttacgtaaccggttttaacgtttacgttaaaaacccttttaaccgggtttaaactccgggtttaacgtaaaccgttaaacgttaacgtttaaaccgtttacggttttaacccgggtttccgggtttaaaccccggaaacgggtttaacccggtaaaccgtaaaaccggttttaaacccgtaaaaagtttaacccggttaaccgttacgggtttacccgtaggtaccctaccgaaacgtttaccctaaccgggtttccgtttacctaacccggttttcaaccccgtttaccccgtaacgttactttaaacggacccgtttacgtacccgggtttaac

SEQ ID NO: 139900 - DNA, 712 bp, Homo sapiens
  misc_feature: GYAE6OF01E2UCU.46.67.G01.1.454.CMB.1.raw
  modified_base (556)..(556): a, c, t, g, unknown or other
  misc_feature (556)..(556): n is a, c, g, or t
  modified_base (581)..(581): a, c, t, g, unknown or other
  misc_feature (581)..(581): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgacgtggtgacggtccttcggacgtaccctcgtcccctcacctgccgctgtctcgtggtcgccctccatctaggttaggtttcggttttccttcggtcgggggtcgtcggggtcccggctaccgtccgttaccccggaagggggaacggggtccgtaagggtaactacgtagttagggaagttcgtctcgtactaagttaggtaggtacggtttccttaacgttaccgtacgttccgtactacctacgaaaggtcgtacgtacgtaccactatactctcgtacggacctaccggtaccaacgtactaacgttccgtttaccgttttcccaagtaagtatagtcgtttcgcggtcgaacccgccgtcgtacggaacggtcggttctttacgttaggngtacggacgaggacgtcgtaacttnttacgttacgtttagtttggtagttacggtttactacgaccgtacgttacgacgggtccgggccgggtacctccgggcccgtagggaccgtagtacgtacgtcgtacctcctctacctccgccctacccgg

SEQ ID NO: 139901 - DNA, 795 bp, Homo sapiens
  misc_feature: GYAE6OF01DJPDK.46.67.G01.1.454.CMB.1.raw
  modified_base (182)..(182): a, c, t, g, unknown or other
  misc_feature (182)..(182): n is a, c, g, or t
  modified_base (196)..(196): a, c, t, g, unknown or other
  misc_feature (196)..(196): n is a, c, g, or t
  modified_base (222)..(222): a, c, t, g, unknown or other
  misc_feature (222)..(222): n is a, c, g, or t
tcagactagcagtacacgaccggtgctcgatttagagtatacatattgggtttggggacctcctgtgcaagaacatgaagcacctgtggtttgtcctcctgctggtggcagctcccagatgggtcctgtccctggtgacaactgcaggagtccgggcccagactggtgaggtccttcggganacccctgttccccncaccgtgcggtctagtctcgtggtcnccttaccatcgagttagttggtttcttcgtgggggtcctaggggtccgacgtcgtccgtacccggaaggggaaggggacgtacgggtaaataacctaaggtttagggaaagttcgtccttacgtacgaagttagggtacggttaacgggtttacccttaagtttaaccgacggtttcccgttaccttacgtaaccgtaaagggtacggtacggtaacgttacccaaccgtaattaaccgtacttccggtacggaaccgtaacccgtaccgtaaacgtactaaacgtttaccgttaccgtttttaccccgaaaggtaaacgttacgtaggttaaccgttcgtagtaccggacccgtacgagtacggacgtacgggttactttagttacgtgtcgagacgacgtcgtacttaagttagttagttacgtttagggtaagtttgttaccgttacgtaacctaccgtagtaacgtaccgggaccggggtacctacccggacccggtagggaccggtaacggtaacgtccggttaacgtacccgtaaccgttccgtaacctccgtacccgtaaccccgg

SEQ ID NO: 139902 - DNA, 903 bp, Homo sapiens
  misc_feature: GYAE6OF01DKC2A.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatggacgggtccccgctcagcctccgtggggcttcctgctactctggctccgaggtgccagatgtagacatcggagctcgacccagtcctccatccctcctgtctacgacgtacggtgggacacgagtctaccnctagtccgtaccgtccggaccggtagtaaggtaccggtaacctagttaccgtaacctttagtttaaaacgttaacgtacgtacctaaacgtaacgtacggaacccggtaaccgggcccgggttaaacccgtaaccccttaagttaacccctttaccggtaaactaccgtttacgtacggtcccttaagttaacccgtcggttaaaaacggttttcgggtaaaccgtaacgggggttacccgtaacgggttcccgtaagtcggggttaactagggtaccgggagttaaggttcggtaacggttaccttagggtaacgggttacccttaaacgttttccaaacggtcccctagcccggttaaaaactcgtaaaacggttaaccgtaacggttaccggtaaacggttaaacgttacggttaaacgtttaaacgttttaacggtttaacctacgttttaaaacctaccggttttaaacggtacgtaaaaaccctaaggttaacggtttaacgttaaacgtttaaccgggttaaccgggtaacctaaaccgggtaacctaaaccggtaaacgttaaaccgttaaacgttaacgggactttaggacgtacttacccgaacttaccgcgtttacttaccgttcgttaaccctcggtaccttacccgtaccaggtttaccctggtccttaacgg

SEQ ID NO: 139903 - DNA, 1038 bp, Homo sapiens
  misc_feature: GYAE6OF01EXB0A.46.67.G01.1.454.CMB.1.raw
  modified_base (175)..(175): a, c, t, g, unknown or other
  misc_feature (175)..(175): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggacgacccttgtccctcacctgcgctgtctcgtggtcnccctcatcagttagttggtttcttcgtggggctcgggtccgcagccgtaccggaggggaaggggctagggaactacgtagttagggaagttcgttctctacaagttaggtggttacggttaccctttaatttaaccgacggttccccgttacttccgtaacgtaaacggtaggttacccggtaacgtttacccgaaacccctaagtttaactttccgttaccggtacggggtaaaccctaacccggttaccgaacggtaaccttaaacgttaccgttttaaccgtttttttaccccgaagggtaaaacgttcgttacggttacggttttacgttcgggttaaccggtccccggtaccggtaccggttacggtaacccggggttaaacccgggggttttaccgttttttaaacgtttcggttaacgggttccgggaacggggtaacgggtaacgggttaaccgggttactttaagtttttaaggtttacggttttttaaaggtttttaggggtaacggtttttaacgggttttaaccgttttaacccggaacccgtttaaacccccggtaggttaacccggggtacccggggttaccccggggggtacccgttaacccccggggtaccccgggggttgggggaaaccccgggtaacggggttaaaccgtttcgggttaccccggttaccccgttaccggttacccttacccggttacccggttacccccgaacccccggtaaacccgggtaaccccgggtaccctttaccccggtttccccgggtttccccccgtttaaccccccggccgttaaccccccgtacccccgttacccgtaaccggaacccgtaccggtacccccgg

SEQ ID NO: 139904 - DNA, 888 bp, Homo sapiens
  misc_feature: GYAE6OF01AFTP1.46.67.G01.1.454.CMB.1.raw
tcagactagcagtacacgaccggtgctcgatttagagtatacatattggtttgtcctcctgctggtggcagctccagatgggtcctgtccctggtgcaactgcaggagtcgggcccacgactgggtgaggccttcgggagacccctgtcccctcacctggccgtctggtcctcgtggtcgccctaccatccgtaggttagttcggttttccttacggtcgggggcgttcgggggtacccgcgacggtcccgttaccccggaagggggggaaacggggtcctaggggtaaacttaccgtaggtttacggggtaacgggtcgtttccgtacctacgtaagttaacggggttgggtaaccggttttacccttaagtttaccggaaccggtttcccggttaccttacgtaacggtaacggacggtttcgaacgttccctaaacccgatttaacgtccgttacggtaccgggaacctacccggttaccgaaggtacctaacgttaccttacggtttttaccccaaggaactagtcggttactttcgtacgtacggtaaccccgcggtacctcggaacgtccggggtttcttttaagtccggtggttggaaccgtagtacggacggtacttagttagttaggtttacgtttagggtacggtttaaggtttacgtttccgaacgttaccgtaacgtcggttaaccggggccgggttaccgtccgggtaccggtaccgggtacggtaacggttacgttaaccgggcgttccggttaaccgtcccgttaccggtccgtacccgtaaccggtaccggaaccgggttacccttaccggtccggtttaaccccgtccccggaccgtaccctcccttacccgacaaccgggttcacccggg

SEQ ID NO: 139905 - DNA, 664 bp, Homo sapiens
  misc_feature: GYAE6OF01EKIQV.46.67.G01.1.454.CMB.1.raw
  modified_base (153)..(153): a, c, t, g, unknown or other
  misc_feature (153)..(153): n is a, c, g, or t
  modified_base (305)..(305): a, c, t, g, unknown or other
  misc_feature (305)..(305): n is a, c, g, or t
  modified_base (347)..(347): a, c, t, g, unknown or other
  misc_feature (347)..(347): n is a, c, g, or t
  modified_base (456)..(456): a, c, t, g, unknown or other
  misc_feature (456)..(456): n is a, c, g, or t
tcagactagcagtacacgaccggtgctcgatttagagtatacatattgggtttgtcctcctgctggtggcagtctcccagatgggtcctgtccctggtgcaactgcaggagtcggcccagactggtgaggccttcggacgccctggtcccctnacctgcgctgtcctacgtggtcgccctcatcgagtgttgtttctcgtggggtctgggtccgcagcctccgagggggaagggctaggaattacgagtttcggaacgttgtcctcgtacagttaggtagggtacggtttccctaagtttaaccncggttcccgttctctacgaaggtagttcgagttccaaccgtnttacgtcctcgtacggaactccgtcagtacctacttcgtaccgttttccagtaagtctgtacgtcgtgacggacccgtacgcgtacgaccgtagggttctttaatacgngtagcgagacggtactagttattagttgttgtttaggacgtttgttagttccacctactagcggtcgggaccgggtctccggcccgtgggaccagggtaacttcgtcgtacccgtacggtcttacccgtcgtccctaccgaccggtaaccggcccttacgttcccggtccctacccggcgtaccctcccgtacctacgacgctacccg

SEQ ID NO: 139906 - DNA, 710 bp, Homo sapiens
  misc_feature: GYAE6OF01BN9QH.46.67.G01.1.454.CMB.1.raw
  modified_base (135)..(135): a, c, t, g, unknown or other
  misc_feature (135)..(135): n is a, c, g, or t
  modified_base (384)..(384): a, c, t, g, unknown or other
  misc_feature (384)..(384): n is a, c, g, or t
  modified_base (397)..(397): a, c, t, g, unknown or other
  misc_feature (397)..(397): n is a, c, g, or t
  modified_base (406)..(406): a, c, t, g, unknown or other
  misc_feature (406)..(406): n is a, c, g, or t
  modified_base (413)..(413): a, c, t, g, unknown or other
  misc_feature (413)..(413): n is a, c, g, or t
  modified_base (438)..(438): a, c, t, g, unknown or other
  misc_feature (438)..(438): n is a, c, g, or t
  modified_base (491)..(491): a, c, t, g, unknown or other
  misc_feature (491)..(491): n is a, c, g, or t
  modified_base (634)..(634): a, c, t, g, unknown or other
  misc_feature (634)..(634): n is a, c, g, or t
tcagactagcagtacacgaccggtgctcgatttagagtatacatattgggtttggggagtctcggtcaggacacagcatggacatgagggtccccgctcagctccgtggggctcctgctactctggctcgaggtnccagatgtgacatcgacgtctacgacccagtcctcctactcccttcccgtgtcctcggccgtaaccggtggaacgacgtagtcgtaccaccgatccgtacgttcggaccgggtctaacggcggtaactagttacgaactaaccgtttattaagttgttactacaactagtacgaccgtacggaaccgtaccctaagccttacctaatcgtactggactcgctactccgtagttcacgtagtccggtacncgtgtaagttcgnggtgtacgnggtacgngtacgaggtacgtactcgtttaccngtaccttaccgctagtacgtacgttatccgtaagtacgtaacgagttaagttnttacggaactttaacgtattcgttaaacgaccgtaataacgttatttaacgttaacgtttccgttaacggtaacccggaaggtaccctaacgttaaacctaaacgtaaaccgttaacgacgtttcggaacgtcctagtaaccnccgtttaattcccgttattacccttaacccgtcgtttaccccctacggaacctttcgtaaccgttcgttaaacccg

SEQ ID NO: 139907 - DNA, 672 bp, Homo sapiens
  misc_feature: GYAE6OF01A3N4R.46.67.G01.1.454.CMB.1.raw
  modified_base (192)..(192): a, c, t, g, unknown or other
  misc_feature (192)..(192): n is a, c, g, or t
  modified_base (198)..(198): a, c, t, g, unknown or other
  misc_feature (198)..(198): n is a, c, g, or t
  modified_base (307)..(307): a, c, t, g, unknown or other
  misc_feature (307)..(307): n is a, c, g, or t
  modified_base (410)..(410): a, c, t, g, unknown or other
  misc_feature (410)..(410): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatccctccctgtctgtaccgtgganacagtntcaccatcacttcgccgggacaaggtcggaactattcgaacctaccttaattttaaagttggtatacaacatacgaccgagggaccgaccctaagcctacctaatctancgctcgcactaccgtagttcgacgtaaggtcggtaccagttccggaggttacaggtggactaggtcggagtcgtagggaactagttagtttaccacgttaccnctaacccgtatacgtaacgttaatctacggaccgtaacgtaggtaatttacgtttagaaccttaacgtttataccgtacgtaactaactaagttaacttaagtacgtttcggtttaccgaacgaaacggtactaacggtaacttaaacctaaagtttaaacacgttggacgtacctagacccgtaacgttgttaccgttcgtttacccgttacctaccgtttccccggttacccaccttaactttctaaggttacccttacg

SEQ ID NO: 139908 - DNA, 815 bp, Homo sapiens
  misc_feature: GYAE6OF01A584M.46.67.G01.1.454.CMB.1.raw
  modified_base (162)..(162): a, c, t, g, unknown or other
  misc_feature (162)..(162): n is a, c, g, or t
tcagactagcagtacacgaccggtgctcgatttagagtatacatattgggtttggggagtctcggtcaggacacagcatggacatgagggtccccgctcagctcctggggctcctgctactcgtggctccgaggtgccagatgtgacatcgagctcgacccngtctccactccgtccctgtctcgccaacggtggagacgagtcgtccaccagtctacgttcggccgggtacaacggtaccggtaacctattacggaacctaaccgtttaaattttaaaacgttcggtaacttaccaacgtaacgttaaccggaaccggtaacggggtaacccggaaccccttaaggtcctaaccttaatacctagtcgctacgacctacgtacccttaggtttaccgaacggtaaacgggtccggttaccccgtaaggtaccggttaacggttcgtaacggtggggtacctaggggttaacggtcgttaccgggtaagggtacttacggttaacttcctaaccgttacctacctaacgtaacttacgtaacgttactcgtacgacgtaaacggtagttaacttagttactacttattacgttatacgtaacaaacgtagttaacttacgttaacgttaggttacccgtaacgaaccggttaccgtaaacgttaaacttaaacgttaaaaccgttaacgggtaacttaccggtaaacggtcctaaccgttaccgtaacgttaccttacggtacccgttttacctaacgttaccccttacccgggtaccccttagttaaccgtttaccggtaccggtttaaacccg

SEQ ID NO: 139909 - DNA, 711 bp, Homo sapiens
  misc_feature: GYAE6OF01BUC38.46.67.G01.1.454.CMB.1.raw
  modified_base (178)..(178): a, c, t, g, unknown or other
  misc_feature (178)..(178): n is a, c, g, or t
  modified_base (394)..(394): a, c, t, g, unknown or other
  misc_feature (394)..(394): n is a, c, g, or t
tcagactagcagtacacgaccggtgctcgatttagagtatacatattgggtttgtcctcctgctggtggcagctcccagatgggtccctgtccctggtgcaactgcaggagtccgggccccacgactggtgaggcccttcggagacccctgtccctcacctgcgctgtctcgtggtcncctccatcagtagttgtttctcgtgggctgggtccgcagcctccgaggggaaggctaggaatcagttaggaagtcgtctctacgagttagtgtacggttccttattacgacgttccgtctctacgaagacgtcgacgtcctacctagtactctcgtaggacctaccgtcacgactaactccgtacgttttacccagaacgtagtagtacgtttcgngtacgcccggccgtcgtacggacgtacgggtcgtttaagtcgtgtcgacgagacggtacgtactattagtagttagttttggagtttgtttagttccgtactacccgtagtacgtaccgggtacgggtcctacccggacccggtgggacccgaagggtaacgttaccggttagtacccgtacccgttccgttacccgttaccgtacccgtacccgaacccggtaaccggtacccgttacggttccccggttccccgttacccccggtccgtaccccctaccccgttaacccgtacccgtaaacgcccggtaaccccg

SEQ ID NO: 139910 - DNA, 653 bp, Homo sapiens
  misc_feature: GYAE6OF01AV94D.46.67.G01.1.454.CMB.1.raw
  modified_base (246)..(246): a, c, t, g, unknown or other
  misc_feature (246)..(246): n is a, c, g, or t
  modified_base (550)..(550): a, c, t, g, unknown or other
  misc_feature (550)..(550): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctcatcagtgtgtttctcgtgggctgggtccgcagctccgagggagggctaggaatacagttggaagtgtctcncgattagtggaggtttcctaattacgagttccgtctctacaagagtcgacgtcaacctatactctctggaccacgtcagcaatcttacgtttccagaagtactagtacttcgtaggcgtaccgccgacgtacgaaccgtagggttaccttttagtaccgtggtagtcggaagacggtaacggtacttaagttagtagtttagttttaggtaggtttggttaactttcgaacctaaccgtagtacgtacgggaccgggtcctcccggtacccggtcgggtacccgaaggtaacgtcgtcgtaccnccgttacgtccttaccgcctaccgaaccgaacggtccctacggttcccggttcccttccccgcggtacccctaccccgttacccgtaccaacgcgtaccccgg

SEQ ID NO: 139911 - DNA, 825 bp, Homo sapiens
  misc_feature: GYAE6OF01CXVCY.46.67.G01.1.454.CMB.1.raw
  modified_base (496)..(496): a, c, t, g, unknown or other
  misc_feature (496)..(496): n is a, c, g, or t
  modified_base (815)..(815): a, c, t, g, unknown or other
  misc_feature (815)..(815): n is a, c, g, or t
tcagactagcagtacacgaccggtgctcgatttagagtatacatagttgggtttggggagtctcggtcaggacacagcatggacatgacgggtccccgctcagctccgtggggctcctgctactctggctccgaggtgccagatgtgacatcgagctgacccagtctccatccctcctgtctgaccaaaccggtgggacacaggtctccacctatccacgttcggacccgggactaaggtaccggaaactagtttacgaaccttaaccgtttaattttaaaacgttggtaactaccaaactaacgtaacggaacccggtaacggggaacccgtaccccgtaaaggtccttaacctaatacctaagtcggtcctagtacctacttaccgtaggtttacgaacgtaacggggttccggggtaccctaagttacggtacggtttacgacgggtacggtcgtaggtaggtacgtcggtagggaactacgtacgtttaccnctttacgaacctaacctatacgtaaggttaactcgtacgtaaccgtaacggttaagtaacgttttagtttacgtaaactttaaccgtttaagttaaccttaacggttaacccaaaagttaagttaaactttaacggttaacgttttacggtttaaccggaaccggttaaaacgggtaaaccctaaacgggttaaactttaaaaaccggtaaaagttttaaccggaacggtttacgggtcgtaccggtaaccgtaacccgtaaccgtacggtttacttacggtttaccttacgtaccttacccgtacccgtacttacgtnttaacgtacg

SEQ ID NO: 139912 - DNA, 762 bp, Homo sapiens
  misc_feature: GYAE6OF01DC6EL.46.67.G01.1.454.CMB.1.raw
  modified_base (147)..(147): a, c, t, g, unknown or other
  misc_feature (147)..(147): n is a, c, g, or t
  modified_base (152)..(152): a, c, t, g, unknown or other
  misc_feature (152)..(152): n is a, c, g, or t
  modified_base (754)..(754): a, c, t, g, unknown or other
  misc_feature (754)..(754): n is a, c, g, or t
tcagactagcagtacacgaccggtgctcgatttagagtatacatattgggtttggggagtctcggtcaggacacagcatggacatggagggtccccgctcagcctccgtggggctcctgctactctggctccggaggtgccagatgngacancgagctagaccctagtcctccactccctcctgtctcgaccgaaccggtgggacacgtaggtctaccaaccctatacctacggttcggaccccgggaagtaacggtaacggaacctacgtttacggaaccttaaacttaaagttttaaagttaggtaactacaaacgtaagtaaccggaaccggaagggtacccggtaaccctaacggtccttaaccgtaaacgttactaacggttcgcctacggtctaacgttacctaggtttacggaacgttaaacgggtccgggtaccctaggttaccggtaggtcgtaaggtcgtaacgtaggtacggtacgtccggtaggactacggtacttaccactactaccactatacgtatacgtcagacgtaaggtaactaaggtttacttagaaccttaattacgtactataaccaagtagttaataagtaagtttcggttaccggaacgaacggtaacctaacgtaaactaaacccgtaaaagttaacccgaaggttacggtaccgtccgtaactaacccgacgtttactacctttcgtaccttacgtactttccccggaaccctacggttatacccggtnttaacccg

SEQ ID NO: 139913 - DNA, 814 bp, Homo sapiens
  misc_feature: GYAE6OF01E05U6.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctcgacccagtctccactccctcccgtgtctcgaccgaaccggtgggacacgtaggtcgtaccaacctactctaccgttcgggacccggggactaacggtaccggaaactacgttacgaacctaaaccgttttaaatttttaaaacgttcggttaacttaaccgaaactaacgtaaccggaacccggaaaccggggggtacccgggtaacccccttaaacggtaccttaacccttaaacttacgttaacgttcggtaccgtcgtacctacgttaccgttaacggttttacggaaccggttaaaacggggttccgggtacccgtacgttaccggtacgggttacgtacgggtcggtacgtacggtaggtacggttacggtacgggtacgtaagttacgtttctaccgttacctaccactacgtactaagttactcgtacgtacgaacggttagtaagtttactttacgtaacttaacttacttacgtacgtactaaacgtattaaacttacgttaacgtttcggttaccggaaccggtaacggtaactaacgtaaccttaaacgtaagtaacgtacgttgtaccggtactacgtaaccgtaccgtattccgttcgttacccgttacctacgttacccttcccgacttcgttacctgttaaccg

SEQ ID NO: 139914 - DNA, 908 bp, Homo sapiens
  misc_feature: GYAE6OF01BMXJY.46.67.G01.1.454.CMB.1.raw
tcagactagcagtacacgaccggtgctcgatttagagtatacatattggggtttgggggagtctcggtcaggacacagcatggacatgagggtccccgctcagctccgtggggctcctgctactctggctccggaggtgccagatgtgacatcgagctcgacccagtcctcctactccctccgtgtctcgaccgaaccgggtgggacacgtaggtcgtaccacctatccacgttcggccgggtacaacggtaccggaactgttacgaacctaactttaagtttaaactggtactacaacgtagtacggaacgtacgggaaccgtacccgtaacgccttaccgtatctatcgtcgtacgactacgttaccgtagtttacgacgtaacgggtccgggtaccctaggtacggtacgttacgacggtaggacggtaggtacggtcgtcggtaaggtaacgtattaacgttcctacctacctaaccgtaactacgtaccgtaaacgttacttcggtaacgtaaccggtaacggttaacggttaacgtttaacgttttaaccgtaaacccggttttaaatttaacccgtttaaggttaacccgttaaaaccgttaaacgttaaacgtttaacccttttaaacggttaaccggtttttaaccggggttaacccgggaaacggtttaaaaccgggtaacccgttaaaaccccggggttaaaacctttaaaacgggttaaaaacccgggtttaaaaccgttacggttaaccggggttaccggtaaaaccgttacccgggttaaacccttaaacccggggttactttaccggttacccgtttaaccggtttacccgttaccccttttaccccggttaccccggtaacccggtttctttaaacgtcgttaaaccccggg

SEQ ID NO: 139915 - DNA, 700 bp, Homo sapiens
  misc_feature: GYAE6OF01EVSVR.46.67.G01.1.454.CMB.1.raw
  modified_base (171)..(171): a, c, t, g, unknown or other
  misc_feature (171)..(171): n is a, c, g, or t
  modified_base (193)..(193): a, c, t, g, unknown or other
  misc_feature (193)..(193): n is a, c, g, or t
  modified_base (690)..(690): a, c, t, g, unknown or other
  misc_feature (690)..(690): n is a, c, g, or t
tcagactagcagtacacgaccggtgctcgatttagagtatacatattgggtttgtcctcctgctggtggcagctcccagatgggtcctgtccctggtgcaactgcaggagtccgggccacgactggtgaggccttcggagaccctgtccctcacctgcgcttgtctctgtncctcatcagtgttgttcttcgngggctcgggtccgcagtccgtccggaggggagggctaggactacgacgtttaggaagtcgttactcgtctagtacgtggacggtttcctattacacggttccgttacctactacgaacgtacggtacgacgtaccaaccgtaatacttccgttccgtacggaaccgtaccgtaccgagtaccgtaacgttcgttaaccgtttttacccgaggtaagttacgttacggttaccgtttacgtcggttacggacccgtcccgtaccggttacggaaccggtaccgggtttaccgtttttaacgttaaccggttgggtcgacggttagacggtacgttacttattacgttaggtttacggttttaggaggttttacgttacgtttaccgactacgtagcggtacgggtaccggctaccggcggcgacgtagtactgcgtcctacgtcgtaccttcgctaccgacggccgtcctaccgtcgtcccctcgcctcccacctccncgactcgccc

SEQ ID NO: 139916 - DNA, 1008 bp, Homo sapiens
  misc_feature: GYAE6OF01CT5NR.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccagactggtgaggtccttcggacgaccctgtccctcacctgcgctgtctcgtggtcacctcatcagttagttcgtttctcgtagggtctgggtccgcacgccgtacccggaaggggaacgggtctaaggtaactacgtaaggttaggtaaggtgttaccttacgtacgtaaggttcggttacgggtaccggtttaccttaacttaccgtacgttcccgtactaccgtacgaaagtcggtacgaagtacccaaccgtaattaccgtccgttcgtaaccgggaacctaccgttaccgaagtaaccttaaacgttaccgtttaacccggttttaccccgaagggtaaagttaccgttaggtttaaccggttacgtttaccgggtaccccgggtaacccggtccccggttaaccggttaccgggttaaaacccgggtttacccgggggtttttaaattttaacccggttacgttacgggggtcgtacgggaaaacggttacgggtaccgtttaacgtttaagtttaggttacggtttttacggttttaagggttaacggttttacggttttaccgtttaaaccggtaccccgttaaacccggttaggttaacccgggttcccgggggtaacccgggttacccgggttaacccccggttacccgggggtaaccgggggttaaacccggtaaacggggttaaccgggttaaccgggttcccgtttaacccccgggtacggtttcccccttaaacccgggtttaccccgtaccccgttaaccccggtaaaccggggtaaccccggttcccggttaaccggtttccccccggttaccccgtttcccccgtacggaccccccttacccctacccgtaacccgaagccccggtacccccgg

SEQ ID NO: 139917 - DNA, 699 bp, Homo sapiens
  misc_feature: GYAE6OF01DQF4B.46.67.G01.1.454.CMB.1.raw
tcagactagcagtacacgaccggtgctcgatttagagtatacatattgggtttgggggacctcctgtgcaagaacagtgaagcacctgtggtttcgtcctcctgctggtggcagctcccagatgggtcctgtccctggtgcaactgcgaggacgtccgggcccacgacgtggtgacggtccgttcggacacccgttcgtcccctcaccgtgcgtcttgtctcgtggtcgacctccgattcgaggttaggtttcggttttcgttcggtgggggtcgttcggggtccggcacggtcccgtaccggaagggggtaacgggtctagggtaacttaagtaggtttaggtaagttcgtctacttcgagttaggtggtacgttccttattacgtacgttcccgttcgtctacgaagtcgtacgtacgtacaacctatactctcgtacggaccaccgtcacgactaacttcttacgtttccgagtagtcgtgtacgttcgtcgtacggacccgtcgtcgtacggaccgtacgggttctttacgttcgtggtacggacgtagcgtacgttcttagttagttgtttagttggtagtttcgttactacgtactaccgtagtacggtcgggtccgggtactacccgggtccggtagggacggtaggtacgttcgtacgtccgtacttacccgtactcccgtccgtacccgg

SEQ ID NO: 139918 - DNA, 942 bp, Homo sapiens
  misc_feature: GYAE6OF01CX66N.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcagggagtccgggcccacgactgggtgacggcctttacgggacgacccctgtcccctcaccctgcgctgtcctcgtggtcgccctaccgatacgtagttaggtttcggttttcttcggtgggggtccgttcgggggtacccgctacggcccgtaccggaagggggacgggcgttaggaactaacgtagttaggaagttcgtactcgtactaggttaaggttcgggtacgtttacctagttaccgtacgttcccgtccttacgtacgaaaggtacggttaccgaacgtaccaaccgtaattaccgttccgttaccgtacgggtaaccctacccggttacccgaaacggttacccaaacgtttccccgtttaaccggtttttaccccgtaaaggttaaacggttacgttagggtttaccggtttaccgtttaccgggtcccggtaaaccccggtcccggtacccgtttacgggtaacccgggtttaacggggttttaaccgttttttaacggttaccgggttggtaccggtaaaccgggaacgtttaacgggtaaccggttacttttaacgttttaaggttaacggtttttaagggttttttacgggtaagggttttaggttttaacccgtttccgaacccgtaccggttaaggtaccgggtaccccggggtccggggtacccgtaaccccgggtacccccgggtaaggggggtaccccggtaaaaggttcccggtaacggttcccgggtaacccttacccggttacccttacccgttacccggtccgtaaacccccggg

SEQ ID NO: 139919 - DNA, 794 bp, Homo sapiens
  misc_feature: GYAE6OF01CS9WE.46.67.G01.1.454.CMB.1.raw
  modified_base (229)..(229): a, c, t, g, unknown or other
  misc_feature (229)..(229): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcgaggagtccgggcccacgacgtgggtgacggtccgttcgggacgtaccctggtcccctacaccgtgccgtctgtctcgtggtcnccctcatcagttgttggtttctcggtggggtctcggggtccgcacgtccgtaccggaagggggaacggggtccgtagggaaattaaccgtaggtttagggaacggttcgttactctacgtaagttagggtacgggtacggttttaccttaagtttaaccgtacgttcccggttcttacctacgaaaggtacggtaccgtacgtccaacctaattctacctcgtacgtactacgtccaagactaacgtctttacgttttcccgaagtaagtacgtggttacgttcgttacggaccggtacccgtccgtacgtacggtaaccggtacgggtttacgtttacgtttaccgtggttacggacgacggtaggtccgtaatttacgtttagttagttaggtttttacggtgtttagttttacgttaccgaaccgttaccgttaggtaccggtaccggggtaccggggtcccgtacccgggtacccggggtccgggtaacggtaacgggttaagttcccggacggttaccccgtacccgttcccgttaccgttccgaccccgttaaccccgg

SEQ ID NO: 139920 - DNA, 584 bp, Homo sapiens
  misc_feature: GYAE6OF01BHQT3.46.67.G01.1.454.CMB.1.raw
  modified_base (296)..(296): a, c, t, g, unknown or other
  misc_feature (296)..(296): n is a, c, g, or t
  modified_base (315)..(315): a, c, t, g, unknown or other
  misc_feature (315)..(315): n is a, c, g, or t
  modified_base (347)..(347): a, c, t, g, unknown or other
  misc_feature (347)..(347): n is a, c, g, or t
  modified_base (499)..(499): a, c, t, g, unknown or other
  misc_feature (499)..(499): n is a, c, g, or t
  modified_base (556)..(556): a, c, t, g, unknown or other
  misc_feature (556)..(556): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcgcctccatcagtagtggtttctcgtggggctgggtccgcagctcccgaggggaggggctagggaatacagttggaagtgtctctcagtaggtggaggtttcctattacagtccgtctctacaagngtcgagtcaccatatctcnggacacgtccagcaatctacgttttccagaanatgagttctggtcgacccgtcgctgaccgacgggtactttattacgtgtgacgagaggaggtctagttatgtagtttaggagttaggttattacgtacaccgtagacgtcgggtacgggctaccggacccgtgggaccgaagggtactacgnggtaccacgtcgtactacgcctacaccgacggtccctaggtccgtcccgttccccgngaccctaccctacctaccaagtcacccg

SEQ ID NO: 139921 - DNA, 635 bp, Homo sapiens
  misc_feature: GYAE6OF01D8Q1J.46.67.G01.1.454.CMB.1.raw
  modified_base (196)..(196): a, c, t, g, unknown or other
  misc_feature (196)..(196): n is a, c, g, or t
  modified_base (428)..(428): a, c, t, g, unknown or other
  misc_feature (428)..(428): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtcctccatccctccctgtctgcaaccggtggganacagtgtccacctaatccacgttcggccgggactaaaggtccggaaactatttcgactaacctttaatttaagtgtaatcaaacagtacgaccgacgggaccgaccctaagtcctacctaatcttatcgctgtactacgttcgtaagtttgaccggtaaagggttccgggtaccctagtcggtacggtcaggtcggcgtagtgtatcgtaggactagcttacactctacacntaacgatactcgtgactagtctaagttcttacgaacttactttattacgttacgtaacaagtaacttaagttactagtttcgtttacgaaccgtaaggacctaacgtaactaaacgtaataacgtacttggtcgacgtacgaccgtaactcttacttcgttaccttcttacccgtttccctaccgttcctaacgttgtacgttaacg

SEQ ID NO: 139922 - DNA, 757 bp, Homo sapiens
  misc_feature: GYAE6OF01D5KKW.46.67.G01.1.454.CMB.1.raw
  modified_base (178)..(178): a, c, t, g, unknown or other
  misc_feature (178)..(178): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgacgtggtgacggccttcgggacgaccctgtccctcacctgcgctgtctcgtggtcncctcagtcagttgttggtttctcggtggggtcgtcgggtccgcacgtccgtccgaagggggaacgggtctaggaaacttacgagtttacgggaagttcgtacctctacgagttacggtgggtacgttacctagttaccgtcgtcccgtctctacgaagtgtcgtacgtctactatactctacgcggacaccgtcacgcaacttcgtacgttttccgagacgtagtgtagttcgtcgtcgacccgtccgtcgtacgacggtaccgggttcgtttagttaccgtggtcgacggtacggtacggacgtacgttatttagttaggttttacgttttgggtaggtttcgtttaacgttcgtaacccgtaaccgttagtacggtaccgggaccggggtcctccgggtaccccgggtacgggaccggtaacgggttaccgttacggttaccggtaccgtacccgttacccgttccgtaccgtccccgtacccggaaccgtacccgggtaccctaccggttcccggttacccccttccccgtcccgtacccctaccccgtaccctaccggaaaccgtcggtaccccg

SEQ ID NO: 139923 - DNA, 636 bp, Homo sapiens
  misc_feature: GYAE6OF01CD1AS.46.67.G01.1.454.CMB.1.raw
  modified_base (191)..(191): a, c, t, g, unknown or other
  misc_feature (191)..(191): n is a, c, g, or t
  modified_base (228)..(228): a, c, t, g, unknown or other
  misc_feature (228)..(228): n is a, c, g, or t
  modified_base (252)..(252): a, c, t, g, unknown or other
  misc_feature (252)..(252): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtggganacagtgtcaccatcacttcgccgggcaagtcgaactnttcgacacttattaatgtatcaantagacagggacgccctaagctcctaatcatacgtctgcactcgtagtttgacaaaggtcgggtcccagtcgtaggttcagttggcgagtggatccgtagggactagtactttcacgttactcgacctatactaagttaactcgtcgtaccgtaaacggttagtaaacgttaagtttcgtaaacctaactttaacgtttaacgttaggtaacctaaaggtaacttaaacttaactaacgttttacggttttaaccggaccgtaacgggaaccgttacgaaaccgtttaaactaaacgttaacgaaaccgttggtacgtacctacgacctacctagtcttcgttactacttccgttacccttaccgacctacgttctacggttaac

SEQ ID NO: 139924 - DNA, 791 bp, Homo sapiens
  misc_feature: GYAE6OF01ER2FK.46.67.G01.1.454.CMB.1.raw
  modified_base (184)..(184): a, c, t, g, unknown or other
  misc_feature (184)..(184): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgacggtcctttcgggacgaccccttgtacccctcaccctgcgctgtctcgtggtcncctcatcagtagttgtttctcgtgggctcgggtccgcagccgtaccgaggggaagggctaggtaatacgtagttaggaacgttgtcctactacgagttaggtaggtaggttcccttaattaccgacgttcccgtctacctagaagtacgtacgacgttaccaccgaattacgtcgttcgtaaggaccacggtccaagctaaattcgtacgtttttacccgagtaaggtactgtaagtttcgtacgttacggacccgtccgtaccgttacgaccggtaaccggggttacctttttaagttaccgtagggttacgaccggtagaacgggtacgtattaacgtttagtggttttaagttttggaggtttcgtttaacgttccgtaaccttacccgtaagcgtaccggggtaccggggtcctaccggtaccccggtagggaccggaacgggttaactaccggttcgggtaacccgtaccgtacccgttaccgttaccgacccccgttaaccgtaaaccccggtacggtaccccgtaacggttcccggttacccccttaccccgtacgggtacccctccccgtacccgtaacccgtaacgccgtaaccccgg

SEQ ID NO: 139925 - DNA, 744 bp, Homo sapiens
  misc_feature: GYAE6OF01BFEC9.46.67.G01.1.454.CMB.1.raw
  modified_base (193)..(193): a, c, t, g, unknown or other
  misc_feature (193)..(193): n is a, c, g, or t
  modified_base (219)..(219): a, c, t, g, unknown or other
  misc_feature (219)..(219): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgtcaccatcacgttgccgggnaagtcggaactattgactaccttaatttaaagtgtatacaactatacgaccgagggaccgaccctaagctacctaatctatcgctgctactccgtagtttcgacgtaaggttcgggacctagtcggtaggttcgaggtggctaggtggtacgtcgtagggactagttactttaccgacttactacctaaccgtattacgtaagttaactccgtacggtaccgtaacggttagtaaacgtttacgttttacgaacctttaaacgtttaacttacgttacgtaacctaaacgttaacggttaaactttaacgttaacgttttacggtttaacccgggaaccggttaaacgggtacccttaaaccggtaaacctttaaaacgttaaaacgtttaaaccggtaacgttacgggtaaccggtacctaaccggtaacctaacccgttagttaccgtttacgtttacccttaaccgttacccgtttaccccgttaccccggttaccttaacgtttcccgtaagtttaacccg

SEQ ID NO: 139926 - DNA, 760 bp, Homo sapiens
  misc_feature: GYAE6OF01AWQQL.46.67.G01.1.454.CMB.1.raw
  modified_base (691)..(691): a, c, t, g, unknown or other
  misc_feature (691)..(691): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccactccctccctgtctgccaaccggtggagacgagtcgtaccaccatccgacttcggccgggacaagtccggaactacgttacgacctaccgtttaattttaaacgtggtaactaccaaactagtaaccgaccgacggggacccggtaccctaagtccttaccttaatctacgtcgactgactacgtaccgtagtttacgacgtaacgggttcgggtacctagtcggtaggttcagggtcgtacgagtagtacgtcggtacggactaggtacttaccgacctcctcaaccgtagtaccgtaagttacctcgtacgacgtaaccggtattaaacgtttactttacggaaacctttaacgtttaacgtttaccgtaacgtaacctaaacgttaacgttaaactttaaaccgtacggttttacgggtttaaccggaaaccggtaaacggtaacccgtaaccgtaaacgtttaaaacttaaaccggtaaacgtacgttacggtaccggtactacggtacctaaccgttnttacccggttacttaccgtttaccttacctttaccccgtaccgttactacgttcccgtaagttaacccg

SEQ ID NO: 139927 - DNA, 990 bp, Homo sapiens
  misc_feature: GYAE6OF01ALZA8.46.67.G01.1.454.CMB.1.raw
tcagactagcagtacacgaccggtgctcgatttagagtatacatattggtttgtcctcctgctggtggcagctcccagatggtcctgtccctggtgcactgcaggagtcggcccacgactggtgaggtccttcggacgaccctgtccctcacctgccgctcgtctctggtcgtccctacctatctaggttcgtttcggttttcgttcgtcgggtccgttcggggtcccggacgtacgcctacccggaggggaacggggcgttagggaacttaacgtaggttaggtaacgtgttccgtcttacgtagttaggtcggtacggtttaccttaagttaccgacggtccgttacttacctacgtaaacggtaggttaccgtacggttacaacccgttattaccgttacttaccggttacgggaaccttaccggttacccaacggtacctaacgttccgttttaacccgtttaccgtaacggtaacgtacggtaggtttacttaccgttacggtaccggtccccgaccgtcgtacggacccggtacgggtttacctttacgttacggtcgtcgagggtaaccgaggtacgttacgttacgtttaagttcgtttaacgggtttcggtaacgttttaggttttacccgttaggtaaccccgtttaaccgttaagggtaccggttacccgggggtacgggtttaaacccccgttacccccggggttaaccgggtacgggggttaaccccggaaacgggtttaaccggggttaaccggttttaccggttaacccccgggtacccgttttaaccggtttacccccgttaacccgggcccccgttaaacccccgttaacccccgggggaaacggtttcccccccgttacccgggttttacccccgggtaccccccccgtttttacccccgaaccccggggttaccccgttacccccccccgtagtttaacccccggaacggggtttaacccctcccccgggg

SEQ ID NO: 139928 - DNA, 780 bp, Homo sapiens
  misc_feature: GYAE6OF01A6I0U.46.67.G01.1.454.CMB.1.raw
  modified_base (172)..(172): a, c, t, g, unknown or other
  misc_feature (172)..(172): n is a, c, g, or t
  modified_base (650)..(650): a, c, t, g, unknown or other
  misc_feature (650)..(650): n is a, c, g, or t
tcagactagcagtacacgaccggtgctcgatttagagtatacatattgggtttgtcctcctgctggtggcagctcccagatgggtcctgtccctggtgcaactgcaggagtcggcccacgactgggtgaggcccttggagaccctgtccctcacctgcgctgtctctggtcncctcatcagtagttcggtttctcgtggggctgggtccgcacgccgtccgaggggagggctaggaatacagttggaatgtcttcactagtacgtggtacggttctaattacgacgttcccgtctcgtacgaaagtccgtagtacgtaccacctatacttccgtcgtacggactccgtaccgagtacctaaagttccgttacgttttacccaggtaacgtagttacggttaacgtttcgttacgtaccggaccccgtccggtacgttaccggaccggttacgggtttaccgttttaagttaccgtgttcggagggtacgaccggtacgggttctttaagttacggtttaggtttacggttttaggtagttacggtttactaccgtaaccgtacgtcgtacggcccgggtacgggtcctcccggtaccggtacgggaccggtaaggttaacctacggtaccgttacccgtccgtttaaccncccgttacgaccccgttaccgaaacccggtacccggtccccgttaaccggttccccggtaccccgttacccccggttacgacccccgttaccccgtacccgttacccggaaacccgtcccggtaaccccg

SEQ ID NO: 139929 - DNA, 881 bp, Homo sapiens
  misc_feature: GYAE6OF01BRTZB.46.67.G01.1.454.CMB.1.raw
  modified_base (246)..(246): a, c, t, g, unknown or other
  misc_feature (246)..(246): n is a, c, g, or t
  modified_base (299)..(299): a, c, t, g, unknown or other
  misc_feature (299)..(299): n is a, c, g, or t
tcagactagcagtacacgaccggtgctcgatttagagtatacatattgggtttgggggacctcctgtgcaagaacatgaagcacctgtggtttgtcctcctgctggtggcagcctcccagatcgggtccctgtccctggtgacaactgcagggacgtccgggacccacgtacgtgggtgaggtccctttagggaacgtaccccgttcgtccccctaccgacctggccgtcttgttcctcgtggtcnccctcagtcgtaggttagttcggttttctcggtggggtcttcggggccgacgngcccgtacccggagggggaacgggctaggaattacgtagttaggaacgttgttacctcgtcgtaagttacggtagggtaaccggtttacctaagtttaccgtacggttcccgttctccgtacgaaacggtacgtaccggacgtaccaccgtaactacttacgtaccgtacggtaaccgtacccgtaccgaacgtacgttaaccgtacgttttacccgttttacccgaaggtaacggttcgtacgggtttacgtttccgttaccggtacccgggacccgtccgttacgtacgggtaacccgggttaccggggtttacttttacggttacgttcgggtagggtacccggtaacgggtaaccggtaccgttactttaagtttaggttagtttttacggttttacgggtagttttacgggttttacctttaccgaacccgttaccgggtaatcccggggtacgggttacccggggtaccccgttaccccgggtacccgggtacgggtacccggaaacgggttaccgttacgggttaccgttacccgtaccgtttaccccttacccgtaccgtccccccggtaaccg

SEQ ID NO: 139930 - DNA, 821 bp, Homo sapiens
  misc_feature: GYAE6OF01CX5M5.46.67.G01.1.454.CMB.1.raw
  modified_base (719)..(719): a, c, t, g, unknown or other
  misc_feature (719)..(719): n is a, c, g, or t
tcagactagcagtacacgaccggtgctcgatttagagtatacatattggggtttggggagtctcggtcaggacacagcatggacatggagggtccccgctcagctccgtggggctcctgctactctggcctcggaggtgccagatgtagacagtcgagctcgaccagtcctctactcctcctgtcgtcgaccgacgggtagggacgacgtacggtctaccaacctagtacgtacggttcggaccggaacgtaacggtacggaacttagttacgaacgttaacctttaaagttttaaaggtgttaacaactaaacgtacggaacgaacggaccgggtaccgtaacctagtacctactaatcgtaagtcgctacgactagtcctaggttacgaacgtaacgggttcggtaccctaggtcggtacgttacgaagggtccggtaagtacggtaggtactaccgggtagggaactacgtttacgtacccgtaactcccgtaactaaccgtaagttaccgaacgttcgttacgaaggtaacgtaaggttacgtaagtttacgttaataaccccgtttaagttaactacggtaaacgtaaacctaagggttaaacttaaccgtttaaggttaaaccgggtttcgggtaaaccggtaaaccggtaacgggtaacttaaaacccggtaaagttaaaactaaaaccggttaccgttaggtccgggttanaaacccgggtacaaccccgttacgtaactttccgggttatttacccctaccgtaaacccgtttccgaacccggtttaaaaccgttccggtaaaattccccgg

SEQ ID NO: 139931 - DNA, 740 bp, Homo sapiens
  misc_feature: GYAE6OF01B0B3H.46.67.G01.1.454.CMB.1.raw
  modified_base (111)..(111): a, c, t, g, unknown or other
  misc_feature (111)..(111): n is a, c, g, or t
  modified_base (176)..(176): a, c, t, g, unknown or other
  misc_feature (176)..(176): n is a, c, g, or t
  modified_base (199)..(199): a, c, t, g, unknown or other
  misc_feature (199)..(199): n is a, c, g, or t
  modified_base (213)..(213): a, c, t, g, unknown or other
  misc_feature (213)..(213): n is a, c, g, or t
  modified_base (418)..(418): a, c, t, g, unknown or other
  misc_feature (418)..(418): n is a, c, g, or t
tcagactagcagtacacgaccggtgctcgatttagagtatacatattggggtttgtcctcctgctggtggcagctcccagatgggtcctgtccctggtgcaacgtgcaggngtccggccacgctggtgacggtccttcggagaccctgtccctcacctgccgctgtctcgtggtcncctcatcgagtgttgtttcctgngggctcgggtccgntacgcctccggagggggacggctaggaatacgtagttggaagtgtactcgcagttaggtcggtagtttccttaagttaccacgggttcctctctaacgaaaggcgttacgagtcccaaccgtattactccgttcgacggacctaccggttcaacgcctaaagttcccgttacgttttacccgaggtaaagtcgttgtacgtttcngggtaccacccggtcgtcgttacggaccggttcgggttactttttaagccgagggttcgacgacggacggtacgtattagttagttagtttaacgtttttggagtttacgtttacgttaccgtaaccgtccttacggtacgtaccgggtccgggtacccgtccgggtacccgggtacgggaacgtagggtaaccgtgttaccggtccgtacccttccgttaccttcgtaccccgtaccgaaccggtaccgtcccgtacgttccccgttccccgttcccgtacccggtaccctcccgttacccgacccgtagcccgtacccgg

SEQ ID NO: 139932 - DNA, 740 bp, Homo sapiens
  misc_feature: GYAE6OF01EGVPB.46.67.G01.1.454.CMB.1.raw
  modified_base (98)..(98): a, c, t, g, unknown or other
  misc_feature (98)..(98): n is a, c, g, or t
  modified_base (292)..(292): a, c, t, g, unknown or other
  misc_feature (292)..(292): n is a, c, g, or t
  modified_base (318)..(318): a, c, t, g, unknown or other
  misc_feature (318)..(318): n is a, c, g, or t
  modified_base (457)..(457): a, c, t, g, unknown or other
  misc_feature (457)..(457): n is a, c, g, or t
tcagactagcagtacacgaccggtgctcgatttagagtatacatattgggtttggggagtctcggtcaggacacagcatggacatgacgggtccccgntcagctccgtggggctcctgctactctggctccggaggtcgccagatgtgacatcgagctcgacccagtcctaccactccctccgtgtctgaccgaccggtgggacacgtaggtcaccacgtactcctacgttcggaccggactaacggtacgaactacgtcgaacctaacgtttaattaagttgtactacaanagtacgaccgtacggaccgtacctancctactacgtctatcgcctcgtactactacgtacggttgaaaccggtacgggttcggacccgtagttcggtacgttaggcggtacggcgttaggacggtacgtcgaggtaccgtaattctacgtactccgtaacctaanaggttactaagtacgtaccgtagtaaccgttacgtaggttaactttacgttaacgtaactttaaccgtttacgtaacgttacggttaaacctaagtaactttagtttaacccgtaggttttaccgggttaaccgaaacggtaaccggtaaccgtaaacttaaaccgtaaacttaaacggtaaacgtcgttaccggacgttaccggaaccaccgttaacttacgtcttaacccttccgttacctaccgtttcccgtaccctagttaccttacggtcttaaccgg

SEQ ID NO: 139933 - DNA, 750 bp, Homo sapiens
  misc_feature: GYAE6OF01CVFWJ.46.67.G01.1.454.CMB.1.raw
  modified_base (175)..(175): a, c, t, g, unknown or other
  misc_feature (175)..(175): n is a, c, g, or t
tcagactagcagtacacgaccggtgctcgatttagagtatacatattgggtttgtcctcctgctggtggcagctcccagatgggtcctgtccctggtgcaactgcgaggagtcgggcccacgactggtgaggccttcggacgaccctcgtccctcacctgcgctgtctctggtcncctccatcagttagttcggtttcttcggtgggtcgtcgggtccgcgacgccgtccggaggggaaggcgtaggtaatacgtagttaggaagtcgttactctacgagttagggtaggtaacggtttacctacgttaacgtacggttccgttctccgtaacgaggtacgtcgagtaccacctaatctcgtacgtcgaccacgtaccacgataactcgttacgtttaccaagtaacagtttacgagttctacggtccgacccgtcccgtcgtacggtacggtaccggtttacgttttacgtacgtcggttgggacggtacggtacggtaacggtacgtttaagttagtttaggtttaggttttacgggtacggtttaggtttaccgttacgaaccgttaccggtaatccgggtaccgggtacgggttacccgtcccggtacccgggtacggaccgggtaacgtaacgttccgtcggtacccgtccgtacccttcgtacccgtcccgtaccgaaccggccgtaccgttaccgtcccgttcccctcccgtccgaccctccctaactcgacgccgtacccgg

SEQ ID NO: 139934 - DNA, 702 bp, Homo sapiens
  misc_feature: GYAE6OF01EBSOL.46.67.G01.1.454.CMB.1.raw
  modified_base (225)..(225): a, c, t, g, unknown or other
  misc_feature (225)..(225): n is a, c, g, or t
  modified_base (267)..(267): a, c, t, g, unknown or other
  misc_feature (267)..(267): n is a, c, g, or t
  modified_base (287)..(287): a, c, t, g, unknown or other
  misc_feature (287)..(287): n is a, c, g, or t
tcagactagcagtacacgaccggtgctcgatttagagtatacatattgggtttgggggacctcctgtgcaagaacatgaagcacctgtggtttgtcctcctgctggtggcagcctcccagatgggtcctgtccctggtgccaactgcagggagtccgggcccacgacgtggtgacggcctttcggacgaccctgtccctacacctgccgtctcgtctcgtggtcncctccagtcaagttgttcggtttctcggtgggctggtccggnacgcgtaccggagggacggntacggaatacagttaggaagtcgtactctacgtagtaggtcggttacggttccttaagttaccgacggttccgtactactacggaagtacggtcgtacgtaccaactacgtatccgtcgtacggactacgtcagtaactacttacgttaccgtttacctaaggaacgtagttacgtagttacgtggtacccgtaaccggcccgtgtaaccgtacggtacgggttactttacggttcgtacgtggtaccgaaggtcgtacgttaagtatttagtcgttttaagggttcgtaacgggtttgttttaacctacgaaccgttaccgtgaacggtcgggaccgggtcacccggtaccgggtagggacggtacgtacgttacgtcgtaccgttaccgtaccctacgtcccgtcctaacccg

SEQ ID NO: 139935 - DNA, 718 bp, Homo sapiens
  misc_feature: GYAE6OF01BGWZU.46.67.G01.1.454.CMB.1.raw
  modified_base (197)..(197): a, c, t, g, unknown or other
  misc_feature (197)..(197): n is a, c, g, or t
tcagactagcagtacacgaccggtgctcgatttagagtatacatattgggtttggggagtctcggtcaggacacagcatggacatgagggtccccgctcagcctcctggggctcctgctactctggctccgaggtgccagatgtgacatcgagctcgacccagtctccactcctccctgtctcgcaaccggtggganacaggtgtccaccatcacgttcggccggacaagtcggaacattacgacctaccttaatttaaagttggtaatacaactagtaacgaaccgaggggaccgtaccctaagtcctacctaatctatcgctgctactccttagttgacgtaagggtcgggtcccagtcgtaggttcaggtgcgtaggtcgtattcggtagggactagttactttccgtacctcgtacctaccacttacgtaacgttacttaccttacgaccgtaaacgttagttaaagtttaactttacgtaaccttaaccgttttactttaaacgttcggttaaactaaacggttaattaaacgtttaacttaaggttttacggtttaccggaaccgtaacgggtaacctaacgttaaactaaacgttaaacttaaacggttaactacgggttacgacgtaccgtaccgtaaacttccgtttcttacgtttaccttaaccgttacctttaccccgtaccgtaccttaactttcgtacgttaacg

SEQ ID NO: 139936 - DNA, 708 bp, Homo sapiens
  misc_feature: GYAE6OF01ARQCJ.46.67.G01.1.454.CMB.1.raw
  modified_base (190)..(190): a, c, t, g, unknown or other
  misc_feature (190)..(190): n is a, c, g, or t
  modified_base (197)..(197): a, c, t, g, unknown or other
  misc_feature (197)..(197): n is a, c, g, or t
  modified_base (211)..(211): a, c, t, g, unknown or other
  misc_feature (211)..(211): n is a, c, g, or t
  modified_base (234)..(234): a, c, t, g, unknown or other
  misc_feature (234)..(234): n is a, c, g, or t
  modified_base (248)..(248): a, c, t, g, unknown or other
  misc_feature (248)..(248): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccagactggtgaggccttggagaccctgtcccncactgcnctgtctcgtggtcncctccatcgagtgtgtttctcgnggggctgggccgcngcctccgagggagggctaggatacgattggaagtcgtctctcatacggtggtaggttacctagttaccgacggttccgtctctaccgtaagacgtacggtactacctaaccgtatacgttctccgtacggaactaccgtaccagacctaattaccgttacgttttcccgaaggtaacgtacttacggtaacttcgtacgtcggtacccgaccggtctaccggaacggttacgggttacttttaagtaccttggtacggtacgttaacgacgggtcgttacttaggtttacgtggttttagtttacgggtcggtttaacggtttacttacccggttaaccgaccttaaggtcgtaccggggtaccgggtcccgtaccggtaccccgggtgggtaaccggacgggttacctaaccgggttcgtacccggtacgttcccgtaccttcccggccctaaccccgg

SEQ ID NO: 139937 - DNA, 821 bp, Homo sapiens
  misc_feature: GYAE6OF01CAQYJ.46.67.G01.1.454.CMB.1.raw
  modified_base (765)..(765): a, c, t, g, unknown or other
  misc_feature (765)..(765): n is a, c, g, or t
  modified_base (802)..(802): a, c, t, g, unknown or other
  misc_feature (802)..(802): n is a, c, g, or t
tcagactagcagtacacgaccggtgctcgatttagagtatacatattgggtttggggagtctcggtcaggacacagcatggacatgagggtccccgctcagctccgtggggctcctgctactctggctcggaggtgccagatgtgacatcggagcctcgaccctagtcctccactccctccctgtctgacgaaccggtggggacacacgttcgtaccactactctaccgttcgggacccgggacgtaacggtaccggaactagttacgaacctaaccgtttaagttttaaacgtgttaacactaacaacggtaaccgaaccgggtacggggacccgtacccttaaacgtccctaccgttaaactctagtcgacctcgtacctactaccggttagtttacggaacggtaacggggtttacccggtccgtacggttggtacgggttacgagggtcgacggtggtcggtaagttccgggaagggtaactcgtttaacctttacaccttaccctaacgtaacgttcgtaacttaaaggttacctccgttaacgaaccggtttaaggtaacgttaaacgtttacttagtaaaccttacgttttaacgtaagtaaccgttaaagtaactaacgttaactttaacgttaccggtttaccgggttaacgaaccggttaaaccggaccgtttaaaaccgtaaacttaaccggttaaaacgttacgtaacgttacgggtctacgtacgaacccttaacgttcttacccggtttanacccgttttacgtacccttaccccgttaccttaaccncttaccgtaacggttaacg

SEQ ID NO: 139938 - DNA, 639 bp, Homo sapiens
  misc_feature: GYAE6OF01CAIK4.46.67.G01.1.454.CMB.1.raw
  modified_base (198)..(198): a, c, t, g, unknown or other
  misc_feature (198)..(198): n is a, c, g, or t
  modified_base (245)..(245): a, c, t, g, unknown or other
  misc_feature (245)..(245): n is a, c, g, or t
  modified_base (370)..(370): a, c, t, g, unknown or other
  misc_feature (370)..(370): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgacgtgggtgaggtcctttcggagaccctgtcccctnacctgccgctgtctctggtcgccctcatcgagtagtggtttcttcgngggctgggtccgcagccgtccgagggaacgggcttggaatacagtttggaagtgtctctctagtaggtcggaggtttcctattacgacgtccgtctctacaagagtcgagtcaacctatactctnttcggaccacgttccaagtcctaaatcctaacgtttttcccaggtaaagtacgttggtacgtttccgtgtaccgacgcccgtacgtcgacgtcgggtctttatacgtgtagcgtaagcggtacgtcttaagttacttgtagtttttggagtttggttattacgacctacgtagtacgtcggtacgggtcctaccggcccggtaggggacccgtaagggtaaccttagtccgggtaccaccggttccctacctttcggccccgtaacccg

SEQ ID NO: 139939 - DNA, 924 bp, Homo sapiens
  misc_feature: GYAE6OF01BRKFB.46.67.G01.1.454.CMB.1.raw
tcagactagcagtacacgaccggtgctcgatttagagtatacatattgggtttgtcctcctgctggtggcagctcccagatgggtcctgtccctggtgcaactgcagggacgtccgggcccacgactgggtgaggccctttcgggacgtacccctgtcccctcacctgcgtctgtctcgtggtcgccctacatcaaggttacggttcggttttccttcggtcggggggtccttcgggggtacccggcacggtcccgttaccccggaagggggggaacggggtctaacgggtaaacttaccgtaggtttacgggaagttcgttccttacgtactaagttacgggtcggtaacggtttacccttaagtttaccgacggttcccgttacttaccgtacgtaaaggtcggttaccggtaactaccaacctagttaccttcccgttcggtaacggaccctaccgggttaccaacggtaccttaaacgttccgttttacgttttaccccgaaggtaaccgttacgttaggttaccgttcgtacgggtaccggaaccccggtcccgttaacggttaccggacggtttaccggggttttaacttttaacttcggtcggttacggaccgggaaggtacggtaaccggtctttaacgttagttagtttaggtttacggtagtttacggtttactaccggtaacctaccgtaaggtcggtccggggtacggggtccctaccgggtcccggtacgggtaccggtaagggttacccttacggtaccgggttacctacccggtttccgtaccgttacccggtaccctacccggaaccgggtccggtaccccttaccgggttccccggtttaccccctcccgggttccgtacccccgtttaacccggtccccttaacgggtacctccccggtaacccgg

SEQ ID NO: 139940 - DNA, 932 bp, Homo sapiens
  misc_feature: GYAE6OF01DVUCD.46.67.G01.1.454.CMB.1.raw
  modified_base (175)..(175): a, c, t, g, unknown or other
  misc_feature (175)..(175): n is a, c, g, or t
tcagactagcagtacacgaccggtgctcgatttagagtatacatattgggtttgtcctcctgctggtggcagctcccagatgggtcctgtccctggtgcaactgcaggaggtccgggcccaggactggtgaggccttcggacgccctcgtccctcacctgcgctgtctctggtcncctccagtcgtaggttaggtttggttttccgttcgggtcggggtcgttcgggggtcccggacctacggtcccgttaccccgggaaggggggaaaccggggcgttacgggtaaatttacgtaggtttacgggtaaagttcgttccttactacgttaaggttagggtttacggggtaccggttttaccttaaccgtttaaccgtaccgggtttacccgttaacttaccgtaacgtaaacgggtacggtaacggtaccttacccgtaaacctaattaccgttccgttacggtaccggaacctaccggtacccgataacctaaactttcgtttacccgtttaacgtagtaaaacgtgttacgttacggttctcgggtaccgacccggtctacgtcgtaaccggtacgggtttctttaacgtagtcggtacggaccggtaaggaccgtacgggtattagtttagtttacggtttaaggttttcggaaggttttacggtttaccgtttaccgtaccgtaccggtaaaggttccgggacgggggttaacccggggtcccggtaccgggtaaccccggggtaacggggttaccggtaacggggtaacgttccggtacgggttacccctacggtttacccttaccgttaccggtcccaaacccccgttaaccgggaacccggttccccgttaccggttccccggttcccctacccccggtcggtcccccctaacccggtccccgtaacgaacccggtcgtaccccg

SEQ ID NO: 139941 - DNA, 738 bp, Homo sapiens
  misc_feature: GYAE6OF01ERJR1.46.67.G01.1.454.CMB.1.raw
  modified_base (323)..(323): a, c, t, g, unknown or other
  misc_feature (323)..(323): n is a, c, g, or t
tcagactagcagtacacgaccggtgctcgatttagagtatacatattggggtttgggggagtctcggtcaggacacagcatggacatgagggtccccgctcagctcctggggctcctgctactctggctccgaggtgccagatgtgacatcgagctgaccctagtctccactcctccctgtctgcaaccggtgggagacagtcgtacaccatcacgttcggccgggtacaacggtacggaactattacgacctacttaatttaaagttggtatacaacatacgaccgagggaccgaccctaagcctactatctatgctcgacnctacgttaggtctaacgtagggttaccgtctacgtacggtcgtacgtaggtcggacgtagggacgtagtacggtagggtaacgtacgtttacttactaccttactaaccactacgtaacgttaacttaacggttcctaaacggttaccggtaaagtacggttttaaacgttacgtttaccaactttaaaccgttttagttaccgtaacttaaacgaaaccgtttaacgttaaacgttaaccgttttagggtttaccggtttaaacgggaacccggaaacggtaaccgttaacccaaaagtttaaaaaccgtaaacggttaaaacggtcgtacggttacggtacgaacccgtataccgttatttcgtaccgtttcctaacttccccggtacccttaccgacttcgtcgtgtaaccg

SEQ ID NO: 139942 - DNA, 787 bp, Homo sapiens
  misc_feature: GYAE6OF01D82OQ.46.67.G01.1.454.CMB.1.raw
  modified_base (145)..(145): a, c, t, g, unknown or other
  misc_feature (145)..(145): n is a, c, g, or t
  modified_base (149)..(149): a, c, t, g, unknown or other
  misc_feature (149)..(149): n is a, c, g, or t
  modified_base (463)..(463): a, c, t, g, unknown or other
  misc_feature (463)..(463): n is a, c, g, or t
tcagactagcagtacacgaccggtgctcgatttagagtatacatattggggtttgggggagtctcggtcaggacacagcatggacatgacgggtccccgctcagctcctgggggctcctgctactctggctcggaggtgccagtntgtnactagtcgagctgacccagtcctccactccctcctgtctcgaccgtaccgggtggacgacgtacgtgaccaacctacgtccgtacgtcggcccgggtaacgtaaggtaccggaactacgttacaaccgttactttaaatttaacgttgtaactaacaaacacgtacggaaccggaccgggaccgtaccctaatccttacctataccgttatcggtactccgtactaccgttccgttaaggtttacgaaccgggttaacgggttccggttacccgacgggttcggttaagggtacctgggtaggacgttaagggngttacgtacggacggtaacttacgtttaacttccctaccttcctaacgtaccgttaaagttacctaacgttacttccggtaacgttaaccggtaagttaagtttaacgttactttaccgttaactttaagtttaccttactacgtaactaagttaacgtaattaacgtttaccgttacggttacggaaccgtaagtaacccgtaaagtaaaccgttaaacgtaaagttaaccgagttaacggtctacgtaccaacgttaccttacgttcttccgttaccttaccggttaccctccgttacacctttcggtaacctgttaacccg

SEQ ID NO: 139943 - DNA, 832 bp, Homo sapiens
  misc_feature: GYAE6OF01B271H.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagaccctgtccctcacctgcgctgtctcgtggtcgcctccatcagtagtggtttctcgtgggctgggtccgcagctccgaggggagggctaggatactagttggaagtgtctctcagtaggtggtacggttcctagttacacgtccgtctctacaagacgtcgacgtcacctatactcctcgtcggaccaccgtccagctaactcttacgttttcccagtaagtattacggtagttctggtaccgaacccggtcccggtacgtacggtacccggtacggggtttacgttttaacttaccgtggtacggacggtaagggtacggtaacgggtctttaagtttacgttaggttttaggtttttacggggtaaggtttacggttttacgtttaacccggaacccgttaacccgtaagggtaccggttaccgggggtaaccgggggtcccttaccccggggtacccccgggtacgggggtacccggtaaggggtaaaccgtttacggttccgggttaacccgtaccccggtttccttaaccccgtttaccggacccccgtacccggtaaaaccccgggtaccggggtacccccttaccgggtttcccccggttaccccgtttcccccccggttaccgggtaccccccttacccccgttaaccccgttacccggaaacgggtcccccggtaaccccgg

SEQ ID NO: 139944 - DNA, 754 bp, Homo sapiens
  misc_feature: GYAE6OF01BLT76.46.67.G01.1.454.CMB.1.raw
  modified_base (277)..(277): a, c, t, g, unknown or other
  misc_feature (277)..(277): n is a, c, g, or t
  modified_base (362)..(362): a, c, t, g, unknown or other
  misc_feature (362)..(362): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctcgtggtcgcctccatcagtagtggtttctcgtgggctgggtccgcagcctccgagggagggctaggaatacagttggaagtgtctctcagtagtggtacgttcctagttacngtccgtctctgaagtgtcgagtcacctatcttctcgtaggacctaccggtcacgactaacgttccttacgttttcccagaacgtnttaggtaacgttcgtcggtacgtacccggcccgtcgtacgaccggtaccgggttcttttaagtacggttggtcgacgggtacgtaacggtaccggtactttaagtttacgtttaggtttacgtttttaggggtagttttacgggtttaccgtttacgtaacccgttaacccgtacgggtacgtacccgggggtaacccggggtcccgttacccggaccccgggttaggggaccgtaaacggggtacttaaccggtcggtacctacccggttcctaaccgttaccgcccctacccgtaacccggtaccggtacccgtacggttccccgtttcccccgttccccggtaccggcccccttacccccgtacccgtccgtaaacggcccgtacccgg

SEQ ID NO: 139945 - DNA, 777 bp, Homo sapiens
  misc_feature: GYAE6OF01CJED3.46.67.G01.1.454.CMB.1.raw
  modified_base (732)..(732): a, c, t, g, unknown or other
  misc_feature (732)..(732): n is a, c, g, or t
  modified_base (767)..(767): a, c, t, g, unknown or other
  misc_feature (767)..(767): n is a, c, g, or t
  modified_base (772)..(772): a, c, t, g, unknown or other
  misc_feature (772)..(772): n is a, c, g, or t
tcagactagcagtacacgaccggtgctcgatttagagtatacatattgggtttggggagtctcggtcaggacacagcagtggacatgagggtcccgctcagctccgtggggctcctgctactcgtggcctccggaggtcgccagactgtcgacatcggagcgtacgaccctagtcctccacttccctaccgtgtcgtacgaccgtaaccggtgggacgacgtacggtcgtaccaacctacgtacctacggttcgggccgggtaacgtaacggtaccgaactagttacgaaccgttaaccttaagttttaaagttcggtactaactaaacgtaacgtaaccgaaccggacgggacccggtaacccgtaacgtaccttacgtacttacgtacgtacggtctacgtcctacgttacgtacggttacggaacggtaacgggtcgggtacctacggttacggtacggttacggtacgggtacgtacggtacggttacggtaggtcggtacgggaactacggttactttaccgaccgttacgtacctaccgtagtacgtaacgttacgtcgtacggtaactaacgggtagttaacgttacgttaacttacgttaactttacgtacgtacgaacgtaaagttaagtaacgtttataaccgggttttaacggtccggaaacgtcgtaaacgtaaccgaacttaaaccgtaaagtaccgtgtcgtatccgacacgtacctnttccgttactcctacgtaccgttcccacgtacttncgttntaccg

SEQ ID NO: 139946 - DNA, 715 bp, Homo sapiens
  misc_feature: GYAE6OF01B27L7.46.67.G01.1.454.CMB.1.raw
  modified_base (224)..(224): a, c, t, g, unknown or other
  misc_feature (224)..(224): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgacgtggtgacggtccttcggacgtaccctcgtcccctcacctgccgcttgtcctcgtggtcnccctccatctaggttagttggttttccttcggtcggggtctcggggaccggcacggccgtaccggaggggacgggcgtaggaactacagttaggagtgtctctacagtggtaggtcgttacttagtactcgtcgtctctacgagtgtcgagtccacgtatactctcgtagacctacgtaccacgactaacttccttacgttttacccaggtaaatagtcgttacgttcgtcgtaccgtcccgcgtcgtacggaccggttacgggtttactttacgtacgttggtacggcggtaacgtacggtacgttacgttagttacgtttgtttaacggttttagggtaggttttacgtttacgttaccgtaacccgttaccggtaaggtaccggtacgggtaccgggtcccgtaccgggtcccgggtacgggacggtaacggtaccggttaccgtcggtaccctacgttcccgttaccgtccgtccccgtaaccccgg

SEQ ID NO: 139947 - DNA, 589 bp, Homo sapiens
  misc_feature: GYAE6OF01ES3K7.46.67.G01.1.454.CMB.1.raw
  modified_base (98)..(98): a, c, t, g, unknown or other
  misc_feature (98)..(98): n is a, c, g, or t
  modified_base (198)..(198): a, c, t, g, unknown or other
  misc_feature (198)..(198): n is a, c, g, or t
  modified_base (224)..(224): a, c, t, g, unknown or other
  misc_feature (224)..(224): n is a, c, g, or t
  modified_base (303)..(303): a, c, t, g, unknown or other
  misc_feature (303)..(303): n is a, c, g, or t
  modified_base (341)..(341): a, c, t, g, unknown or other
  misc_feature (341)..(341): n is a, c, g, or t
  modified_base (404)..(404): a, c, t, g, unknown or other
  misc_feature (404)..(404): n is a, c, g, or t
  modified_base (415)..(415): a, c, t, g, unknown or other
  misc_feature (415)..(415): n is a, c, g, or t
  modified_base (542)..(542): a, c, t, g, unknown or other
  misc_feature (542)..(542): n is a, c, g, or t
tcagactagcagtacacgaccggtgctcgatttagagtatacatattggggtttgggggacgtctcggtcaggacacagcatggacatgagggtcccnctcagctcctggggctcctgctactctggctccgaggtgccagatgtagacatcgagctgacccagtctccatccctcctgtctagacaaccggtggganacaggtcgcaccatcacttgccgggnaagtcggaacattgaacacctttatttaaagtggtatcaactatagaccagggtacgccctaagcctacctaagtctangctgactacgtctaggtttgactaaggtgggaccagtntaggttcagttgactagtcggattcgtagggactagtacttacgactctacacagtcaagtanctagacaacgngtaatatttagactaacgttacttactgtaacgataacaagttaacagttacggttacgaccgtaaggactaacggtaactaacgtaaactaacgtacgtagtcggcttacggactaacctacggtnttacggtcttacctacttacccgttacccactacttacgtgtaaacg

SEQ ID NO: 139948 - DNA, 663 bp, Homo sapiens
  misc_feature: GYAE6OF01BWGDQ.46.67.G01.1.454.CMB.1.raw
  modified_base (151)..(151): a, c, t, g, unknown or other
  misc_feature (151)..(151): n is a, c, g, or t
  modified_base (227)..(227): a, c, t, g, unknown or other
  misc_feature (227)..(227): n is a, c, g, or t
tcagactagcagtacacgaccggtgctcgatttagagtatacatattgggtttggggagtctcggtcaggacacagcatggacatgagggtccccgctcagctcctgggctcctgctactctggctccgaggtgccagatgtgacatcganctgacccagtctcactcctccctgtctgccaacggtgggacacagtgtcaccatcacgttgaccggcaagtcgaanttcgactacttaatttaagtgtactacaactatacgaccgacggaccgaccctaagtcctacctaatctatcgctgctacgtccgtagtttcgacgtaacggtcggtacccagtcggtagttcgaggtgactaggtgagttcgagggactagtacttacactcgtaccgtaacctacttacgtaagttactcgtacgtaacgtaacggttaagtaacgttatttacgaaccttaaattacgttacgtactaacgtaaacgtaagttaaactttacgttaacgtttcggtttaacccggaacggtaaacgggtacctaaacgtaacttaaaccgtaaattaaccggacgttgtaccggtactacgtacctacgttacgttacgttcgttacctacgtacccttccgttacccgtactaccgtttccgacgttaaccg

SEQ ID NO: 139949 - DNA, 757 bp, Homo sapiens
  misc_feature: GYAE6OF01BYWX2.46.67.G01.1.454.CMB.1.raw
  modified_base (276)..(276): a, c, t, g, unknown or other
  misc_feature (276)..(276): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttgggagacccctgtccctcacctgcgctgtctctggtcgccctcatcagttagttgtttcttcgtggggctaggggccggcacgccgtaccggagggggaacggggtctaggaattacgagttgggtaagtcgttctactanagtaggtggtacggtttaccttaattacgtacgttcccgttactctaccgaaaggtacggtacggataccaacccgtagttaacttccgttcgtacggacctacccgtacgagaacctaagtcctttacgttttccccgtaagtaaacgtgtaggtaactttcgtggtccggtaacccggcgtacgtacggtaacggtaccgggtttaatttaccttggttacggtgggtacggtagaacgggtaccgtacgttaatttagtaggtttattttcggggtaaggttttcgtttaacttaccggtacctaaaccgttaggtaccggttacgggggtaacccgggtcgtacccggtacccgggttcgggacgaagggttaacctcggttacgtccggtaccttcgtacccgtactccccgacgaaccgaccggtacctacgtccgttcccctcccgtacggcccttacccgcaccgatccggcg

SEQ ID NO: 139950 - DNA, 660 bp, Homo sapiens
  misc_feature: GYAE6OF01CSX7Z.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctggggtccggcacgctcccgaaggggaacggggctaggaatacagttgggaagtgtctctcagtagtggaggttcctattacagtccgtctctcaagagtcgagtcacatatctcgtggacacgtccagactaatctacgttttcccaggaatagtggtagtttctgtacgacccgccgtctggaaccgtacggggttcttttaacttacgtggttcggcggaaggacggtacggtacttaagtttacttaggtttagtttttgggaaggtttggtttaattccggtaactacccgtagtacgtcgggacggggtcctaccggaccccggtcggggaccggaagggtaacgttacgtcggtaccgtaccgtctccgttacgtccctacgtacccgacgggtcccacggttccggttcccttccccgcgtaccctaccctccgtacccaagccgtacccg

SEQ ID NO: 139951 - DNA, 997 bp, Homo sapiens
  misc_feature: GYAE6OF01DWVB5.46.67.G01.1.454.CMB.1.raw
tcagactagcagtacacgaccggtgctcgatttagagtatacatattgggtttgtcctcctgctggtggcagctcccagatgggtcctgtccctggtgcaactgcgaggacgtccgggcccacgacgtggtgacggtccgttcgggacgaccctcgtcccctcaccgtgcgtctgtctcgtggtcgcctaccatcgagttagttgtttcttggtgggcgtcgggtccgcacgccgtaccggaggggacgggctaggaactacgtagttaggaagttcgtcctcgtacgtaagtaggtacggtacggtttaccttaagttaccgtaccgttcccgttcttaccgtaaggtaacggtacggttaccggtacgtaccgaacctagttaccgttactcgtaccggtaacccgtaccgtaccgtaacgtaacctaaccttacggtttaccgttttacccgaacgtaagtacggttacgttacggttaccggttacggtccccggtaacccggtaccgttaccgtaccggtaaacggtttacccggggttttacgttttaaccgttacggtacggtaccggaacgggtaacgggtaccgtaacggtttacttaaagttttcgggtttaaggttttaagggtttaggtttcggttttaacggttttaaccgttacccggtaaacccccgttaaccggttaggtccccggggttaacccgggggtacccggggttacccgtacccccggggttaccccgggggttacgggaacccgggttaaacggggtttaaaccgtcccgggttacccggttaccccgttacccggtttacccgttaacccgggttacccaccccggttaacccccggtaaccgggtaacccggggttaccccctttacccgggggttacccccttcccccggttacccccggaccccgttaaacccccgttccccccgttaaaacccggtacccgtaaaccgggtccccttaacccccgggg

SEQ ID NO: 139952 - DNA, 741 bp, Homo sapiens
  misc_feature: GYAE6OF01B0UAC.46.67.G01.1.454.CMB.1.raw
  modified_base (139)..(139): a, c, t, g, unknown or other
  misc_feature (139)..(139): n is a, c, g, or t
  modified_base (165)..(165): a, c, t, g, unknown or other
  misc_feature (165)..(165): n is a, c, g, or t
  modified_base (727)..(727): a, c, t, g, unknown or other
  misc_feature (727)..(727): n is a, c, g, or t
  modified_base (735)..(735): a, c, t, g, unknown or other
  misc_feature (735)..(735): n is a, c, g, or t
tcagactagcagtacacgaccggtgctcgatttagagtatacatattgggtttggggagtctcggtcaggacacagcatggacatgagggtccccgctcagctcctggggctcctgctactctggctccgagtgccagntgtgacatcgagctcgaccctagtcncctactcctcctgtctgacaaccggtggacgacagtgtaccaccatccacgttcggaccgggactaaacggtccggaaactagttacgaccttaaccttaagttttaaagttgtactacaactagtacgaccggtacgggaccgtacccgtaagccttaacttaagtctagtcgtcctcgtactacttccgtaggtttacgaacgtaagggttccgggtacctacggttcggtagttacagggtcgtacggtaggttcgacgttcggtcggggtaaactcggttactttacccgaacgtttcccgtaacaacccttaacggttacgttaaacgttaacgttccgttaaccgtaaccggttaaacggtaacggttaaacgtttacgtttaccgttaaacgttttaaactttaacgtttaccgttaagtaaccgtaaattacgttaaactttacgtaacgttttcggtaaccggaccggtaaacggtacctaacgtaacgtaaactaagtaactacgtgtagcctacgactcgtcgtacttcgtcttacgtccttcgtaccctntcgttacngttacg

SEQ ID NO: 139953 - DNA, 580 bp, Homo sapiens
  misc_feature: GYAE6OF01B6GMT.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggaccatgagggtccccgctcagctcctggggctcctgctactctggctccgaggtgccagatgtgacatcgagctgacccagtctccatcctccctgtctgcaaccgtgggagcagtgtcaccatcacttgccgggnaagtcggaacattgacactatttaaatgtatcgaacatagaccagggaccgccctaagctcctaatctatgctgcatcctagtttgacaaagtcgggtcccagtcgaggttcagtggcaggtggatcgtgggacagtattcactctacacatcgaagttatctgacaagtagaagtatttagactaactttattactagtactaaacgtaagttaaactttactaagttcggttttaccggaccgtaaagggtacctaacgtaactaacgtaaagttaaaccgtaacgtagtacggtacctagacctaacctagttaccttgttccttacacgtttccttccccgactcgtacgttcgtaacg

SEQ ID NO: 139954 - DNA, 732 bp, Homo sapiens
  misc_feature: GYAE6OF01ENXM8.46.67.G01.1.454.CMB.1.raw
  modified_base (172)..(172): a, c, t, g, unknown or other
  misc_feature (172)..(172): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcncctccatcagtagtggtttctcgtgggctgggtccgcagcctccgaggggaggggctaggaatacagttggaagtgtctctcagtaggtggtaggttcctaattacacggttccgtctactacaagtacgtcgagtacaccatatctcgtgacaccgtcagactaatctacgttttcccagaagtagtgtagttctggtcgaccgccgcgtacgaccgtacgggtactttagttacgtgtacggacgaggtaacgtaccggtacttatttacgttagttagtttttagggtagtttaggtttacggtttaccgtaaccgtaacccgttaggtacggtacgggtaccggggggtacctacccgggaccccgggtacggggaccgtaaggggtaacttaccggttcgggttacccgtaacccgtttccttacccgttaccgccccgtacccgtaacccggtaaacccgggtccccgtacggttccccgggttacccccgttccccccggtacggtaccccctacccccttaccccgaacccgtaaccgaccggtacccccgg

SEQ ID NO: 139955 - DNA, 590 bp, Homo sapiens
  misc_feature: GYAE6OF01AJ84Y.46.67.G01.1.454.CMB.1.raw
  modified_base (191)..(191): a, c, t, g, unknown or other
  misc_feature (191)..(191): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtggganacagtgtcaccatcacttcgcggcaagtcggaacattgacacttattaattgtatcaacatagacagggaccgccctaagctcctaatctatgctgcatccagtttgactaacggtcgggtcccagtcgtaggttcgaggtcggctaggtggtactcgtagggactaggtatttcacgtctccgacactcaagtactcagcgtaaacgtgtaaagttagtttcggacttaaacctttattactcgtaactaactaagttaacttaactacgtttagtttaccggaacgtaacggtaactaccggtaacttaacgtaaaacgttaaccgaagttcggtagtaccttagacctacctagttctcttccttacacttccctacccgtactactcgtataacg

SEQ ID NO: 139956 - DNA, 619 bp, Homo sapiens
  misc_feature: GYAE6OF01BYD7M.46.67.G01.1.454.CMB.1.raw
  modified_base (217)..(217): a, c, t, g, unknown or other
  misc_feature (217)..(217): n is a, c, g, or t
  modified_base (404)..(404): a, c, t, g, unknown or other
  misc_feature (404)..(404): n is a, c, g, or t
  modified_base (481)..(481): a, c, t, g, unknown or other
  misc_feature (481)..(481): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgactggtgacggccttcggacgaccctgtcccctcacctgcgctgtctcgtggtcncctcatcagtgttggtttcttcgtggggctgggtccgcagcctccggagggaagggctaggaatacagttggaagtgtctctacagtaggtggacggttcctattacagtccgtctctacagacgtcgagtccaacattactctcgtgactaccgtccagactaactctacgttttcccagaacgtntagtacgtttctacggtacgacccgtccgtctacgacgtacgggttactttacttcgtgtcggcgtaggagtacgtnttagttgtgtttagtttgggagtttggttattccgacgtaccgtagtcgtacgggaccggtccgtcccggacccggtgggaccgtaacgggtaacgtcggtacgtccttaccgtcgttaccgttcgccccgtacccgg

SEQ ID NO: 139957 - DNA, 893 bp, Homo sapiens
  misc_feature: GYAE6OF01B9N7E.46.67.G01.1.454.CMB.1.raw
tcagactagcagtacacgaccggtgctcgatttagagtatacatattgggtttggggagtctcggtcaggacacagcatggacatggacgggtccccgctcagcctccgtggggctcctgctactcgtggctcggaggtgccagtatgtgacagtcgatcctacgaccctagttcctacctacttcccctccgttgtctacggaccgtaaccgggtgggaacgacgtagtctacctaacctacgtaccgtacgttcgggacccgggtacgtaaggtaccggtaacttagttaccgtaaccttaacgtttaaacgttttaaaggttcggtaaacttaaccgaaactaacgggtaacggaacccggaacggggtaccccgttaaccctaacggtaccttaaccttaattcgtaacgtcgtctacgtactacgtacgtacgttagaacgtacgggtccgtacgtacgtacggtacgtacgtggtacggaacgtagggtacggttacgtaggtaacggaacgttaacggttacctttaacccctagttaccttaaccgtaaacgtaacgttaacggttaacttaacggtacgtacgtaaacggttaaccggttaaagttaagttttaccgtttaacaaaaccgtttttacgttaactttaacgttaaccggtaaacctttaaaggtaacctttaaacgtttaaccggtttaaacggtttaccggttaaacccgggtaaaccggaaccggttaaacctaaaccgtaaacttaaaaccggttaaaccttaacggtaacgtaggtcccgtaaactacctaaccgtaacttacgttactttccgttaacccgtacttacccgtttaccctacccgaatttaaccctgttaaccgttaaccg

SEQ ID NO: 139958 - DNA, 1020 bp, Homo sapiens
  misc_feature: GYAE6OF01EK98Y.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagcctcccagatgggtcctgtccctggtgcaactgcgaggacgtccgggcccacgacgtgggtgacggtcccttcggacgaccccgtcgtccctcacctgccgtctgtcctcgtggtccgcccttccgatcgtagttaggttgttttcctcggtcggggtccgttcggggtcccgcgacggtcccgtacccggagggggtaacgggctagggtaactacgtagttacgggtaagttcgttacctctaccgtaaggttacgggttacgggttaccggtttacccgtttaacgtttaccggtaccggtttcccggttaccgttaccgtaccggtaaaagggtacgttaccggtacgttaccccaacctacttaccttccgttaccggtacggtaaccccgtaccggtaccccgaaggtaaccttaaccgtttccgtttaacccggtttttaccccgtaaggtaaacgtttacggttcgggtttaaccggtttaccggttccgggtaacccggtaccccggtccggtacgtaccgggtaaccggtaccgggtttactttttaacgttacgttcggtacgggtaccggtaacggtaaccgggtcggtttaacgtttacgttttaacggttggtttttaacggtttttacggggtaacggttttttaccggtttaaccggtttaaccccgtaacccggtttaacccggttacggggttaacccgggtacccgggggttaccccgggggttacccccgtttacccccggggtaacccccgggggttaccggggggtaaccccggttaaacgggggtaaacccctttccggggtaaccccggtttacccccggttaaccccggtttaccccgtttaaccccgggtttaacccccgacccccggttaaaccccccggg

SEQ ID NO: 139959 - DNA, 734 bp, Homo sapiens
  misc_feature: GYAE6OF01EYTFT.46.67.G01.1.454.CMB.1.raw
tcagactagcagtacacgaccggtgctcgatttagagtatacatattgggtttgggggagtctcggtcaggacacagcatggacatgagggtccccgctcagctcctgggggctcctgctactctggctccgaggtgccagatgtgacatcgagctcgacccagtctccatcctccctgtctgcaaccggtgggagacagtgtcacactcacttcggccgggacaacgtcggaacattagacctacttatttaaagtgtatacaacatacgacgagggaccgaccctaagcctacctaatactatcgctgcctagttaccgtaggtttcaacggtaaaggtccggggtacccagttaccggtaggttactaagggtggtcgaaggttcggaattccgtaggggaacctaaggttaccttttccaaccttccgttaccaactaacgttacgtaaggttaacttccgtacgacgaaacggttaagtaaacgtttagttttacgtaacttaaacgtttaatttacgttacgtaaacctaaataacgttaaatttaacttaacgttaggtttaaccgggtaaccggtaaacgggaaccgtaaccggtaaaccttaaactaaaaacgttaaaccggtaaacgtagggtacgtacgtaaccgtactaacccgttatacctttacggttaccttacctaacctttccccgttacccgtacccttacttcccgagttaaccg

SEQ ID NO: 139960 - DNA, 785 bp, Homo sapiens
  misc_feature: GYAE6OF01BN9J2.46.67.G01.1.454.CMB.1.raw
tcagactagcagtacacgaccggtgctcgatttagagtatacatattgggtttggggagtctcggtcaggacacagcatggacatgagggtccccgctcagctccgtggggctcctgctactctggctccggaggtgccagatgtgacatcgagctgacccagtctccatcctcctgtctgacgaacggtgggagacagtcgtaccaccagtctacgttcggaccgggtacaacggtacggaactagttacgacctaacttaatttaaagtggtactacaacagtacgaaccgacgggtaccgtaccctaagtctacctaatctatcgtctagactactaccgtagttcgacgtaacggtcgggtacctagtacggtaggttacgagtaggacgtaggtacggtacgtcggtaggacccgtaagttactttaccacgttcctaacctaaccgtattaaccgtaaagttaacgtcgtaacgtaacgtaacgttaagttaaagtttaacgtttaacggttaaacctttacgtttaaccgtaggttaaaccctaaagtaacgttaaacgtttaaaccgttaagttttaccgggtttaacggaacccgggtaaacggtaaccgtaaacgtaaaccttaaaaaccggttaaaacgttaaaccggtaacggttaacggtacgtaaccgtacggtaacccctaaagttaccgtttacgtaccgttttacccttaccgttaccgttaccccgtttacccccggattaccgttaacttacgtaccgttaaacgg

SEQ ID NO: 139961 - DNA, 1078 bp, Homo sapiens
  misc_feature: GYAE6OF01BHZRY.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctcgtggtcgcctccatcagtaggttgtttcttcgtgggtcgtcgggtcccggcagccgtcccggaagggggaagggtctaggtaactacgtaggtttagggaagttcgtcttcctactagttagggtaggtacggtttaccttaacgttaacctaccggttcccgttcgttccgttaacgtaaagggtacggttaccggtaaccgtaccaaccgtaacgtttacttcccgttcgtacgggtaacctaccgtaccgacggacctaaactttccgtttaaccgttttccccgtaggtaaaacgttagttcggttaacgtttcgtacgggtacccggtaaccccggtccggtaccggtaccgggtacccgggttaaccggggttttacgtttttaaaccgtttcggttacgggtcggtaacgggaaggttaacgggtacccgttaagtttaacgtttaggttacggtttttaggtttttaggggtacggttttacgggtttttaccttacccggtaaacccgttaccgggtttaaacgtcccgggggtttacccgggggtaaccccgggggtttcccgtacccccggggttaacccccggggggttcggggggtaaaaccccgggttaacgggggtttaaaccggttacccgggttaccccgggtttaccccggtaacccccggtttttccccccgtttaccggtttaaaccccggaccccccgttttaaaccccgggaaacccccggggtacccccgggggtttaacccccttaaccccggggtttttaccccccccgggttcccccccgttttccccccccgggtaaccccggggttaccccccccctttaaacccccccgttccccccgttaaaccccggaaaccccgggggttaaacccgttcccccccgggg

SEQ ID NO: 139962 - DNA, 705 bp, Homo sapiens
  misc_feature: GYAE6OF01CZYTR.46.67.G01.1.454.CMB.1.raw
tcagactagcagtacacgaccggtgctcgatttagagtatacatattgggtttggggagtctcggtcaggacacagcatggacatggagggtccccgctcagctccgtggggctcctgctactctggctccggaggtgccagatgtgacatcgagctgacccagtctccatccctccctgtcctgccgaaccggtgggacactagtcgtacaccatccaccgttggcccggggacaaggtccggaacattgacctaccttaatttaaatggtaatcaacatagaccgaagggaccggccctaagctactaatctatgctgactactcctaagtttgaacgtaagggtcgggtaccctagtcgaggttcaaggttgcgtaggtggtactcggtgggaactaggtactttcgactcttaccacctataccgtaagttaacttcgtacgtaacgtaacgttaggaaacgttattttacgactttaaacttaatttacgttaagtaaacctaaactaacgtttaaactttaacctaaacggttttcgttttaacccggaaccggtaaacgggtaacctaacgtaaaacgtttaaaaccaaaacgtttaaaccgtaaattgggtaaccgtctaacggacctacggtacttcccggttgtttacccttacttacgttaccccttacccgtaccttaacgtcttaggtaacc

SEQ ID NO: 139963 - DNA, 970 bp, Homo sapiens
  misc_feature: GYAE6OF01BM7VJ.46.67.G01.1.454.CMB.1.raw
  modified_base (186)..(186): a, c, t, g, unknown or other
  misc_feature (186)..(186): n is a, c, g, or t
tcagactagcagtacacgaccggtgctcgatttagagtatacatattgggtttgtcctcctgctggtggcagctcccagatgggtcctgtccctggtgcaactgcaggacgtccgggcccacgactggtgacggcccttcgggacgacccttcgtcccctcaccgtgccgtctcgtctcgtggtcncctcatctagttgttcggtttctcggtcggggtctcggggtccgacacgtccgtaccggaaggggacgggctaggtaactacgtagttaggattcgtcctctagagttggtaggtacgttccttagttacgtacgttccgtctacgtaacgaaggtcgtacgtactaccgaccttaattacttccgtaccgtacggaacctaccgtaccgaacgtactaacgttcctttaccggttttaaccgaaggtaacgtacgttaggtacgtttcgtacggtacccgtacccggcgtaccgtacggtaaccgggttaccggtttacgttttaacgtccggtacggtcggtaaccggaaggtaccggtaaccgtttagttaagtttggtttacggttttaaggttttacgggtacggttttaaccggttttagttaaccccgtaaaccggttacccgttaagggtaccgggtaccccggggttaaccggggtaccccttacccgggggtaaccccggggttacgggaaccgggttaacgggggtaccttttacccgggttaccgttacccccgttacccgggttttaccccttaccccggtaaccccggtacccccgtttaaacccccgggaacccggggttaaccccggtttacccccggtaaccccgggtttttccccccggggttaccccccccgttttaccccccggtaaccgggtaccccccccctttaacccccggttaacccccggttaaacccgtacggggacccccgtttaaccccccgggg

SEQ ID NO: 139964 - DNA, 673 bp, Homo sapiens
  misc_feature: GYAE6OF01CYO45.46.67.G01.1.454.CMB.1.raw
  modified_base (210)..(210): a, c, t, g, unknown or other
  misc_feature (210)..(210): n is a, c, g, or t
  modified_base (230)..(230): a, c, t, g, unknown or other
  misc_feature (230)..(230): n is a, c, g, or t
  modified_base (273)..(273): a, c, t, g, unknown or other
  misc_feature (273)..(273): n is a, c, g, or t
  modified_base (317)..(317): a, c, t, g, unknown or other
  misc_feature (317)..(317): n is a, c, g, or t
  modified_base (352)..(352): a, c, t, g, unknown or other
  misc_feature (352)..(352): n is a, c, g, or t
tcagactagcagtacacgaccggtgctcgatttagagtatacatattgggtttggggagtctcggtcaggacacagcatggacatgagggtccccgctcagctccgtggggctcctgctactctggctccggaggtgccagatgtgacatcgagctcggaccctagtcctccactccctccctgtctggacgaacggtggagacaggtcncacatcacttcggaccgganaagtacgaactattagaactacttaattaagtagtacactaanagtaacgacgacgggaccgacctagtctacctagtctagcgctnctactccgtagttacgacgaaacgggttcggaccngttacggacgttcgagtcggagtaggtagactggtaggaactacgtactttccgatccctaacgtaacctacgtacgtaaagtactacgtacgtacgaacgttaagtaacgtttagtttaacacgtttaaacttagttaccgtactaactaaacgttaagtaactttaacggtatttacgggttttaaaccggacgtaaacgggtaaccgtaactaaaccgttaaaacttaaacggtaaacgtaccgtaaggttccgaacgtacgactaacctacgtcttacgtaccttacgtacgttccctaacgctactagtacgtacg

SEQ ID NO: 139965 - DNA, 1055 bp, Homo sapiens
  misc_feature: GYAE6OF01BALJP.46.67.G01.1.454.CMB.1.raw
  modified_base (96)..(96): a, c, t, g, unknown or other
  misc_feature (96)..(96): n is a, c, g, or t
  modified_base (189)..(189): a, c, t, g, unknown or other
  misc_feature (189)..(189): n is a, c, g, or t
tcagactagcagtacacgaccggtgctcgatttagagtatacatattgggtttggggagtctcggtcaggacacagcatggacatgagggtcccgntcagctcctgggctcctgctactctggctccgaggtgccaggatgtgacatcgagctgacccagtctccatcctcctgtctgcaacggtgganacagtcgtcactatccgtacttcggccgggtacaaggttccggaactagtttcggaaccttaaccgtttaagttttaaaacgttcggttaacttaccgaaaccgtagttaacggtaaccccgtacgggggtaacccggttaccccgttaaaaggtcccgttaacccgttaaaacgtttcccgttaagtttccggtaccgtttacgggtacccttaacgtttaccccggttaacggtttttaccggtaaccggttaaaaacggggtttcccggggggttaaacccccttaagggtttacccgggttaacgggttttacccggaacgggtttaccgggtaaccggtttaacggttaacggggtaaccgtttaccgggtaacgggggttaaaccgtaaacggtttaacccgtttttaccggaacccgtttaacctttaacccggtaacccttaacgttaccggttaaacggtttacccgttacgttaaccgggtaaccgttaaaccgggttaaggttaaacggtttaacctttttaccgggaaacttttaaaacccgttttacgtttaacccgttaaggttaaacccttaaaccggttaaagtttaaaccgttaaccgtttaacggttttaccgggtttttaacccgggaaacccggttaaaccgggtaaacccggttaaccgttaaaacccgttaaaccggttaaaaaccggtttaaccgggtaaaaccgttcggggttaaccgggtaccttaccgggaaccctttaaacccggtaaggtttcccggttaactttaccccgtttagtaaccccgggttttacccctacccggttaacccttacgtttaacccgttacggttaaacccg

SEQ ID NO: 139966 - DNA, 877 bp, Homo sapiens
  misc_feature: GYAE6OF01DZRDH.46.67.G01.1.454.CMB.1.raw
  modified_base (201)..(201): a, c, t, g, unknown or other
  misc_feature (201)..(201): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctcgacccagtcctccactccctccctgtctcgacgaaccggtggganacgagtcgtaccaccatctacgttcggcccgggactaaggtccggaactgttacgaccttaactttaattttaaagttcggtataaccaaactaagttaacggaacccgacggggaacccgtaccctaaagcccttacctaactctacgtcgcgtcgacttactccgttaggtttacgaacggtaaacgggttcgggtaacccctaggttacggtacggttacggaggtacgggtcgtaagggtggtacttacggtagggtaacgtacgtttaacgttcccgtacctaccggttaacccaaccgtaactttaaccgtaagtttaccctagggttaaccgaacccggttaaaggtttacggtaaaacggttttcttttacggtaaacctttaaacgttttacttaaccgttaacgtaaaccttaaacgtttaagttaaaaccttttaacggtaaggttttttacgggttaacccccggaaacgggttaaaccggtaaaaccgtaacccggtttaaaaaccgttaaaaccgtttaaaaacggtttaaaccggtacgggttaccgtacggtaacccgttagtaaacccgtaaaccgtttcgttaccgtttacgttacccttacccgtttaaccgttacccccgttcccggtaaccttaccggttatcccggttaaccgg

SEQ ID NO: 139967 - DNA, 909 bp, Homo sapiens
  misc_feature: GYAE6OF01E4UAX.46.67.G01.1.454.CMB.1.raw
tcagactagcagtacacgaccggtgctcgatttagagtatacatattgggtttggggagtctcggtcaggacacagcatggacatgagggtccccgctcagctccgtggggctcctgctactctggctcgaggtcgccagatgtgacatcgacgctacgacccgagtcctaccacttccctcctgtctacggaccgtaacggtagggacgacgtacggtcgaccacctactacctacgttcgggtaccgggacctaaacgggtaccggtaaccttacgttacggtaaccctttaaccgtttaagtttttaaagttacggttactaaccgaaacgtaacggtaacggtaacccggaacgggggtaaccccgacccgttaaacgtacccttaacccgtaaacgttccgttaacggtcgtaccgtacgtacctaaccgtttaccggttaacggtttacggtaacccgggttaaacggggtttacccggggtaccccgttaagggtttaccgggttaacgggtaccgggttaaggttccggggtacgtaacgggtacggtaacggttccggggtaacggtaaccggttaaggttaccgtttaccgtaccgttccctaaccggttaaccaacggttaacccgttaaggtaactaccgtacgtaaccgtaacggttaacgttaacggtttacgtttaccttaacgttaaccttttaccgttaagttaccgaaataaccttaagtaacttttacggtaacgttttacgtaccggtaacggttacccgtaacgtaaccgttaaacgaaacgttaaccgggttaacgtcgtaggtcgtacctcgaacccgttacttaccgtgttccttacccggttacttaccgttacccctacgtaccttaactcggttacgtaacc

SEQ ID NO: 139968 - DNA, 1010 bp, Homo sapiens
  misc_feature: GYAE6OF01DFU4Z.46.67.G01.1.454.CMB.1.raw
  modified_base (216)..(216): a, c, t, g, unknown or other
  misc_feature (216)..(216): n is a, c, g, or t
tcagactagcagtacacgaccggtgctcgatttagagtatacatattgggtttgggggacctctgtgcaagaacatgaagcacctgtggtttgtcctcctgctggtggccagcctcccgagagtcgggtcctcgttcccgtggtgacaactgacgaggacggtccgggcccgacgtacgtgggtagacggtccttcggacgtacccgttcgtcccnccaccgtgccgcttcgtctcgtcggtctccctacgtactacgtaggtttacggtttcggtttttccgttcggtcgggggtccggtttccgggggtacccggacgtaccggtacccggtaccccggggaaaaggggggtacgggtaccggtaaggtaaaacgttaacgttaggtttacgggtaaacgtttgttacccgtttacgtacgtaacggttacggggtttacggggtttaaacccgttttcctttaacgttaccggttacccggttaccccggtttcccgtttaaccgtaaccgggtaaaaggttaccggtttaacccgggaaccgttaacccctaaccgtttaacttaccgttcccgttacggtaacccgggttaaacccgtaccccgtaaccgaaccgttaccgttaacctttaccgttttcccgttttacccgaagtaaacgttacgtcggtttacgtttcgtccggtaccgaccccggtccggaccgtacggttaacccggtttacgggtttacctttacggtaccgttcgggtacgtaacgggagttaacgggtacctttacgttaagtttcgtttaaggtttacggtttacggttacgtttacggttttaccttaaccgtcccgttaacggaaggttacccgggtacccggggacccggggttacccgtaaccccgggtaccccgggggtacggaaccggttaaaaggtacccgttcggggttaccttaaaccccggtttcccggtcccttttaaaccggtccccgtaccccggttaaccccgg

SEQ ID NO: 139969 - DNA, 673 bp, Homo sapiens
  misc_feature: GYAE6OF01CT1NB.46.67.G01.1.454.CMB.1.raw
  modified_base (136)..(136): a, c, t, g, unknown or other
  misc_feature (136)..(136): n is a, c, g, or t
  modified_base (210)..(210): a, c, t, g, unknown or other
  misc_feature (210)..(210): n is a, c, g, or t
  modified_base (488)..(488): a, c, t, g, unknown or other
  misc_feature (488)..(488): n is a, c, g, or t
tcagactagcagtacacgaccggtgctcgatttagagtatacatagttgggtttggggagtctcggtcaggacacagcagtggacatggacgggtccccgctcagctccgtggggcctcgtgctactcgtggaccnccggtaggtgccaggtatggtgacatcgagctcgaccctagtcctccactccgtcctgtcgcggacgtaccggnggacagacgttcaccacgtatcgtagttccggacggacgtaaggtacgtacaacgttcgacttaacgttaattaagttcgtactaacaagtacgacgaccggtaacgggacccggtacctaagtacctaccttaatacttctacggcgttacgactcggttacttacgtagtaccgtaaacgggtcgggtacctagttaccgggagtttacggaggggttcctaaacggtagttacgggttacgtacggacgaacgtttacgtaacttttccggaacncctttaacgactaatcgtaagtactacggacgtagtacggaacgttattaacgttactacttactacgtaattacacctaataagtatacgttagttacgtaaccgacgtagacgtaacaactaactaagacgtaatcggatcatcgattcagtcttcacttctaccctactggtcttgagttcg

SEQ ID NO: 139970 - DNA, 672 bp, Homo sapiens
  misc_feature: GYAE6OF01CAS2X.46.67.G01.1.454.CMB.1.raw
  modified_base (201)..(201): a, c, t, g, unknown or other
  misc_feature (201)..(201): n is a, c, g, or t
  modified_base (233)..(233): a, c, t, g, unknown or other
  misc_feature (233)..(233): n is a, c, g, or t
tcagactagcagtacacgaccggtgctcgatttagagtatacatattgggtttggggagtctcggtcaggacacagcatggacatgagggtccccgctcagctccgtggggctcctgctactctggctcggaggtgccagatgtgacatcgagctcgacccagtcctccatccctccctgtcctagccgaaccggtggganacagtgccacatcctacgttcggaccgggtanaacggtacggaactattcggaacctaacgtttaattttaaacgttggtactacaaacagtaacggaccgacggggacccgtaccccgaagtccttacctaatctaacgtgaccttgacctacgtcctaggtttagaccgtaaacgggtcgggtaccctagtcggtaggttacacgggtgacgtagcggtatcggtaggacagtattaccacttcgctacagtcgaatactcagacgtagtgtaacgttatttacaacgttatttactacgtacgtaataacgtaataacgttagttaacgttcggtttaccgaacggtaaccgtaacgtacgttaaactaaacgttaaacgtaaacgtacgtaggtagtaccgtacgacgtaccgtatacgttaccgttcttaccgtaccttacctacccgtactactctagttaaccg

SEQ ID NO: 139971 - DNA, 784 bp, Homo sapiens
  misc_feature: GYAE6OF01CJ0NM.46.67.G01.1.454.CMB.1.raw
  modified_base (234)..(234): a, c, t, g, unknown or other
  misc_feature (234)..(234): n is a, c, g, or t
  modified_base (326)..(326): a, c, t, g, unknown or other
  misc_feature (326)..(326): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagaccctcgtccctcacctgcgctgtctctggtcgcctccatcagtagtggtttcttcgtgggcgtgggtccgcacgcgtcccgaggggacgggngtaggaatacagttggaagtgtctctctagtaggtggtacgttcctatacgacgttccgtctctacgaagacgtcgagtccaccatacttcncgtacggactaccgtaccgacgtacctaacttcttaccgttttccgtaagtaacgtagttacggtacgttcgtcggtccgaacccggtccgtacgtcggtaaccggttaccgggtttacgttttaaacgttcgttaggtacggacggaacgtacgggacgttacttagtttagttagtttagttttagggtagtttacggtttacttacgaacccttaccggtaagcggttccggggaccgggtacccgtaccgggtccccggtacggggtaccgtaagggtaccttaccggtcggtaccctaccgttacccgttccggtacccgtaccccgtaacccgacccgggtaaacccgggtccccgttaacccggttcccggtttacccccctttacccccgggcccgttacccccgttacccccttaccccggtacccgaaacggtccccggtaaccccgg

SEQ ID NO: 139972 - DNA, 782 bp, Homo sapiens
  misc_feature: GYAE6OF01B0VCI.46.67.G01.1.454.CMB.1.raw
tcagactagcagtacacgaccggtgctcgatttagagtatacatattggggtttggggagtctcggtcaggacacagcatggacatgagggtccccgctcagctcctggggctcctgctactctggctccgaggtgccagatgtgacatcgagctgacccagtcctccactccctccctgtctgccgaaccggtgggagactaggtcgtcaccactccgacgttcggcccgggactaacggtacggaactattgaacctacctttaattttaaattggttatacaactatacgaccgaggggaccggccctaagtcctacctaatctatgctgctaactcctaggtttacgacgtaaacgggttcggggtaccctaacgttacggtacggtttcgtaaggttcggggaccgtagggtacggtactacgggtacgggtaactaacggtacttttcaacgtttccctaactaacccgtaattacgtaacgtttaactccgtacggtaaccgtaaggttaacggtatttaacggttttcaaacttaactttactttaaccgtgttaaaccaacgttaaatacttaacgtaacgttttgggttaaccgaaccgtaacgggtaacctaccgtaaaaccgttaaataaaaccgttaaacgttaccggtagggttaccgtacctacgggtaacccacccgtttaattcccggtttagttaccccctttcgtaaacccgttttccccccgtaccccggtttaaaccatttccccgttacggttaaaccgg

SEQ ID NO: 139973 - DNA, 768 bp, Homo sapiens
  misc_feature: GYAE6OF01EO4Z9.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctcgacccagtcctccactccctccctgtctgaccaaccggtgggacacagtcgtccaaccatccaccgttcggccgggacaaggtaccggaactattcgaacctaaccttaatttaagttgtatacaacagtacgaccgacgggacccgtaccctaagcctacctaatcgtatgccgtgactacttccgttagttaggaaccgaagggttccgggtaccctagtcggtacggttcaggtcggagtaggtgtacgtcggtaggaactagtactttccactacctaccgacctagttacgtaagttacctcgttaccgaacgtaacggttagttaaacgtttagtttaccgaaaccttttaacgttttaattacccggttataaacccgtaaacggtaattttaaacgtttaaccgttacgtttttaccgggttacggtaaacccggtaaacgggtacccttaaaaccgttaaccgttaaaaaccgttaaacggtttaaaccgtacggttgggtaccgtacccgtacgtaaccttaacccgttgtttacccttccgtttaaccgttaccccttaaccgtttcccccgaccccgtaagttccttacggttcttaaccg

SEQ ID NO: 139974 - DNA, 746 bp, Homo sapiens
  misc_feature: GYAE6OF01ARHAF.46.67.G01.1.454.CMB.1.raw
  modified_base (279)..(279): a, c, t, g, unknown or other
  misc_feature (279)..(279): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccgcagctccgagggagggctggaatactagtggaatgtctctcatgtgacggttctatacagtccgtctctanagagtcagtcacctatatctctcggacacgtccgagacaatcgttacgttttcccagaagtgtacgtgttcgttcggtcggacccgcccggtcgtcggaaccgtaccgggttacgtttttaacgtcgttggtacgacgggtagacggtacggtctttaagtttcgttagtttagtttttgggtacggtttaggtttacttaccggtaacctacccgtagtaccggtccggacgggggtcccttacccggaccccggttcggggaacccggtaaggggtaaccgttacgggttacggtacccgacccggtttccgttaacccgttacggtacccccgtaccccgtaaccgtaaaccgggtcccccttaacggttcccccggttaccccgtttccccccgggttaccggtaccccccgttaaccccccgttccccggtaaccccgaaacgggtccccggttaaccccgg

SEQ ID NO: 139975 - DNA, 665 bp, Homo sapiens
  misc_feature: GYAE6OF01DTNLE.46.67.G01.1.454.CMB.1.raw
  modified_base (245)..(245): a, c, t, g, unknown or other
  misc_feature (245)..(245): n is a, c, g, or t
  modified_base (442)..(442): a, c, t, g, unknown or other
  misc_feature (442)..(442): n is a, c, g, or t
  modified_base (490)..(490): a, c, t, g, unknown or other
  misc_feature (490)..(490): n is a, c, g, or t
  modified_base (612)..(612): a, c, t, g, unknown or other
  misc_feature (612)..(612): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctcgacccagtctccatccctcctgtctcgaccgaaccggtgggagacagtcgaccaccatctacgttcggaccgggacaacgtcggaaactnttacgaacctaaccgtttaatttaaagttggttaactaccaaactagtaacgacccgaacggggacccgaccctaagcctacctaatctagtcgctcgacacttccgtagtttacgacgtaacgggttccggtacctagtcggaaggttcaggtcggcgtagtacggtactcggtagggaactaacgttcgttaccncgtacacctactatacgtataacgtctacgtacgtacgttagaagttnttacgaactttacgttatacgtctaacgtaagtaattaactactaacgtttcgttaacggacgaaggtacctaacgtaactaaattaaaccgtaacgtacgtgtacgctacgaccgtacctnttcttacgttaccttactaccgtttcccgaccctataacgtctaacgttaacg

SEQ ID NO: 139976 - DNA, 791 bp, Homo sapiens
  misc_feature: GYAE6OF01A7JRU.46.67.G01.1.454.CMB.1.raw
tcagactagcagtacacgaccggtgctcgatttagagtatacatattgggtttggggagtctcggtcaggacacagcatggacatgagggtccccgctcagcctccgtggggctcctgctactctggctccgaggtgccagatgtgacatcgagctcgacccagtcctccactccctcccgtgtcgtcgaccgaaccggtgggacgacgagtcgtaccacctatccacgttcggcccgggacgaacggtaccggaactacgttacgtaacctaacctttaagttttaaacgtttaggtacttaacgaaacctaagtaaccgggaacccggaacggggtaaccccggtaacccccgtaacgtcccgttaacccttaacgttccttaacgtcggtccgtcgactaccgttaccgttaggtttacgaacggtaaacgggtcccggggtaccctaggttaccggtacggttcgagggtcggacgtaggtacggtagttacggtaggtaaccgttagttacctttacccgtaccttacccgttacctaacctagttaacctaagttacgttgtaccggtaccgtaacggttacgttaagttttactttaccgtaactttaactttagttaaccgttagtaacctaaacgtagttaactttaatacgtttacggttacgaacggtaacgacgtaaccgtaaacttaacgtaaacgtaacgtacgtggtacgtccgtacgacctacgtattcgttactccttacctccttccccgtactaccgttcttacgtgtaacg

SEQ ID NO: 139977 - DNA, 744 bp, Homo sapiens
  misc_feature: GYAE6OF01DXYHV.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatccctccctgtctgaccaaccggtgggagacagtgtccactagtccacgttcggaccgggactaaacggtcggaaacctatttacgaacctaaccttttaagttttaaagttcggttaataccaaaacgtaactaacggaacccggaacggggacccgtacccctaaaggtcccttaccttaaattccgtaagtcgtcctagtacctacttaccgtaagtttacgaacgtaagggtccgggttacccaagttcggtaacggtttcgacgggtaggtacgtaaggttcggaattcggtacgggtaactaggttacctttaccacgttctaccaacctagtacctaagttaactcgtagacgtacgtaagtagttactttagacttaacttacgttacttacacgtaactaagttaacttaacgttatttacgggtttaaccgaccggtaaaacggtactaaccgtaaactaaacgtaaaacgttaaccggagttacggtcgacgtacgtactaacctactttcggtacttaccgttactacccgttccttaaccccggattacgttcgtacggtaac

SEQ ID NO: 139978 - DNA, 845 bp, Homo sapiens
  misc_feature: GYAE6OF01EZOD9.46.67.G01.1.454.CMB.1.raw
  modified_base (174)..(174): a, c, t, g, unknown or other
  misc_feature (174)..(174): n is a, c, g, or t
  modified_base (197)..(197): a, c, t, g, unknown or other
  misc_feature (197)..(197): n is a, c, g, or t
  modified_base (418)..(418): a, c, t, g, unknown or other
  misc_feature (418)..(418): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggccttcggagacccctgtccctcacctgcgctgtctctggtcncctcatcagtagttgtttctcgngggctgggtccgcagccgtaccggaggggacgggctaggaatacgtagttaggaagtcgtcctctacgtagttaggtgggtacggtttacctaattaacacggttccgtcttctacgtaaaggtacggtacgtacgtccaaccgtattacgttcctcgtacggacctacgtccagactaacttccttacgttttcccgagtaagtagtagtaacgtttcgnggtaccgtaccggcccgtacgtaccggacggtaccgggtttcttttaacgttacgtcggtagacggtaggacggacgttacttaagttacgttagtttaggttttagggtaggtttacggtttacgttaccggtaccctaaccgttacggtaccggtacggggtaccggggttacccgtaaccccggggtaccccggggttacggggacccggtaaaccggggttaacgttaccgggtttacggttaccccggtaacccgtttcccgttaccgttaccccggttacccccggaacccgtaaccccgggtaacccgggaccccgttccggttaccccgggtttaccccccgttaccccccggggtaacgtaccccccgttaacccccgttaccccgtaacccggtaaagtaccccgggtacccccggg

SEQ ID NO: 139979 - DNA, 1156 bp, Homo sapiens
  misc_feature: GYAE6OF01ECCLY.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctcgacccagtcctccactccctccctgtctcgaccgtaaccggtgggaacgaaccgtaggttcgtacccaaccctaacttacctaaccggtttccgggaccccggggtacgtaaacgggtaccgggtaaactaacgtttacggaaccttaaacccgtttaaagttttttaaaaacgttcgggttaacttaaccgtaaaaaccgtaacgttaaaccggaaaccccgggaaaccgggggtaacccccgggtaacccccgttaaaacggtaccccgtttaaacccttaaacgtttacccgttaaacgttcggtcccgtttaggtaccctaaccgttaccccggtttaaaggtttttacggaaaccgggttaaaacgggggtttaccccggggttaacccctaacggttaacccgggttaacgggtttaccgtaacgggtacggggtaacgtaaggggttacgggttacgttccgggtaacgggggtaaaccttaacggtttaaccttttaccctacccgttacccgttaacccgtaaacccgttaaacttaaccggttaaacgtttaaacgttcccgtaacggttaaacccgggttaaacggttaaacgggtttaaacgttttaacgtttttaccggaaaacctttttaaaccgtttaacgttttaaccgttaaaccgggttaaactaaaccgtaaaacgttttaaactttaaaccgtttaacgggtttttaccgggttttaaacccggggaaacccgggttaaaacgggtaacccgttaaaacccggttaaaaacgtttaaaacccgttaaaaaccgttttaaaaccgggacggtttaaccgggttacccggtaacgttaaccccggttaaacctaaacccggtttttacgttaccccgttttaaacgtttaacccccggtttcccgtttaaaaccccgttttcccccggtttaaccccccctaagtttttaacccgttaccggttaaccgtttttaaaacccgg

SEQ ID NO: 139980 - DNA, 859 bp, Homo sapiens
  misc_feature: GYAE6OF01CKPGG.46.67.G01.1.454.CMB.1.raw
  modified_base (160)..(160): a, c, t, g, unknown or other
  misc_feature (160)..(160): n is a, c, g, or t
  modified_base (209)..(209): a, c, t, g, unknown or other
  misc_feature (209)..(209): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggacgaccctgtccctcacctgcnctgtctctggtcgcctcatcagtagttgtttcttgtgggctgggtccgnacgcctccgaggggaggtctaggaatacgtagttgggaacttgtcctcgtcgtaagtacggttgggtacggtttcctaacgttacctacggttccgttctcctacgaaggtacgtacgtacgtaccacctatacttcgtacgtaggaacctccgtaccacgtactaacttaccgttacgttttacccaaggtaaacgtagttcgtacgtttcgtacggtaccgtacccgccgtacgtacgtaaccggtaccgggttttacgtttaaacgttggtacggttacggacggtaacggaacggtaacgtacgtttaagttagttaggttttacgggttttaggttacggtttacggttttaacgttaccgtaaccgtaacccgtaaggttaccggtaccggggttaccggggtcccttaacgggcccccggttaaggggacccggtaacggggttaaccgttcgggtacccggtttaccggtacccggtttaccgtttacccggttacccgtaccccgtaccccggaaacccggtaacccgggtaccccgttaaccgggtttccccgggtttacccccgttacccccggttccggtacccccctacccccgtttaacccgttaacccggaaaccgggtacccggttacccccgg

SEQ ID NO: 139981 - DNA, 814 bp, Homo sapiens
  misc_feature: GYAE6OF01DB0GZ.46.67.G01.1.454.CMB.1.raw
  modified_base (177)..(177): a, c, t, g, unknown or other
  misc_feature (177)..(177): n is a, c, g, or t
  modified_base (797)..(797): a, c, t, g, unknown or other
  misc_feature (797)..(797): n is a, c, g, or t
  modified_base (804)..(804): a, c, t, g, unknown or other
  misc_feature (804)..(804): n is a, c, g, or t
tcagactagcagtacacgaccggtgctcgatttagagtatacatattgggtttgtcctcctgctggtggcagctcccagatgggtcctgtccctggtgcaactgcagggacgtcgggccccagactggtgaggcccttcggacgaccctgtccctcacctgcgctgtctcgtggtcncctcatctagtggttgttttctcgtgggtctgggtccgcacgtccgtccgaaggggagggctaggaactacgtagttaggaagttcgtactcgtcaagttacggtaggttacggtttacccttaagttaaccgtacggttacccgttacttaccgtaacgaaacggtacggttaccgacgttaccaacctaagttaacttcgtcgtacggaacctaccgtaccgacgtaacctaagttacccgttacgtttttacccgaaggtaatacggttgtaacgtttcgtacgtaccggacccgttccgcgtacggtaaccggtaccgggttttaacgtttttaacgttaccggtgggttaccggaacggaaggtaaacgggtaccggttaactttaagtttaggttacggtttttaggtttttagggttaacggtttcggttttaaccgttaccgtaacccgtaaccggttaacggtaccggttccggggaaccgggtcccgtacccgggtaccgggtacgggaaccggtaagggtacttacggtcgttaccgtccgtccgtaccttaccgcccgtacccgacggaccgtcctcgttcccgttcccgttcccgacgtccctaccncctaacncgtcgtaccg

SEQ ID NO: 139982 - DNA, 603 bp, Homo sapiens
  misc_feature: GYAE6OF01BK7YE.46.67.G01.1.454.CMB.1.raw
  modified_base (190)..(190): a, c, t, g, unknown or other
  misc_feature (190)..(190): n is a, c, g, or t
  modified_base (217)..(217): a, c, t, g, unknown or other
  misc_feature (217)..(217): n is a, c, g, or t
  modified_base (229)..(229): a, c, t, g, unknown or other
  misc_feature (229)..(229): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaacgtggganacagtgtcaccatccacttggccgggnaaggtcggaacnttgactaccttatttaaatgtatcaacatacgaccgagggacggccctaagcctcctaatctatgctgcatcctagtttgactaaggtggtcccagtcgagttcagtggcagtgtatcgtgggacagtacttcactctacacatcaagttatcgtacgacaacggtagtaacgtacttttacgacttaaacttactttaactggtaacctaactagtaaacttaactaagtttcgtttaaccgaccgtaaagggacctaacgtaaccgttaactaaacgttaaccgtaacgtagtacggtcctaggccctaaccgttattcgttacgttcttacctactttaccccgtcccgtacctccgttacgtgttacccg

SEQ ID NO: 139983 - DNA, 748 bp, Homo sapiens
  misc_feature: GYAE6OF01CWIQ9.46.67.G01.1.454.CMB.1.raw
  modified_base (195)..(195): a, c, t, g, unknown or other
  misc_feature (195)..(195): n is a, c, g, or t
  modified_base (199)..(199): a, c, t, g, unknown or other
  misc_feature (199)..(199): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatccctcctgtctgaccaccggtggganacgngtcgtaccaccatcacgttgacccgggtacaacggtacggaactacgttgaacctacttaatttaagtgtactacaaacagtacgaccgagggacccgaccctagcctacctaatctatgctgacactaccgtagttcgaacgtaacggtccggtacctagtccggaggttacgaggtacgacgtaggtacgggtattccggacgggaactggttacttaccaccttccgtaccactataccgtaattaccgtacctacggacgttaacggtagttaaagtttcgttttaaccggaacctttaaagtttactaacggttacgtaacctaaaacttaagttaaactttaacgttaggtttacccgggttttaacccgaacccggtaaccgggaacttaaacccggaactttaaaaaccggttaaaacggttaaccgtaacggtttaccggaagggttacctaaccggtacccgtaaactttaccgttacttccggtttaaccctcttacccttccccggtaaccctagtacttacccgttgttaaacccg

SEQ ID NO: 139984 - DNA, 663 bp, Homo sapiens
  misc_feature: GYAE6OF01ECOJP.46.67.G01.1.454.CMB.1.raw
  modified_base (217)..(217): a, c, t, g, unknown or other
  misc_feature (217)..(217): n is a, c, g, or t
  modified_base (289)..(289): a, c, t, g, unknown or other
  misc_feature (289)..(289): n is a, c, g, or t
tcagactagcagtacacgaccggtgctcgatttagagtatacatattgggtttggggagtctcggtcagggacacagcatggacatgagggtccccgctcagctcctggggctcctgctactctggctccgaggtgccagatgtgacatcgagctgacccagtctccatcctccctgtctgcaccggtggagacagtgtcaccatcacttgccgggnaagtcggaacatgacacttattaaatgtatcaacatacgacaggaccgccctaagctactaatctatgctcncactcctagttagacgtaagtcgggtacccagtcggtacggttcaggtgcgaggtgagtcgtaggactagtattcgaccttctaccactatacaagttaactcgtacacgtaacgtagtaacgttagtttacgtacttaaactttacttacgttacgtaactaaactaacgttaaactttaacgtaacgtttacggtttaccggaaccggtaaacgggtaacctaaaccggtaaaccttaaactaaaacggtttaaaccggtaacgttacggtacggtaacctacggtaaccctaccgtaactttcccgtacgtttcccgttaccgtaacctttccccgttaccccgttaaccttacttcccgttgttaaaccg

SEQ ID NO: 139985 - DNA, 764 bp, Homo sapiens
  misc_feature: GYAE6OF01AWRLP.46.67.G01.1.454.CMB.1.raw
  modified_base (215)..(215): a, c, t, g, unknown or other
  misc_feature (215)..(215): n is a, c, g, or t
  modified_base (605)..(605): a, c, t, g, unknown or other
  misc_feature (605)..(605): n is a, c, g, or t
tcagactagcagtacacgaccggtgctcgatttagagtatacatattgggttggggaccgtcctgtgcaagaacatgaagcacctgtggtttcgtcctccgtgcgtggtggccagcctcccagatcgggtcctgtcccgtggtgcaactgcaggacgtccgggcccacgacgtcggtgaggcccttcgggacgccctgtcccctcaccgtcggcnccgttcgtcctcgtggacgtccctcctagtccgaggttcgttggtttcctcggtggggcttcgggtccgcgtagcctaccggagggacggcctaggtaactactagttacggagtcgtctctacgagtggtagtacggtttctaagttaccgacgtccgttactcacgtagaggttccgacgttccgaatcgtacttccgtgtaaccggacctaccgttcgaacgtacctaaaccgttcgttaccgtttacccgagtaaacgtacgttacgtaacgtcgtaacgtcgacccgtcgtacgtcgtaacgtcgggttaactttctaacggtgtccgagtaaccgagtcgtatacgttaggtcgtttaaggttcgtaggttacgtttaaccgtntaccccggttaacgtacggaacccgggttcggaaacccgggttcccgttaaccccgggtaccgggtaacgggacggttaaacccggtaaccgggtttccgaccggttaacccccggtaccgttaccgttaaccggtaccgttacccccccggtaaccgg

SEQ ID NO: 139986 - DNA, 761 bp, Homo sapiens
  misc_feature: GYAE6OF01BO7RR.46.67.G01.1.454.CMB.1.raw
  modified_base (158)..(158): a, c, t, g, unknown or other
  misc_feature (158)..(158): n is a, c, g, or t
  modified_base (168)..(168): a, c, t, g, unknown or other
  misc_feature (168)..(168): n is a, c, g, or t
  modified_base (258)..(258): a, c, t, g, unknown or other
  misc_feature (258)..(258): n is a, c, g, or t
  modified_base (327)..(327): a, c, t, g, unknown or other
  misc_feature (327)..(327): n is a, c, g, or t
tcagactagcagtacacgaccggtgctcgatttagagtatacatagttgggtttggggagtctcggtcaggacacagcatggacatgagggtccccgctcagctccgtggggctcctgctactctggcctccggaggtcgccagatcggtgacatcgngctcgacccngtcctaccatccctcctgtactcgaccgaaccggtgggacgtacagttcgtccacctactcacgttcggaccggtacaagtccggaactnttcgaactaccgttaatttaagtggtactacaacgtgtaaccggaccgaggggtaccctacccggtaanccttccgtaatcctgtccggatcgctaacgtcctaggtttcgaacgtaacgggttccgggtacctaagttcgggtagggtttaccaggggttcggaaccgtgggtaacgtacgtccggttagggaaccctaaagggtttccgtttacaccgtttctacgaccctaaggtctaaacgttcgtccgttaacggacctttaaggggtattagttacccgttttagaaaccttttaaggttacctttcgaacttaataaccgtaaagtaacgtttacttaaacggtttggttaacccggaacttaacgggacttaaaccggaacttttaaacgaaaccgtaacgttcggtctacggacttaaccggccctttatagttccccggttatcccggtttaaccggttacccccttagacccttggtaaactgggtaaaccc

SEQ ID NO: 139987 - DNA, 927 bp, Homo sapiens
  misc_feature: GYAE6OF01DRLDC.46.67.G01.1.454.CMB.1.raw
  modified_base (180)..(180): a, c, t, g, unknown or other
  misc_feature (180)..(180): n is a, c, g, or t
tcagactagcagtacacgaccggtgctcgatttagagtatacatattgggtttgtcctcctgctggtggcagctcccagatgggtcctgtccctggtgcaactgcaggagtccgggcccagactgggtgacggtccttcggacgaccctcgtccctcaccgtgcgtctgtctcgtggtcncctcatctaggtgttgtttctgtcgggtcgtcgggtccgcacgtccgtaccggaagggggtaacgggtctaggtaactacgtaggttaggaagttcgtacctcgtagtaagttaggttacgggtacgtttacccttaacgttacgtaccgttccgttccctacgtaacgaaggtcgtcggaacgttaccaaccgtattacctcgtacggtaccgtaacccgaccggtaccaaggaccttacttaccgtttaccgttttaccgaggaaactgtacggttacttcggtcgacggacccgtcgtacgtacggtaaccgggtcggtttactttaacgttcggtaggacgggaacggtacggtaccggtaacgtttacgtttaagttttacgttagggttttacggttttaacgggtggtttttaaccggtttaaccgtttaacccggaaacccgtttaacccgggtagggttaccggggtaacccggggggtaacccggggttcccccgtaacccgggggttcccccgggtaagggggtaaacccgaaacggggttttaaccgttaccgggtacccgtttacccccgtaaccggtttccgttaccccggttaccacccccggttaaacggaacccgggttacccggtaccccgttaaccggtttccccccgggttacccccgtttaccccccgggcgttaacccccctacccctaacccgttaaccgaaccgggtcccttaacccccgggg

SEQ ID NO: 139988 - DNA, 793 bp, Homo sapiens
  misc_feature: GYAE6OF01A4AK0.46.67.G01.1.454.CMB.1.raw
tcagactagcagtacacgaccggtgctcgatttagagtatacatattgggtttggggagtctcggtcaggacacagcatggacatggagggtccccgctcagctcctggggctcctgctactctggctccgaggtgccagatgtgacatcgagctgacccagtcctccatccctcccgtgtctgcgaaccggtgggacgacagtcgtcaccgactctacgttggccgggtactaaggtacggaactagttcggaactaaccgttattttaaaagttggtactaccaaacgtacgttaacgaccgaacggggaccggaccccgttaaaggaccttaccgtaacttcttaacttgggtcctgtaccgtaacgtacccgttaggtttacgaacgtaaacgggtcggggttaccccaaggttcgtacgggtttctaagggtcggacgtacgggtaggtacgtacggtaggggtaacgtaacggttactttacccgacgttcctacgtaaacccgtgttaaccgtaaccgttaacgttacctaccggtaaccgttaaaccggttaggtaaagtttaaccgttttaggaaaccgtttaaaccgtttacgtttaccgtaaggtaacctaaacgtaacgtaaactttacgtaacgtttcggtttaccggaccgggtaaaaggtaccgaaccgttaataaacccgtaaaattaaccggtagttcggtacgtaacgtcgtaaccgtacttactcggttcttacgtaacttaccgtctaccccggtatacttccgtacgtaacc

SEQ ID NO: 139989 - DNA, 708 bp, Homo sapiens
  misc_feature: GYAE6OF01EZ7R2.46.67.G01.1.454.CMB.1.raw
  modified_base (196)..(196): a, c, t, g, unknown or other
  misc_feature (196)..(196): n is a, c, g, or t
  modified_base (235)..(235): a, c, t, g, unknown or other
  misc_feature (235)..(235): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatccctccctgtctgacaaccggtggganacgagtgtcaccatcacttggccgggacaagtcggaacntagacacttatttaaagtggtatcaacatacgaccgagggaccgccctaagctactatctatgctgcatcctagttagacgtaaaggtcgggtaccctagtacggtaggttcaggtggctagtaggtatcgtaggggtactaggttatttcacctactaccaaccctataccgtaaagttacttccgtaggtacgtaacgttaggtaacgtttagttttacgacctttaaactttattaccgttagtaacctaaacgtaagttaaactttaacgtaacgttttacggtttacccggaacggtaaacggggtaacctaaccggtaaacttaaacgtaaaacgtttaaaaccgtacgttacggtacggtacccgtacgtaacccctaacgttaccgtttccgttacggtttaccttacttaacccgtttaccccgtttaaccccccgacttttaaacttcccgtggttaaacccg

SEQ ID NO: 139990 - DNA, 591 bp, Homo sapiens
  misc_feature: GYAE6OF01A2TBH.46.67.G01.1.454.CMB.1.raw
  modified_base (193)..(193): a, c, t, g, unknown or other
  misc_feature (193)..(193): n is a, c, g, or t
tcagactagcagtacacgaccggtgctcgatttagagtatacatattggggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacactatttaaatggtatcaacatagaccagggacgccctaagctcctaatctatcgctgcatcctagtttgacaaaggtcgggtacccagtcgaggttcagtggacaggtggactcgtaggactagtatttcactctacaccatacagtaactctgactaacgtagtaaagtatttagactaaactttattaacgtagtaccaaacgtataaattactaagttcggttttaccggaccgtaacgggtacctaacgaacctaacgtaaaacgttaaacgtaacgttacgtcggtacgtacgacctaacctattacgtcgttcttactacgttcccttacccgacctactccgtgtaacg

SEQ ID NO: 139991 - DNA, 630 bp, Homo sapiens
  misc_feature: GYAE6OF01BB9H4.46.67.G01.1.454.CMB.1.raw
  modified_base (249)..(249): a, c, t, g, unknown or other
  misc_feature (249)..(249): n is a, c, g, or t
  modified_base (326)..(326): a, c, t, g, unknown or other
  misc_feature (326)..(326): n is a, c, g, or t
  modified_base (337)..(337): a, c, t, g, unknown or other
  misc_feature (337)..(337): n is a, c, g, or t
  modified_base (348)..(348): a, c, t, g, unknown or other
  misc_feature (348)..(348): n is a, c, g, or t
  modified_base (354)..(354): a, c, t, g, unknown or other
  misc_feature (354)..(354): n is a, c, g, or t
  modified_base (371)..(371): a, c, t, g, unknown or other
  misc_feature (371)..(371): n is a, c, g, or t
  modified_base (388)..(388): a, c, t, g, unknown or other
  misc_feature (388)..(388): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggcctttcggagaccctgtccctcacctgcgctgtctctggtgcctccatcagtagtggtttctcgtggggctgggccgnagctccgagggaagggctggaatacgagttggaagtgtctctcatagtggagttcctatacagtccgtctctcaagngtcgagtcacntatctctgacncgtcancaatctacgttttcccngtaagattgacgtttcngtacgacccggccgctacggaaccgtacgggttactttacgttacgtcgtcgcggaaggtacgtaccggttacttaagtttacgtagttagtttttcgggagtttagggtttaactttcggaacctacccgtaggacgtaccgggtacggggtctaccccgggtacccggtagggccggtaaagggtacctacggttacgggtaccctaacccggttccttacccgttcgcccctaacccgg

SEQ ID NO: 139992 - DNA, 834 bp, Homo sapiens
  misc_feature: GYAE6OF01AIIA4.46.67.G01.1.454.CMB.1.raw
  modified_base (191)..(191): a, c, t, g, unknown or other
  misc_feature (191)..(191): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctcatcctccctgtctgcaaccgtggganacagtgtcaccatcacgttggccgggcaagtcggaacattcgactacttatttaaagtgtatacaacatacgaccgagggaccgccctaagcctacctaatcctagtcgctgctattccgtaggtttacgacgtaaacgggttccggggtacccctaggttaccggtagggtttaccgaggttacggggtacgtaagggttccgggtaagttccggttagggggaaccttaaggttaccttttaacccgtaccgttacccgttaccgtaaccctaacgttaccgtaaacgggtttaaccttaccggttaacgtaaccggttaaaccggttagttaaacggttttacgttttaaggaacccgttttaaaccgtttaatttacccgttaaacggtacctaaacgttaacgttaaacttttaccggttaagttttacccgggttttaacggaacccgggttaaacgggtaaccccgttaaaccggtaaacgtttaaaccgttaaaacgtttaaaaccgggtacgttaacgggttcgtacccgttaacgtaacccgtaacttaccgtttaccgttccgtttacccgttaccgttaaccctttcccccggttacccctaccgttaaccgtttccgtaacggtttaacc

SEQ ID NO: 139993 - DNA, 846 bp, Homo sapiens
  misc_feature: GYAE6OF01BQIZV.46.67.G01.1.454.CMB.1.raw
  modified_base (224)..(224): a, c, t, g, unknown or other
  misc_feature (224)..(224): n is a, c, g, or t
  modified_base (431)..(431): a, c, t, g, unknown or other
  misc_feature (431)..(431): n is a, c, g, or t
  modified_base (603)..(603): a, c, t, g, unknown or other
  misc_feature (603)..(603): n is a, c, g, or t
tcagactagcagtacacgaccggtgctcgatttagagtatacatattgggtttgggggacctcctgtgcaagaacatgaagcacctgtggtttgtcctcctgcgtgggtggcagcctcccgagtagtcgggtccttcgtcccgtggtgaccaactggcgaggacggtccgggacccacggacgtggtagacggtccgttcggaacgtccccttcgtcccctacnccgtgcgtcttcgtcctcggtcggtcctccctcgtatcgtaggttggtttcggtttccgtgggtcggggtaccgttcggggaccgcgaccggtccggaccgggaaggggtacgggtacgtaagggaaaccttaggtaggttacggacgttcgttctactgtaacggttggtacggttacgttaccttaagttaccgtaccgttcctnttaaccgaggtaacgaggttaccgtaactaccgaacctattcctacgttacggaacgtaccctaccgtaactacggtaactatttacccgtttaacgttccgaaggtacgtacgttgtaccgttgacgggtccgaccgcgtagtacgtaccggttacgttacttaggtacgnggtaacgacgggtagtacggttactagtttagttggtttcgtttaagggttttcgtaaggtttaccgtttcgtaaaccccgtgtaaccgggttcgaaacccggggtccgggtaccccgggtacccggtaccccgggtaaccgggtaggggaaaccgttacggttacccggttaacccgggttcggtaccccccgtttagtacccccgttccgggtaaacccctcccgggtaaaaccccccggg

SEQ ID NO: 139994 - DNA, 770 bp, Homo sapiens
  misc_feature: GYAE6OF01EJ1Y6.46.67.G01.1.454.CMB.1.raw
  modified_base (335)..(335): a, c, t, g, unknown or other
  misc_feature (335)..(335): n is a, c, g, or t
  modified_base (385)..(385): a, c, t, g, unknown or other
  misc_feature (385)..(385): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcgcctcatctagtagttcggtttcttcgtcggggtctcggggtccggcagccttcccgaggggaaggggctgggaatacgtagttggtaagtgtctctcagtagtggtagttcctattacagttccgtctcacgaagacgtcgagtccaaccgtatactcgtcgnggacctaccgtccaagtacctaagttccgtaacgttttccgagtaaacgnttacggtacgttcgtcggtacgacccggtcgtaccgtaggaaccggtcggggttaccttttaagtaccgttggtacggtacggaacgtaaggtaccgtactttaagttagttaggtttagttttgggagttttaacggtttacgtttccgaaaccgtttacccgtaaggtccgggttaacgggacccgggggttcctaccccgggacccggtagggggaccgaagggggttaccttaccgggttacgtacccgttaccggttccgttcccgtaccgtaccccgtccccggaaccgtaaccggggtcccctaaggttcccccgtttccccgtttaccccggcgtacccccgtaccctacccccgtacgttaaacgggcttaccccg

SEQ ID NO: 139995 - DNA, 740 bp, Homo sapiens
  misc_feature: GYAE6OF01AYBVJ.46.67.G01.1.454.CMB.1.raw
  modified_base (187)..(187): a, c, t, g, unknown or other
  misc_feature (187)..(187): n is a, c, g, or t
  modified_base (226)..(226): a, c, t, g, unknown or other
  misc_feature (226)..(226): n is a, c, g, or t
tcagactagcagtacacgaccggtgctcgatttagagtatacatagttggggtttgtcctcctgctgggtggcagctcccagatgggtcctgtccctgggtgcaacctgcaggagtcgggccccacggactgggtgacggcccttcgggacgacccctgtcccctcacctgcgctgtctctgggtcncctccatcagtagtggtttctcgtggggcctgggtccgnacgccgtcccgaggggacgggctaggaactacagttcggaagttgtcctctacgattaggtcggtaggtttcctaattacaggtcctctctcgaagtcgtcgatcgaactatactctcgtggaccacgtccagctacgtcttacgttttcccgagaacgtagtggtacgtttcgtcggtccgcccgtcccggtctacggaaccgtcgggttctttacttacgtggtcgacgaggacggtacggtacttacgttagtagtttagttttcgggacgtttcggtttaaccttccgtaaccgtacccgtaggtacgtaccggggtaccggggtccgttacccggtaccccgggttaggggcccggtaaacggggtaccgttccggttcggttaccctaccggttccttaccccgttaggcccccgtaaccgtaacccgggaccggtccctaaggttccccggttaccccgtccccgtacggcccccttaccctacccgtaaccgacgtccgtacccgg

SEQ ID NO: 139996 - DNA, 831 bp, Homo sapiens
  misc_feature: GYAE6OF01DZZWQ.46.67.G01.1.454.CMB.1.raw
tcagactagcagtacacgaccggtgctcgatttagagtatacatattggggtttggggagtctcggtcaggacacagcatggacatggacgggtccccgctcagcctccgtggggctcctgctactctggcctccggaggtcgaccagtatgtgacagtcggagctacgacccagtcctcctactcccctccgtgtcctacggaccgtaaccgggtggggacacgtacgtcgtaccacctactaccgtaccggttcgggaccgggtaacaacgggttaccggaactagttacgaccttaactttaatttaaagtcgtaactacaaactagtacggaaccggagggtaccccgaacctaagtccttaacctaagttctacgtggactcgtactactaccgtgttacgaacgtacgggtccggtacctaggtcggtcggtacgaggcgtagagtgtactcggaggactactactttaccgaacctcgaacctacgtacttacgtaacgttaacgtccgtaaccgtacgttaacggtagttaagtttctaacggttaacttaaacgttttcgatttaaaccgaaccgtaaagtttaacgtaaacgttttaaacggtttcggtttaaccggttaacggggaaaacccacggggttaaaccccttaaaatttaaaaaccgttaaaacggttaaaaacctttaaaccggggacgttttacgggaaccttaacggaacccgtaaaccttacccggttaatttccccgttaggtttacccctaaccttttcccccgaaacccgtttccctaaaccgtcggtttaacctaaggttaaccc

SEQ ID NO: 139997 - DNA, 710 bp, Homo sapiens
  misc_feature: GYAE6OF01CE9F3.46.67.G01.1.454.CMB.1.raw
  modified_base (194)..(194): a, c, t, g, unknown or other
  misc_feature (194)..(194): n is a, c, g, or t
  modified_base (206)..(206): a, c, t, g, unknown or other
  misc_feature (206)..(206): n is a, c, g, or t
  modified_base (221)..(221): a, c, t, g, unknown or other
  misc_feature (221)..(221): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctcctgtctcgcaaccggtggganacagtgtcaccntcacgttcggccggnaagtcgaacatgacacttattaaatgtatacaactatacgaccgacgggaccgaccctaagtcctaccgttaaatctacgtgtaccgtcgacctacttaccgtagtttacgacgtaaagggtccgggtccctaagtcggacggttcgagtcggtcgtagtcggtatcggtagggaacttacggtctttaccgctccttacaccgtataaccgtaagttaacttcgtaacggacgtaaacggttagtaaaggtttacgtttaccgtaactttaaaccgtttacttaacgttacgttaacaaacgttaacgttaaactttaacgttaacgttttaccggtttacgggaacccgggttaacggaacccgttacgtaaaacttaaacgttaaacgtaacgtacggttacgtacgacctacgactaccctagttaccttcgtaccctttactacccgtttccgttacccaccctttaagttccgtaagttaacg

SEQ ID NO: 139998 - DNA, 688 bp, Homo sapiens
  misc_feature: GYAE6OF01B35FV.46.67.G01.1.454.CMB.1.raw
  modified_base (92)..(92): a, c, t, g, unknown or other
  misc_feature (92)..(92): n is a, c, g, or t
  modified_base (121)..(121): a, c, t, g, unknown or other
  misc_feature (121)..(121): n is a, c, g, or t
  modified_base (264)..(264): a, c, t, g, unknown or other
  misc_feature (264)..(264): n is a, c, g, or t
  modified_base (280)..(280): a, c, t, g, unknown or other
  misc_feature (280)..(280): n is a, c, g, or t
  modified_base (424)..(424): a, c, t, g, unknown or other
  misc_feature (424)..(424): n is a, c, g, or t
tcagactagcagtacacgaccggtgctcgatttagagtatacatattgggttggggacctcctgtgcaagaacatgaagcacctgtggtttntcctcctgctggtcggcagcctcccagtntcgggtcctggtcctggtcacaactgcgaggcgtccggcccagactggcgaggtcccttcgggacacccttgtcccctacgaccgtggcctcgttcgtctcgtcggctccctaccaatccgaagttctttcggtttcttacgnggggtcctggggccanacggtcctaccggaagggacgggtcttaggaaactacgtaagttggaacgttgtccttactagaaggttcgggacgttagttacccttataccgtaggtcccttcgtacacgaaaggtcggtaccacgtacaactatacgttcngtacgactagaccagtacctaagctttacccgtttgaaagactagacgttcgttacgtcgtacggtaccgccgtactacgtaacggtacgggttatttaacgtcgtaggtcgtagtacgaggtaccgtattactggttcttagtttcggagttacgttcgttacgaactaccgtgacggtccgtacggggccttaccggccggtacggacggtaatacgtaccgtaggtcccttaccgtgtacccttacggtccctaaacccgg

SEQ ID NO: 139999 - DNA, 854 bp, Homo sapiens
  misc_feature: GYAE6OF01A7QTQ.46.67.G01.1.454.CMB.1.raw
  modified_base (363)..(363): a, c, t, g, unknown or other
  misc_feature (363)..(363): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgacgtggtgacggccttcggacgaccctgtcccctcacctgccgcttcgtctctggtcgccctaccatccgtagtaggtttcggtttcttcggtggggccgttcgggtccgcagcctccggaggggaagggtcgtaggaatacgtacgtaggaagtgtctctcagtaggtgggtacgttactagttacgacgttccgtacctntacgaacgtgtacggtacgtaccgaactacgtaacttccgttcgaacgggacctacccgacccgtaagtaccgtaaacttccgtttaacgtttttccccgaaggttaacgtattagggttacctttggtacggttaccgaccccggtcgtaccgttcggtaacggtacccgggtttacgttttaaaccgttggttacgttaccgggtcggtaaacggtaccggttaacgggaccttttagtttacgtttacgggtttaacgttttttaggggtaaccggttttacggggttttaacgtttaaccctaacccgttaccccgggttaaagtacccgggggttacccggggtaccccgggggtcgttaaccccgggtttaccccccggggagggggtaacccggtaaacgggttaaccgtttacccgggtaccgggttaacccgttcccgttaaacccgtttccccggttaaccgggtccccctaaaccccggg

SEQ ID NO: 140000 - DNA, 892 bp, Homo sapiens
  misc_feature: GYAE6OF01BRDUJ.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccggaggtgccagatgtgacagtcgagctcgacccagtcctccactcccgttccctgtctgccgtaaccggtgggacacgtaggtcgtaccaccgatacgtacgttcggcccgggtacaacggttaccggaaactagttacgaaccttaaaacccttttaagttttaaaagtttcgggtaaataaccgtaaactaacgttaaccggaacccggtaacgggggtaaccccgtaaccccgttaaacggtcccctaacccgtttaacgttaccttagttcggaccgttcgtacctaacgttccgttacggtttacgaaacggtaaacggggttccgggtaaccctaggtacgggttacgttacggtacgggtcggtacgtagggtacggtagtcggaacgggtactaagttcttacctacgtccttaccgacgttaacgtacgtaagttactacgtacgtaacgtaacggtattaagttaacgtttacgaaactttaacgtttacttaacgtaacgtaactaacgtaaacgtaacgtttaacgttaacgttttacggttaaccggtaaccggtaaaccgtaaccgttaaaaccgttaaccgttaaaaacgttaaacggttaaaaccggttacgttccgggttaaggtacccgttacgaaccccgttacgttaccccggtttacgtttacccgttaccgtttaccccgttaaaccgttttcccccggttaacccgttaacccgttaccggtttcgttaaaccgttaccg

SEQ ID NO: 140001 - DNA, 620 bp, Homo sapiens
  misc_feature: GYAE6OF01EIH7M.46.67.G01.1.454.CMB.1.raw
  modified_base (172)..(172): a, c, t, g, unknown or other
  misc_feature (172)..(172): n is a, c, g, or t
  modified_base (207)..(207): a, c, t, g, unknown or other
  misc_feature (207)..(207): n is a, c, g, or t
  modified_base (286)..(286): a, c, t, g, unknown or other
  misc_feature (286)..(286): n is a, c, g, or t
  modified_base (346)..(346): a, c, t, g, unknown or other
  misc_feature (346)..(346): n is a, c, g, or t
  modified_base (415)..(415): a, c, t, g, unknown or other
  misc_feature (415)..(415): n is a, c, g, or t
tcagactagcagtacacgaccggtgctcgatttagagtatacatattgggtttgtcctcctgctggtggcagctcccagatgggtccctgtccctggtgcaactgcaggagtcggcccacgactggtgaggccttcggagaccctgtccctcacctgcgctgtctctggtcncctcatcagtgtggtttctcgtgggctgggtcgcngctccgagggagggctggaatacagttggaagtcgtctcgtcagtagtggaggttcctattacagtccgtctctcaagngtcgagtcactatatctctcggacacgtccagacaacttctacgttttccccagaacgtntgtagttcgtgttcgaaccgcgtctacggacgtacgggtcttttatacctgtcgacgtagacgtacggnttaacttagtagttaacttttggagtttcgtttaattccgtactaccgtagtacgtacggaccggggtctaccggacccgtcggggaccgtacgggtaacttacgtcggttactaccgtccgttacctacggtcccaccgtaaccgtacggccctagtccggttccctccccgtcgccctaccctccctaccgtagcgtaccccg

SEQ ID NO: 140002 - DNA, 809 bp, Homo sapiens
  misc_feature: GYAE6OF01C6OCH.46.67.G01.1.454.CMB.1.raw
  modified_base (138)..(138): a, c, t, g, unknown or other
  misc_feature (138)..(138): n is a, c, g, or t
  modified_base (530)..(530): a, c, t, g, unknown or other
  misc_feature (530)..(530): n is a, c, g, or t
  modified_base (799)..(799): a, c, t, g, unknown or other
  misc_feature (799)..(799): n is a, c, g, or t
tcagactagcagtacacgaccggtgctcgatttagagtatacatattgggtttggggagtctcggtcaggacacagcatggacatgagggtccccgctcagctccgtggggctcctgctactctggcctccggaggtnccagatgtagacatcgagctacgaccagtcctacctacttccctcccttgtctacgaccgtaaccgggtagggacgacgtacgtacgtaccaaccgtactaccgtaacggttcgggacccgggtaacgtaaacgggtaaccgggtaaacttacgtttaaccggaaaccgtttaaaccttttaaagtttttaaaacggtttcggtaaaacctaaccggaaactaacgggtaaccggaacccggggtaacggggtaaccccgtacccgttaacggtccttaacctaacgttactacgtcggacttaccgacttacgtaccgttaggttacgaacgttaacgggtccgtaaccaggttacggacgttcgaggtcggacgtggagtacgtcggganacttagttactcccgaactccgaacacttaacagtaacgtacacgttacggacggttaaagtacggttaaatttacgttacgaactttaacgttacttaccgtaactaactaacgtaacgttaacgtttaacgtacgtttaccgggtaaccaaacgggtaacgaaccgttaacgaaaccgttaaaggttaaaccgtacgtacgtaggtcttaccacgtacccgtaagttcacggtttcaccttcgtaccgtccgaccctagtacgttcncgtttaaccg

SEQ ID NO: 140003 - DNA, 657 bp, Homo sapiens
  misc_feature: GYAE6OF01ATWWE.46.67.G01.1.454.CMB.1.raw
  modified_base (224)..(224): a, c, t, g, unknown or other
  misc_feature (224)..(224): n is a, c, g, or t
  modified_base (645)..(645): a, c, t, g, unknown or other
  misc_feature (645)..(645): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatccctcctgtctgcacggtggagacagtcgtaccaccatctacgttcggccggganaacggtcgaactattagaacctacttaatttaaacgttgtactacaaactagtacgaaccgaaggggaccgtaccctaagctacctaaagtcctaagtcgtctcgactacttccgaggtttacgacgtaaacgggtcgggtaccctagtcgggtagttacgaggtcggactacgggtgtactccggtagggactaggtacttacacgtcctacactatactagtaactcgtagacgtaacggtagtaacgttacgtttagaacttaaacttacgttaccgtagtaacgttaaagtaacgttaactttaactaagtttacggtttacgaaccgtaaacggacctaacgttactaaacctaaagtaacgtacgtgtacgtgacactactatccgttatccttacgacctttcctacccgtaancttcgtagtaac

SEQ ID NO: 140004 - DNA, 621 bp, Homo sapiens
  misc_feature: GYAE6OF01B13IV.46.67.G01.1.454.CMB.1.raw
  modified_base (323)..(323): a, c, t, g, unknown or other
  misc_feature (323)..(323): n is a, c, g, or t
  modified_base (386)..(386): a, c, t, g, unknown or other
  misc_feature (386)..(386): n is a, c, g, or t
  modified_base (393)..(393): a, c, t, g, unknown or other
  misc_feature (393)..(393): n is a, c, g, or t
  modified_base (398)..(398): a, c, t, g, unknown or other
  misc_feature (398)..(398): n is a, c, g, or t
  modified_base (414)..(414): a, c, t, g, unknown or other
  misc_feature (414)..(414): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccactccctccctgtctgcaaccggtgggagacagtgtccaccatccacgttcggcccgggacaacggtcggaactagttacgactacctttaatttaaagtggtaatacaacatagaccgacgggaccggaccctaggctacctaagtctatgcgtcnctactctagttcgacgaagggtcgggtccagtcgagttcagtgcgagtgactcgagtacagtntcactcncactntcgaagtactcgacgngtaacgtgtaattgtttacacttaactttataccgtagtacctaagtaagtaattacgttaacgtttcggttacgaccggaacggtataaccgtaattaaacgtaaatttaaccggactaggttccggtactaaccgtccaaccgttacttaccgtactttccgtaccttacgtttccccttacccgacttagttacctcgttaacg

SEQ ID NO: 140005 - DNA, 736 bp, Homo sapiens
  misc_feature: GYAE6OF01B3JAP.46.67.G01.1.454.CMB.1.raw
  modified_base (248)..(248): a, c, t, g, unknown or other
  misc_feature (248)..(248): n is a, c, g, or t
  modified_base (362)..(362): a, c, t, g, unknown or other
  misc_feature (362)..(362): n is a, c, g, or t
tcagactagcagtacacgaccggtgctcgatttagagtatacatattgggtttgggggacctcctgtgcaagaacatgaagcacctgtggtttgtcctcctgctggtggcagctccagatgggtcctgtccctggtgcaactgcaggagtccgggcccacgacgtggtgacggtccttcggacgaccctgtccctcgacctgcgcgtgtctctggtctccctcatctagttagttcggtttcttcggnggggtctggggtccggcacgccgtaccggaaggggaacggggtcgtaggtaagtacgtagttaggaacgtgtctctactagtaggtggacgtttctagttacgacgttcgtacncgtacgaagtacgtcgactcaacgtatctctacgtacggactacgtcgaagtactaactcgttaacgtttccaagtaacgtagttacggttagttacgtcgtacggacccgtccgtcgtacgtaacggtacggttacgttttaactacggtcgtacgtacggaggtaacgaacgtaagttactttaagttgtttacgttttagggagtttggtttaacgttacgaaccgtacccgtaaggtacggttacgggaccgggttaaccgtacccggtaccccggggtagggtaacccggaaagggttaacccgttacggtaccgttaacccgttaaccgttaccggtttcccgttaacccggtccgttaaacccccgg

SEQ ID NO: 140006 - DNA, 829 bp, Homo sapiens
  misc_feature: GYAE6OF01B9MDZ.46.67.G01.1.454.CMB.1.raw
  modified_base (123)..(123): a, c, t, g, unknown or other
  misc_feature (123)..(123): n is a, c, g, or t
  modified_base (808)..(808): a, c, t, g, unknown or other
  misc_feature (808)..(808): n is a, c, g, or t
tcagactagcagtacacgaccggtgctcgatttagagtatacatattgggtttggggagtctcggtcaggacacagcagtggacatgacgggtcccgctcagctcctaggggctcctgctacnctggctccgaggtgccagatgtgacatcggacgctacgaccctagtctaccaactccgtccttagtctcggaccgtaaccggtgggacgacgtaggtccgtacgaacctacgtcctaacggttccggcccggggaactaaacgggttacccggaactacgttacgaacctaaccgtttaatttaaacggttcgtaactaccaactagtacggaccgacgggaccgtacctaacgtacctaccgtaactctacgtgaccgtcgacgtctaccgttaggtacgaacgtaaacgggttcgggtacccagtacggtacggttacgacggtcggacggtagtcgggtaacgttcggagggaacttaagggtactttccgtaactcctacgacctagtaccgtaattactccgtacgaacggtaacgtgtaaacgttgttttacgaacttaactttaacgttcgttacggtaacctaaactacgtttaaacgttaacttaagtttttcgggtttacccggaaacggaaccgggttaaaccgtaaccgtttaaaaccggttaaactttaaaaaccgggttaacgttaccggtttaaggtacccgggttactacccggaactttaaccctaacggtttactttaccgggttacccttttcgaacccgtttttcccccggtacctttaaacccngttccgtttaaaggttaccgg

SEQ ID NO: 140007 - DNA, 744 bp, Homo sapiens
  misc_feature: GYAE6OF01CKIBW.46.67.G01.1.454.CMB.1.raw
  modified_base (97)..(97): a, c, t, g, unknown or other
  misc_feature (97)..(97): n is a, c, g, or t
  modified_base (154)..(154): a, c, t, g, unknown or other
  misc_feature (154)..(154): n is a, c, g, or t
  modified_base (198)..(198): a, c, t, g, unknown or other
  misc_feature (198)..(198): n is a, c, g, or t
  modified_base (693)..(693): a, c, t, g, unknown or other
  misc_feature (693)..(693): n is a, c, g, or t
  modified_base (711)..(711): a, c, t, g, unknown or other
  misc_feature (711)..(711): n is a, c, g, or t
tcagactagcagtacacgaccggtgctcgatttagagtatacatattgggtttggggagtctcggtcaggacacagcatggacatgagggtccccgntcagctccgtggggctcctgctactctggctccggaggtgccagatgtgacatcganctcgaccctagtcctccatcctcctgtctgacaaccggtggaanctaggtctaccaacctatctacgtcggccgggacaaggtcgaactattacgacctacttaattaagtcggtatacaacatacgaccgagggaccgtaccctaagtcctacgttaactctatcggctcgacctagtccgtagttcggaaacgtacggtcgggtacccagtacggtagttacgaaggtcgacgtaggtagggtactacgggtaggaacttaacggtcctttaaccacccgttacctaccgtaaacctacgttaactaaggttaaccctcggtaacggtaaccgttaacggttaggttaaacctttacttttaacggaaaacccttttaacgtttttacgtaaacgttacggtaaaaccctaacggtaaacttaaaccgtttaagttaacgtttacgggttacccgaaaccggtaagggtaaccttaaccgtaaataaaacctaaacggttacgttaagcgggttacctacgtcgacccttaaacgtnttaccgttcgtaaccgtnttacccgtccgtaccgatacgttcgtaagtccc

SEQ ID NO: 140008 - DNA, 725 bp, Homo sapiens
  misc_feature: GYAE6OF01C1I9V.46.67.G01.1.454.CMB.1.raw
  modified_base (196)..(196): a, c, t, g, unknown or other
  misc_feature (196)..(196): n is a, c, g, or t
  modified_base (223)..(223): a, c, t, g, unknown or other
  misc_feature (223)..(223): n is a, c, g, or t
tcagactagcagtacacgaccggtgctcgatttagagtatacatattgggtttggggagtctcggtcaggacacagcatggacatggagggtccccgctcagctcctggggctcctgctactctggctccgaggtgccagatgtgacatcgagctgacccagtctccactccctcctgtctgaccaaccggtgganacagtcgcacatcacttcggaccgganaaggtccgaactattacgacctaaccgttattttaaacgtgtaatacaaactacgtaacgaaccgacggggaacccgtaccctaagtcctaccgtaatcgtagtcgctcgctactaccgtaggtttacgacgtaacggtcgggtaccctaaggtcgtaggtcgaggtcggagtacggttggactcggttaggacttaagtactttaccgacgttcctaccgaacttatacgtaacgtacttcgtacgaactaacggtagtaaagttactttacgtaactacttttaatacgttcaaactaacgtaaattaacttaacgttaacgtttacgggtttacgaacgggtaacgtaaccgaacgttaacctaaaacgttaaaaccttacggtaactttcgggttaacgaccgttaaccgtacctaccttaccggtacgttttaccttacccgtttaacccgttaccttcccccggttaaccctacctacgtttccgtacggttaacc

SEQ ID NO: 140009 - DNA, 889 bp, Homo sapiens
  misc_feature: GYAE6OF01B3ZPC.46.67.G01.1.454.CMB.1.raw
tcagactagcagtacacgaccggtgctcgatttagagtatacatattgggtttgtcctcctgctggtggcagctccagatgggtcctgtccctggtgcaactgcagggacgtccgggcccacgacgtgggtgacggtccgttcggacgaccctcgtccctcacctgcgtctgtctcgtggtcgcctccatctagttagttcggtttcgttcggtgggtcgtcgggtccgacgacgccgtaccggaagggggaacggggtcgtaggtaactacgtagttacgggaagttcgtctactacgagttaggtcggttacgttaccgttaattaccgacgttcccgtccttacgtaacgaaacggtcgtaccggaacgtaccgaacctagttaccttcgtaccggtacggaccctaccgtaccgtaacgacttaagtccgttttacctttaccgaaggtaactaggttcggttacgttccgtacgtaccggaccgtcccgtacggttcggaacgggttaccgggtttaccgttttaagttcgttaggtacggacggtacggacggttaacggttacttaacggtttagtttacggttttaagggttttcgggttaaggttttaccggtttacctttaccggaaaccttaccggttaacggtacgggacccggggttaccgggtacccggtcccggtacccggggttagggaccggtaagggtaccggttacgttaccgggtaccgttaccgttcccgtaccggtacccgacccggtaacccgttacccggtaacccggggttcccctaccgggtttcccccgttacccccgttccccggtacccgtaccccccgtaccccgttacccgttaaccggaccggtaacccggtccccg

SEQ ID NO: 140010 - DNA, 863 bp, Homo sapiens
  misc_feature: GYAE6OF01DLAS8.46.67.G01.1.454.CMB.1.raw
tcagactagcagtacacgaccggtgctcgatttagagtatacatattggggtttggggagtctcggtcaggacacagcatggacatggaacgggtccccgctcagctccgtgggggctcctgctactctggctccggaggtgaccagatggtgactatcggacgctcggacccctagttcctaccacttcccctcccgttgttccgtcgacccgtaaccgggttaggggaagtaacgtacggttcgtaccaaccctactaccgtaaccgttcgggacccgggactaacgggttaccgaacttagttacgaacctaacgtttaattttaaagttcgtactacaaactagtaacgaccggacgggacccgacctaagccctacgtaatctagtcgcttagccttaacgtccgttaggttacgaacggaacgggtttaccgggtacccctaaggtcgggttaacggttcgacgggttacggtacggtagttacgggtacgttacgggaacggtaacgttaagtttcctttaccaccgtttcgtaacccgtaaccttacgttaaacgtaacgttacgttaccgtacggtaacgtaagttaacggtaagtttacgtttacgtaacttaaacgttttagttaacgtacgtaacctaaagtaacgtttaacctaacgtttacgttttacgggttaaaccgacgggtaaccggtaaacaaccgtttaaacgtaaacgttaaaacgttacgtaacggttacgtaccggtagtacccgaaaccgttaccttagttttaccgttaccgtttacctttaccgtacccggtttacccctaacccgttacgttaaaccttcgttaaacggttaaccg

SEQ ID NO: 140011 - DNA, 872 bp, Homo sapiens
  misc_feature: GYAE6OF01DEFJV.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcgaggagtcgggcccacgactggtgaggccttcggacgaccctgtccctcacctgcgctgtctcgtggtcgcctccatcgtagtagttggtttcttcggtggggcgtcggggtccgacgacggtccgtaccggaagggggaacggggcgtagggaacttaacgtaggtttagggaagttcgtacctacgtcgtaagttagggtacgggtacgtttacctaactttacgacggttccgtactctacgaaggtacgtcggaataccgaactagttactccgtacgtacggtaacctaccgttaccaaggtacctaacgttaccgtttaccgtttttacccgaaggtaaaggtagttacgggttacgtttcgtaccgggtaccggtacccccgtacggttaccgtaaccggtaaccggttaaccggggttttacgttttaaacggtttaccgttcgggtttaaccggaacgggtaacgggaacggtaccggttaactttaagttttagttaggttttaacggtttttaggggtaaggtttttacggtttaaccgtttaccggtaacccgttacccggttaacggtaaccgggttccggggtaacccggggttcccgtaaccccggggtcccgggtaccgggggaaccggtaaacgggttaaccgttccgggtaccggttaccccgtacccggtttaccccttaaccggtccccgtaccgtaaccccccggg

SEQ ID NO: 140012 - DNA, 749 bp, Homo sapiens
  misc_feature: GYAE6OF01BM223.46.67.G01.1.454.CMB.1.raw
  modified_base (200)..(200): a, c, t, g, unknown or other
  misc_feature (200)..(200): n is a, c, g, or t
  modified_base (261)..(261): a, c, t, g, unknown or other
  misc_feature (261)..(261): n is a, c, g, or t
  modified_base (298)..(298): a, c, t, g, unknown or other
  misc_feature (298)..(298): n is a, c, g, or t
tcagactagcagtacacgaccggtgctcgatttagagtatacatattggggtttggggagtctcggtcaggacacagcatggacatgagggtccccgctcagctcctggggctcctgctactctggctccgaggtgccagatgtgacatcgagctagaccctagtctccactccctccctgtcctcgacaccggtggganactagtcgtacacatcacgtgccggacagtacgactatcgactactattaatgtatacaanatacgaccgtagggaccgacctagtctactaatctangctgcatcgtgttacgacgtaacggtcgggtacctagtacggtaggttcgacggtcggtacgtacggttaggacgtcggtacgggtactaaggttaacctttcccgtaaccgttccgtaacccacccgtaacgttacggttaacgttaacgttccgtaacgtaaccggttaacggttaaggtaaacgtttcggttttaacaaacgtttaacctttacgttacgtaccgttaacctaaacgttaataacctttaacgttaaggttttaccggtttaaccgggaaccggtaaacggaaccgttaccgtaaacgtttaaaacgtaaaccgtttaaaccggacggttaccggtacggtaccctaggtaccccgtaccgttattacccgttcggtaccctttaccggtaaccctttccccgtaccccgtacgttacgttcggttacgtaaacccgg

SEQ ID NO: 140013 - DNA, 830 bp, Homo sapiens
  misc_feature: GYAE6OF01DHPHU.46.67.G01.1.454.CMB.1.raw
  modified_base (394)..(394): a, c, t, g, unknown or other
  misc_feature (394)..(394): n is a, c, g, or t
  modified_base (647)..(647): a, c, t, g, unknown or other
  misc_feature (647)..(647): n is a, c, g, or t
  modified_base (774)..(774): a, c, t, g, unknown or other
  misc_feature (774)..(774): n is a, c, g, or t
  modified_base (784)..(784): a, c, t, g, unknown or other
  misc_feature (784)..(784): n is a, c, g, or t
  modified_base (813)..(813): a, c, t, g, unknown or other
  misc_feature (813)..(813): n is a, c, g, or t
tcagactagcagtacacgaccggtgctcgatttagagtatacatattgggtttggggagtctcggtcaggacacagcatggacatgacgggtccccgctcagcctccgtggggctcctgctactctggctccgaggtgccagatgtgacatcgagctcgaccctgtcctcctactccctccgtgtactcgaccgtaaccggtgggaagacgtagttcgaccaacctactaccgtaccgttcgggacccggacgtaacggtaaccggtaactacgttaacgaacctaaacctttaattttaaaggttataactacctaaactaacggtaaccgaacccggtaacggggtaaccccggtaccttaagtaccctaacttaagtcttatcggtaaccngaccttaatttccggtaagttacggtaagtaaccgggggttcccggtaactaggttcccggtaaggtttacgaggttgggaaccgtagggttagggtactttaccggggtaaggtaacttacgggttaacttttacccaacctttccgaaacgttaactcgtaacgttaacgttactacggtaccgaacgtttaacgtaaggttaaatttttccgttacgtaaaccgtttatttaacgtcgtaacccttaaanaacgttaagtttaactttaacgtttaggtttacccggtaaaccggtaaccgggtaaacgtaaaccctggtaaaaccttaaacttaaacgtacggttagaaccggttccgacgttagacccaaagttnttaccggttntacccgttactttaccctcccgttaaacnttactacgttctaaacg

SEQ ID NO: 140014 - DNA, 1007 bp, Homo sapiens
  misc_feature: GYAE6OF01AY7CW.46.67.G01.1.454.CMB.1.raw
  modified_base (228)..(228): a, c, t, g, unknown or other
  misc_feature (228)..(228): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgacaactgcgaggaggtccgggcccacgacgtggtgacggtccgttcggacgaccctgtcccctcacctgcgtccttggttcctgtggtcnccctcagtcaggttacggttcggtttcttcggtggggtccgttcggggccgctacgtcccgtaccggaggggtaacgggcgtacggtaactacgtagttaggtaagtcgtctctctaagtggtacggtcggtttaccgttacttacgtacggttaccgtcctcgtaactaaggtacggtaccggtacctaccgtaacctacgtttacttaccgttaccggtaccgtaacccgtacccggtaaccgaacgtaaccgtaaaccgtttacgtttaccccggtttttaaccccgtaaggtaaacggtttacctttaaacgggttccggttttaacccgttcggggttaccccggtaacccgggtaacccccggtttcgttaacccccgggtaaccggggtttaacccgggtttaaccggttttttaaccgtttaccggttacggggtttacgggaccgggttaaacggggttaaccggtacccggtttacgttttaagttttacggttttacggtttttaaacggggttttttcgggttaagggtttttacccggggttttacgttttaaaccccggtaacccgtttaacccggttaacgggtcccggttaacccgggggtaaccccggggtttacccgttaacccccggggttacccccggggtacgggggtaaacccggttaaggggttaaacccgttacccggggttaccggttaacccccggttacccggtttaaccggtttccccccgttaaaccgcccccccggttaaaaccccggg

SEQ ID NO: 140015 - DNA, 788 bp, Homo sapiens
  misc_feature: GYAE6OF01EVHJS.46.67.G01.1.454.CMB.1.raw
tcagactagcagtacacgaccggtgctcgatttagagtatacatattgggtttggggagtctcggtcaggacacagcatggacatgacgggtccccgctcagctccgtggggctcctgctactctggctccgaggtgccagatgtgacatcgagtctacgaccctagtcctccacttccctccgtgtcgtgaccgtaaccgggtgggacgactagtcgtaccaaccgtactcctacgttcgggaccgggtactaacggtaccggaactagttaccgaaccttaactttaaagttttaaagtgtaactaccaaactacgtaaccggaacccggaacgggacccgtacccgtaaagtcccttaaccgtattaccgttagtcgtaccgttcgaccttacgtaccggtttaagggttaacgaacggttaacgggtcccgggtaactaggtaccgggtaggttcggaagggtcgaacggtaggtactcgtacggaggtactattaccttactacctactacccacgtactacgtaacttcgtacgtacgtaaggtaacttaggttaactttaactacgttaactttaaggttacttacgtaactaataaaggttattaacgtttaagggttcgtttaaccgggtaaccggaaaggttaacccgaaaccgtttaaacgtaaaacctttaaaacggtaaacgttacgcggtagtaccgtacgtacctaacgttcccgttatccggttcttaacctcttacccttaaccgacccttaatccgttaaagtctaaccg

SEQ ID NO: 140016 - DNA, 729 bp, Homo sapiens
  misc_feature: GYAE6OF01CAVE6.46.67.G01.1.454.CMB.1.raw
  modified_base (358)..(358): a, c, t, g, unknown or other
  misc_feature (358)..(358): n is a, c, g, or t
  modified_base (381)..(381): a, c, t, g, unknown or other
  misc_feature (381)..(381): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagacccctggtccctcacctgcgctgtctctggtcgcctccatcagtagttgtttccttcgtgggctgggtccgcagctcccgaggggaacgggctaggaatacgagttggaagtgtctctcagtgtggagttcctagttacagtccgtcttctcaagtcgtcgagtccaactatatccacgtggacaccgtccagactatcctagtttacccagaagntgtattctaggtacgccgtccgntacggaacgtacgggttctttacgttacgtggtacgtcggaagtacggtacggtacttacgtttataggtttagttttaggtagtttacgggtttaacttccggaactacccgtagtaccgtacgggtacggggtcctaccgggccccggtacgggggaccgtaacggggtaacgttaccggttacggtacccgtacccggttaccttaccggttacccgtaccccgacccgtaaaccccggtaccggggtaccccctaacgggtttcccccggttcccccgtttccccggtacccgttacccccgtaccccccgttaccgtaccccggtaacgtcccgttacccccg

SEQ ID NO: 140017 - DNA, 676 bp, Homo sapiens
  misc_feature: GYAE6OF01DSUIE.46.67.G01.1.454.CMB.1.raw
  modified_base (191)..(191): a, c, t, g, unknown or other
  misc_feature (191)..(191): n is a, c, g, or t
  modified_base (205)..(205): a, c, t, g, unknown or other
  misc_feature (205)..(205): n is a, c, g, or t
tcagactagcagtacacgaccggtgctcgatttagagtatacatattgggttggggagtctcggtcaggacacagcatggacatgagggtcccgctcagctcctggggctcctgctactctggctccgaggtgccagatgtgacatcgagctgacccagtctccatcctcctgtctgccaaccggtggganacgagtgtccaccntcacgttcggccgggacagtcggaactatcgactacttatttaacgtggtactacaacagtacgtaccgacgggaccggtaccctaaggccttacctaaacgttccgtaatcggtactggaccttatacccggttagttacgacgtaaggttccgggtacccagtacggtagtccaggtcgctagggtgactggtacggatacgtacttacggacttcgtaccgacttacgtactaacgttaactcgtaacacgttaacgtaagttagttaacgttcgtaacttaacgtttattaccggttaataaccgtaaattaacgtaaagtttactaacgtttcgggtttaacgaccggtacggaaaccgtacgtaaaccttaacttaaaacgtagttaacgtggtacggacttacggaaccctactgttaacctcggttactaccgttacgtacccttcgacttacgtctgtaccg

SEQ ID NO: 140018 - DNA, 684 bp, Homo sapiens
  misc_feature: GYAE6OF01AZ073.46.67.G01.1.454.CMB.1.raw
  modified_base (195)..(195): a, c, t, g, unknown or other
  misc_feature (195)..(195): n is a, c, g, or t
tcagactagcagtacacgaccggtgctcgatttagagtatacatattggggtttggggagtctcggtcaggacacagcatggacatgagggtccccgctcagctcctggggctcctgctactctggctccggaggtgccagatgtgacatcgagctcgacccagtctccatccctcctgtctgcaacggtggganacagtcgaccaccatctacgtcggccggactaaaggtccggaactagttcgaacctaacctttaatttaaagttcggtaactacaacagtacgacgacgggaccgtaccctaagcctactaatctagtgctgactacgtcctagttacgacgtaaggtccgggtacctagtacggtaggttacgaggtgacgtaggtgtacgtcggaggactagtcgttaccactcctacacctatacgaagttactcgtacgtacgtaacgtagtaacgtttacttacgaacgttaactttataacgttagtaaccaaacgttagttaaactttacgtaacgttttcggtaaccgaacggtacgaacgttaaccgaacttaaacgtaaacgttaacgtacgtacggtacgtaccgtaacgtaccgaaccgtttatacggttctttacccttaccgtaaccgtttccccttacccgtacttacgttcctcgtttaaccg

SEQ ID NO: 140019 - DNA, 922 bp, Homo sapiens
  misc_feature: GYAE6OF01ARHCA.46.67.G01.1.454.CMB.1.raw
  modified_base (585)..(585): a, c, t, g, unknown or other
  misc_feature (585)..(585): n is a, c, g, or t
tcagactagcagtacacgaccggtgctcgatttagagtatacatattgggtttggggagtctcggtcaggacacagcatggacatggacgggtccccgctcagctccgtcggggctcctcgctactctggtcctccgaggtgccagtatgtagacacgttcggacgtctaccgaccctagtccctccctaacttccccgttcccttacggtccgtacggaccgtaaccgggttgggaactaccgtagttccgtaccaacctcgttaccgtaccgttccggggccgggtaacgtaacggttaccggaaaccttaggttaccgtaaaccctaaccgtttttaaaagtttttaaaaccggtttcggtaaacttaacccgaaaacgttaacgggttaacccggtaaaccccggggaacgggggtaccccccgtaaccccggttaaaaccgtccccgttttaaaccctttaaacgttacgttaacggttccggtaaccgtacccggtacttacccttaaccggttagtttaccggaaaccggtttaacgggtcccgggttacctaacggtcggttaacggttcgtacggngggtaccgtaggtcggttacgtaccgggtagaacccgtacgttaccgttccctacgtacctaccgtactcgtaccgtaattacgtcgtaactaccgttaacgtaggtaaactttcgttaaccttaccgttaattttacccgttaattaaccggtaacaagtttaaccgttacgtttaaacgttcggttttaacggtaccggaacggttaccggaaccctttaaacggaacctaaaggttaaaccgttaacgtctacggtacgtccgtaagttaccctctcgttaaccctcgggtttcctacgttccttacccggtacctattcctaacgttgtaccg

SEQ ID NO: 140020 - DNA, 723 bp, Homo sapiens
  misc_feature: GYAE6OF01ECKZ7.46.67.G01.1.454.CMB.1.raw
tcagactagcagtacacgaccggtgctcgatttagagtatacatattgggtttggggagtctcggtcaggacacagcatggacatgagggtccccgctcagctccgtggggctcctgctactctggcctcgagtgcagatgtcgacagtcgagctcgaccacgtcctcctactccctccttcgtctacgaccgtaaccgggtagggacgacgtgttacgccaacctactccgtacgtttcggacggactaacggtacggtaactagttacgaccttaacttttaaagttaacgttacggtacttaaccaactaacgtaacggaccggaacggggtaccgtacccgtaactaccgtaccttaacgtcttacgtacgtcgtcgacctaccgtacgttacggttaacgtaacgtaacgggttaccggttaccgtacggtaccggttaggttacgtaggtcggaacggtacggtagtacggtcggtacgtactacggtacttactcctacactactacgtacgagtactacggtacaacgtacgtagttacgttacgttactaagttacttacttacgtactaactaagtagttaacttacgtacgtttacggtacgaacggtaacgtacgtaaccgtaaataacgtaaacgtaacgtagacgtcgtacgtctactacgttactatccgttactaccgtacttccctacgtactacgtctcgttacg

SEQ ID NO: 140021 - DNA, 854 bp, Homo sapiens
  misc_feature: GYAE6OF01AYUSY.46.67.G01.1.454.CMB.1.raw
tcagactagcagtacacgaccggtgctcgatttagagtatacatattgggtttggggagtctcggtcaggacacagcatggacatgacgggtccccgctcagctccgtggggctcctgctactctggctccgaggtgccagatgtgacagtcgagctcggacccagtcctccatccctccctgtctgccaaccggtgggacacagtcgtcaccatcacgttcggaccggacaaggtcggaactgttcgaactaccttaagtttaaagttcgtactaccgtaacagttacggaccgacggggacccgtacccctaagcctaccgtaattctaatcggtcctggcctaagttccctaggttttagaccgtaaacgggttcggggtacccctaggttccggtaaggtttccgaggttcgggtactagggttacgggtacttacgggtaacgggtaaccgtacggtttactttacgaaccgttccgtaacccgtaaccctagtttaaccgtaacggtttaacgttcccgttaacggtaaccgtaaaccgggttaaggttaaccggtttaacgtttttaccgaaaccggtttaaccttttacgttaacttacggttaaaccctaaaccggtaatttaaacggtttaactttacgggtttaacggtttttaccccgggaacggttaaacggggtaaccccgtaaaccgtttaaacctaaaaccggttaaacgttaaaccgggttaacttacgggtaacggtacccgttaacgggaccctaacggttacgttaccgttcggttaccttacccggttaccttaccccggttaccctacttccgttaacgtacggtttacccg

SEQ ID NO: 140022 - DNA, 720 bp, Homo sapiens
  misc_feature: GYAE6OF01ASXTS.46.67.G01.1.454.CMB.1.raw
  modified_base (212)..(212): a, c, t, g, unknown or other
  misc_feature (212)..(212): n is a, c, g, or t
  modified_base (219)..(219): a, c, t, g, unknown or other
  misc_feature (219)..(219): n is a, c, g, or t
  modified_base (257)..(257): a, c, t, g, unknown or other
  misc_feature (257)..(257): n is a, c, g, or t
  modified_base (277)..(277): a, c, t, g, unknown or other
  misc_feature (277)..(277): n is a, c, g, or t
  modified_base (395)..(395): a, c, t, g, unknown or other
  misc_feature (395)..(395): n is a, c, g, or t
  modified_base (586)..(586): a, c, t, g, unknown or other
  misc_feature (586)..(586): n is a, c, g, or t
  modified_base (654)..(654): a, c, t, g, unknown or other
  misc_feature (654)..(654): n is a, c, g, or t
tcagactagcagtacacgaccggtgctcgatttagagtatacatagttgggtttggggaggtctcggtcaggacacagtcatggacatgacgggtccccgctcagctccgtggggctccgtgctacgtctggctccgaggtgccagacttgtagacatcgagcctcgacccagtcctaccattcctcctagtctagccgaaccggtggaacncgacgtntccaccgatcctagtcggaccgacaacggtccgaactnttacgactacttaatttagngtacacagatagaccgagggtccgacctaagcctactactactcgtacgcttacgcttaaccttccgtagtttacggaaccggaggtttaccgggcctagtacccggtagtttacggngttacggactaggtacggtactcggtaggacttagtaccttaccgtacttcgacctaccgtataccgtaacttacgacgttaccgtacgaagtttacgtaaagttacgtttaccgtaacttaactttaactacgtacaactaaacgaatttacgtaagttacgttacgttacggtaacgacggaacgtaanaaccttaaaccgtaacgtttaacgacgttcgtacgaccgtaacgtaccgtaccgttatacccggtttnttacccggttaaccctaccccgtttaccgtacccccgttattaacccggtcgttaacttaacccgg

SEQ ID NO: 140023 - DNA, 813 bp, Homo sapiens
  misc_feature: GYAE6OF01C7ZT3.46.67.G01.1.454.CMB.1.raw
  modified_base (200)..(200): a, c, t, g, unknown or other
  misc_feature (200)..(200): n is a, c, g, or t
tcagactagcagtacacgaccggtgctcgatttagagtatacatattgggtttgggggagtctcggtcaggacacagcatggacatgacgggtccccgctcagctcctggggctcctgctactctggctccgaggtgccagatgtgactatcgagctcgacccagtcctccactccctcctgtctgccaaccggtggganagagtgtcaccatcacgttggccggactaaggtcggaactagttacgaacctaacttaagttttaaagttcggtactacaaactagtaacgacgaacgggaccggaccctaagcctacctaagtcttactgctcgctactccttagttcgaacgtaaaggtccgggtaccatccggtaggtacgtacggtaggacgttaggtacggtagttccggtaggggtaacgtacgggttactttaacctaccgttacccttaccgacctattaaccgtacgttaaacgttcgtacgtaaccggtaacgttaaccggttaaaagtttaccgttttaagtaaccctttaaactttaacgtttaccgttaacttaaccctaaaaggttaacgttaaacgttttaacgtaaccgggtttttacggttttaacccggggaaccggttaaaccgggtaaacccgtaaccggttaaaacccttaaaacgtttaaaaacgggtaaacccgttaaacggttggtaccggtaacctcggaaacccgtacgttaacgttcccgtttacgtaccgtttaaccctacctttaccccggttcccacccgtttcttaccgtaaccgttaaccg

SEQ ID NO: 140024 - DNA, 839 bp, Homo sapiens
  misc_feature: GYAE6OF01BIINS.46.67.G01.1.454.CMB.1.raw
  modified_base (222)..(222): a, c, t, g, unknown or other
  misc_feature (222)..(222): n is a, c, g, or t
tcagactagcagtacacgaccggtgctcgatttagagtatacatattgggtttgggggacctcctgtgcaagaacatgaagcacctgtggtttgtcctcctgctggtggcagcctcccagatgggtcctgtccctggtgcaactgcaggagtccgggcccacgactggtggaggccgttcggacgtaccctcgtccctcacctgcgctgtcctcgtgggtcnccctaccgatacgtaggtacggtttcggttttccgttcggtcgggggcgttcgggggtccggacgacgtccgtaccccggaagggggaacggggcgtagggtaaactaccgtagttaggaagttcgtacctcgtaccaagttagggtacggttacggttccttaagttaaccgacggttcccggtactacctacgtaaggtacgtaccgtagtaccctacgtattaactcgtaccgtacggaacctccggtaaccacggtacctaacgttaccgtttaaccgttttcccaaggaacgtacgtggttaacgttcgtacggtacgaccccgggtccgtacgtaccggtaaccggttacgggttcttttaacgttaccggtggttcggaccggtaaggtaccggtacggttaccgtttaagtttacggttaagtttcggttttagggtaaggtttacgttttacgtaaccgtacccgtaccgtaggtcggttaccggggtcccggtaaccgtccccgggaccgggtaccggggaccgttaaacggggtacgttacccgggttacccggtacccgttacccggttacccgtttcccgttccggtacccgtaaacccccggg

SEQ ID NO: 140025 - DNA, 916 bp, Homo sapiens
  misc_feature: GYAE6OF01CV1X4.46.67.G01.1.454.CMB.1.raw
  modified_base (172)..(172): a, c, t, g, unknown or other
  misc_feature (172)..(172): n is a, c, g, or t
  modified_base (273)..(273): a, c, t, g, unknown or other
  misc_feature (273)..(273): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctcgtggtncctccatcagtagttggtttcttcgtggggtctcgggtccggacacgccgtaccgaggggaaggggtctaggaactactagttggaagttgtaccgtctanaagtaggtggtacggttaccttaagttacgtaacgttccgtctactacgaaacgtacggtacggtaagttccaaacctagttaacttccgttaccggtaccggtaaccctaacggttacccaacggtaccttaaaacttcccgtttaaaccgttttttaccccggaagtaaaggttaacgttcggtaacgttttccggtacgtaacccggtacccggtcccgtaccggttcggaaaccgggtttaccggggtttacctttttaacggttacgtttacgggacgtacgggaacgggttaacgggtacgggttaaccttttaagtttaaccggtttagggttttaagtttttagggggtagtttttacgggtttaactttacccgaacccgttaaacccggtaaggtcggtttaaacccgggggccgggttaccgttacccccgggtaacccgggtacgggggaccgtaacggggttaacttaccgggttactccggtaacccgttcccttacgttacccgggaccttacccgtaaacccggtaccgggtaccccgttaccggtacccccggttttcccggttcccccgtacccgggttaccctaacccccctttacccggaaccgaaccggtcgtaacccccgg

SEQ ID NO: 140026 - DNA, 646 bp, Homo sapiens
  misc_feature: GYAE6OF01ENKI7.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccggtgggacgacagtcgtcaccatcacgttcggccggacaagtcggaactattcgaacctaactttaatttaaagttggtactacaactaagtaacgaccggaacgggaccgtaccctaagcctacctaatctatcgctgtactactccgtagttacgacgaaacggttcgggtaccctagtcggtaggttacgaggtcgacgtaggtggtatcggtagggactaaggtactttcgactcctacgacctagtactaacgtatcgtacgacgtaaggttataagttactttacgacttaacttattacgtactaacaaactagtaacttaactagtttacgttacggaacctaacggactaacgtaacgttaaactaaacgttaacgtacgtgtacggtacgtacgaccgtactactcgttcgttacctctaccttccctacccgatcgttcgtgtaacccg

SEQ ID NO: 140027 - DNA, 716 bp, Homo sapiens
  misc_feature: GYAE6OF01ET77O.46.67.G01.1.454.CMB.1.raw
  modified_base (97)..(97): a, c, t, g, unknown or other
  misc_feature (97)..(97): n is a, c, g, or t
  modified_base (239)..(239): a, c, t, g, unknown or other
  misc_feature (239)..(239): n is a, c, g, or t
  modified_base (320)..(320): a, c, t, g, unknown or other
  misc_feature (320)..(320): n is a, c, g, or t
tcagactagcagtacacgaccggtgctcgatttagagtatacatattgggtttggggagtctcggtcaggacacagcatggacatgagggtccccgntcagctcctggggctcctgctactctggctcgaggtgccagatgtgacatcgagctgacccagtctccatccctccctgtctgacaaccggtgggagacagtcgtaccaccatcctaacttggccgggacaaggtcgaaacnttgactaacttaatttaaattggtatacaaacagtaacgaccgacgggaaccggaccctaaagtcctacctaatccttaancgctgactatccgtagtttacgacgtaaaagggtcgggtacccagtccggaggtttcaggtggacaggtggactggagggaacagtactttcgactctacacctatacgaagttaactcgtagaaccgtaacggtagtaaaggtattttacgaacgttaaactttaacttaacgttacgtaaaccgaaacgtaagttaaactttaacgttaacgtttacggttttaaccgggaaaccggtaaacggggtaacccaaacggttaaacttaaaaccgtaaaacgttaaaacggtaacgttacgggtacggtacctacggtacctaaaccgttacttaccgttacgttacccttactaaccgttcccgttaccccgtaactacgttacgtaagtaaccg

SEQ ID NO: 140028 - DNA, 826 bp, Homo sapiens
  misc_feature: GYAE6OF01DE1X8.46.67.G01.1.454.CMB.1.raw
tcagactagcagtacacgaccggtgctcgatttagagtatacatattgggttgggggacctcctgtgcaagaacatgaagcacctgtggtttgtcctcctgctggtggctagcctcccagtgtcgggtcctgtccctggtgaccaactgacgaggtacgtcgggcccacgactgggtagacggtccttcgggacaccctgtccctacacccgtggtcctcgttctccgtcgtcggtacctccctacctatccgtaaggttagttcggtttctcggttggggacgttcgggtccgcgtacgtccgtaacgggaaggggacggggtcgtaacggaattaccgtaagttgggtaagttcgtcttacgataggttaacggtacggggtacgtttacctaacgttaccgtacggttcccgtactccgtaacgaaacggttcgtacggtacacctacgtatcttacgtcgtacggacctacgaccacgtacctaattccgtacttttccaaggaacgtggttcttacggtctacggtccgtaccggtcctcggtacgtacggtaggttacgtttaacgttccgggtaagtccgggtaaacgcgggttaacgtacccggttatttaaagttacgggtttaccggttttaagggttttcgggttaacgggttttaacgtttacggttacccgtaaacccggttccggtaacggtacggtaccggggttaacccgggtccgtacccgtaccgggggtaccgggtaaccggttaggggtaaaccgtcgtaccggtaccgtacccgtttaccgtaccgtaacccgtccgtaacccgg

SEQ ID NO: 140029 - DNA, 798 bp, Homo sapiens
  misc_feature: GYAE6OF01E02AA.46.67.G01.1.454.CMB.1.raw
  modified_base (99)..(99): a, c, t, g, unknown or other
  misc_feature (99)..(99): n is a, c, g, or t
  modified_base (790)..(790): a, c, t, g, unknown or other
  misc_feature (790)..(790): n is a, c, g, or t
tcagactagcagtacacgaccggtgctcgatttagagtatacatattgggtttgtcctcctgctggtggcagctcccagatgggtcctgtccctggtcncaactgcaggagtccgggcccacgactggtagaggccttacgggacacccgtgtccctcacctgcgtctcgtctcgtggtgcctccgatcgagttacgttgtttctcgtgggtcctagggtccgcacgcctaccggagggaagggctaggaactcgagttggaagttctcgtactacgaagttacggtgacggtttaccgtattacgacgttcccggttcttacgtacggaagtacggtacgtacggtacctaaccgtattacgtaccttcgtacggtaccgtaccggtacaacgtactaaccgtacgtttaactttcccgtaaggaacgtacgtagttacggttcctacggtaccgtaaccgggtcccgtaagttacggaaccggttaccgggttaacgtttttacctacggttacggtcggaacggtacggtaacggtaaccggttacgttaagttttacgttaagtttacggtttaaggtacggttttacggtttaccgtttaccgtaaccgtaaccgttacggaccggtacgggtaccgggttcccgacccgggttaccggaaccgggtaccggtaggtaaccgttcgtacgtaccgtaccgttcctaccgttaccgaccctaccgtaacggacccgtcgtaccgtcccgtcccgttcccaccggtccctaccggtaccctacgacnccgtaccg

SEQ ID NO: 140030 - DNA, 839 bp, Homo sapiens
  misc_feature: GYAE6OF01BJBV3.46.67.G01.1.454.CMB.1.raw
  modified_base (825)..(825): a, c, t, g, unknown or other
  misc_feature (825)..(825): n is a, c, g, or t
tcagactagcagtacacgaccggtgctcgatttagagtatacatattgggtttgtcctcctgctggtggcagctcccagatgggtcctgtccctggtgcaactgcgaggagtccgggcccacgacgtggtgaggtcccttcgggacgacccctcgtcccctcaccctgccgtctgtcctcgtggtcgccctcatcgagttagttcggtttctcggtgggccgttcgggaccgtcgacgccgtacccggaaggggacggggtctaggaactacgtagttagggaagttcgtcctctagagtaggtcggtacgttacctagttacgacgttccgtcctacgtacgaaggtacgtacgacggtaccaacgtattactcgtccgttacggacctaccgtaccgacgtaactaacttccgtttaaccgttttaccgaaggtaacgttacgttacggttacggttttccgtacggtacccggacccggtcccggtacggttaccggtaacccggttaccgggttttacgttttaaacgtttcgtcggggtaccggtaacggtaacggtacgggtacgttacgttaagtttcgtttagttttaaggtttgggtacgttttacggttaccttaccggtaaccttaccggtacggtacgggttcccggggtaccgggttccccgtaacccggaccccggggttagggaaccggaacggggttacctacgggttcgtaccccgaccgttccgtactcccgcccgtaacccgtaacggcggttcccaccggtttccccgccccttcccggacctccccgtaccctaaccgtacccncggtaccctcccgg

SEQ ID NO: 140031 - DNA, 882 bp, Homo sapiens
  misc_feature: GYAE6OF01EZUXQ.46.67.G01.1.454.CMB.1.raw
  modified_base (207)..(207): a, c, t, g, unknown or other
  misc_feature (207)..(207): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcgcctcatcagtagtggtttctgtgggctgggtccgnagctcccgaggggagggctaggaatacagttagggaagttgtctctactagtaggtggtacgtttaccttagttacgacgttccgtctctacgaagtacggtacgacgtccaaccgtattacgttccgtccgtagggtaacccaccggttacccaaggtacctaaacgttccgttaacggtttttaccccgtaaggaaaagtacgttagtacgtttcgtacggttccgacccggtccgtacgtaccggtaaccggttacggggtttactttttaaacggtacccgttgggtaccggaccggaaggtaccgggttacggtacttttaagtttacgtaggtttttaaggtttttggggaacgttttacggttttaacgttaccggaaccctacccgggttaagtacccggttacccgggggtaacccgggggtccttaccccggggaacccgggttcggggggaacccctaaaggggttaaccgttaccggtttaccgggtacccttaccccgggttcctttaacccggttacccgaccccccggttaaacccgaacccggggtaaccccgggtcccccttaacgggtttacccccgggttccccctttaccccccgggtagtacccccccttaacccccggttcccctaaacccggtaaccggaccttcccccggg

SEQ ID NO: 140032 - DNA, 747 bp, Homo sapiens
  misc_feature: GYAE6OF01B58ST.46.67.G01.1.454.CMB.1.raw
  modified_base (99)..(99): a, c, t, g, unknown or other
  misc_feature (99)..(99): n is a, c, g, or t
  modified_base (127)..(127): a, c, t, g, unknown or other
  misc_feature (127)..(127): n is a, c, g, or t
  modified_base (241)..(241): a, c, t, g, unknown or other
  misc_feature (241)..(241): n is a, c, g, or t
  modified_base (308)..(308): a, c, t, g, unknown or other
  misc_feature (308)..(308): n is a, c, g, or t
  modified_base (633)..(633): a, c, t, g, unknown or other
  misc_feature (633)..(633): n is a, c, g, or t
  modified_base (656)..(656): a, c, t, g, unknown or other
  misc_feature (656)..(656): n is a, c, g, or t
  modified_base (676)..(676): a, c, t, g, unknown or other
  misc_feature (676)..(676): n is a, c, g, or t
tcagactagcagtacacgaccggtgctcgattagagtatacatattggggtttggggagtctcggtcaggacacagcatggacatggacgggtccccgntcagctccgtggggctcctgctactcgnggctccggaggtcgaccagtatggtagactagtcgagctacggacctagtcctaccattcccgtaccctggtctacggacgtaaccgggtgggaacgacaggttcgaccaaccnctccgacggttcggaccgggataaacggtcgaaactgttacgaaccttaactttaaattttaaacgnggtaactacaactagtaacggaaccggtaacggggacccgtaaccctaagtccgttaacctaaacttcgtaacgttcgtcgctacgtaccttaccggttagttacgaccggaaagggttcccgggtaactacgttacgggacgttagacggtcggacttagggtccggtagtacggtacggataagttcgttacgtactactaaccgatagtaactagtactccgtatacgtaacgtaaggtagttaacttacgaacgttaattacttacgtagaacctaaagtacttaaattacgtaagttacgttacggaactaaccggtaanaaccgtaataaacgtaaagtaanacgtaggttcgacggttaanacctaacgttataccgttcgtttaccttactacccggttaacctttaccccggatttacgtcgtaactacg

SEQ ID NO: 140033 - DNA, 781 bp, Homo sapiens
  misc_feature: GYAE6OF01DU36I.46.67.G01.1.454.CMB.1.raw
  modified_base (196)..(196): a, c, t, g, unknown or other
  misc_feature (196)..(196): n is a, c, g, or t
  modified_base (199)..(199): a, c, t, g, unknown or other
  misc_feature (199)..(199): n is a, c, g, or t
tcagactagcagtacacgaccggtgctcgatttagagtatacatattgggtttggggagtctcggtcaggacacagcatggacatgagggtccccgctcagctccgtggggctcctgctactctggctccggaggtgccagatgtgacatcgagctgaaccagtcctccattccctcctgtctgcaaccggtgganacngtgcaccatccacgttcggaccgggacaaggtccgaactattcgacctaaccttaatttaagtgtatacaacatacgaccgagggaccgaccctaagcctactaactctagtcgactgacctacttccgtaggtttcgaacgtaacgggtccgggtaccctaggttacggtaggttcgaggtcggacgtaggtaggtactcggtagggtactagttacgtttaccaccgttcacctaactactacgtaattaactctacgaccttaaggtacgttaagtttatttacgtaacctttaaacgtttacttaacgttacgtaacctaaacgttaagtttaaaccttaacggttaacggttttacggtttaacccgggaaaccggttaaacgggtaaaccgttaaccggtaaaccgtttaaaaccgttaaaacggttaaaccggtaaacggtttccgggtaaccggtacccgttaacggtaccccgtaaccgtttaactttacccggtttacgtttacccgttttacgttaaccctttccccgttaacccccggtaactttccggtttaacccgtaggttaaaccc

SEQ ID NO: 140034 - DNA, 705 bp, Homo sapiens
  misc_feature: GYAE6OF01B4IA9.46.67.G01.1.454.CMB.1.raw
  modified_base (294)..(294): a, c, t, g, unknown or other
  misc_feature (294)..(294): n is a, c, g, or t
  modified_base (351)..(351): a, c, t, g, unknown or other
  misc_feature (351)..(351): n is a, c, g, or t
  modified_base (360)..(360): a, c, t, g, unknown or other
  misc_feature (360)..(360): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactgggtgaggccttcggacgaccctgtccctcacctgcgctgtctcgtggtcgcctcatcgagtagttggtttctcgtggggctgggtccgcagctccgaggggagggctaggaatacagttggaagtgtctctgagtggtggtaggttcctattacagttccgtctctanaagagtcgagtcaaccatactctcgtagacacgtccagcaatctacgtttccagaantgtagttcngtcgaccgccgctacgacgtacgggttacgtttattaccgtggtacgcggtaaggacggtacggactttaattagttaggtttagttttagggtaaggtttcggtttaacgtttacgtaccgtacccgttaaggtcgttacgggaccgggggtaccttcccggacccgggttcggggaaccgtacgggtaacgttacgttacggtaccgtacccgttccgttacccgttacggtccctaacccgaaccggtaaccggggtcccttaaccggttcccggttaccccgttccccccggtacgtcccccaacccccgttacccgtaccccgtaaggtcccgtacccgg

SEQ ID NO: 140035 - DNA, 688 bp, Homo sapiens
  misc_feature: GYAE6OF01D4O3A.46.67.G01.1.454.CMB.1.raw
  modified_base (194)..(194): a, c, t, g, unknown or other
  misc_feature (194)..(194): n is a, c, g, or t
  modified_base (335)..(335): a, c, t, g, unknown or other
  misc_feature (335)..(335): n is a, c, g, or t
  modified_base (667)..(667): a, c, t, g, unknown or other
  misc_feature (667)..(667): n is a, c, g, or t
tcagactagcagtacacgaccggtgctcgatttagagtatacatattgggtttggggagtctcggtcaggacacagcatggacatgacgggtccccgctcagctcctggggctcctgctactctggctccgaggtgccagatgtgacatcgagctgacccagtctccatccgtccctgtctgcaaccgtggganacagtcgtccaaccatccacgttcggccgggactaaggtcggaactattcgaactaccgtttaatttaaagttggtaactacgaaactagtaacgaccgaacgggtacccggtaccctaagccttacttaagtccttatcncgtgactactaccgtagtttcacgtaaggtcgggtacccagttcggtaggttcagtcggactaggtcgatcggtaggactaagtactttcacgtctacactgtactagtactcgtacgaacgtacgtagtaaacttagtttacgaacgttaaactttacttacggttaacctaaacgaaacgttaagttaaactttaagttaacgttacgttttccggaacggtaacggaacctaacgttaaactaaacgtaaacgttaacgtaagttcgtacggtcctaggacctaccgttattacttccgttacttaaccctaccgttcccgttaacccncgttaacttacgcgttaaccg

SEQ ID NO: 140036 - DNA, 719 bp, Homo sapiens
  misc_feature: GYAE6OF01BMC6P.46.67.G01.1.454.CMB.1.raw
  modified_base (220)..(220): a, c, t, g, unknown or other
  misc_feature (220)..(220): n is a, c, g, or t
  modified_base (261)..(261): a, c, t, g, unknown or other
  misc_feature (261)..(261): n is a, c, g, or t
  modified_base (429)..(429): a, c, t, g, unknown or other
  misc_feature (429)..(429): n is a, c, g, or t
tcagactagcagtacacgaccggtgctcgatttagagtatacatattgggtttgggggacctcctgtgcaagaacatgaagcacctgtggtttgtcctcctgctggtggcagctcccagatcgggtcctgtccctggtgcaactgcaggagtccgggcccacgacgtgggtgaggcccttcgggacgaccctgtcccctcacctgcgctgtctctggtcncctcatcgtagtagttgtttctcggtggggctcgggtccgnacgccgtcccggaggggacgggctaggaactacgtagttaggaagtcgtctctcgaattggtcgggtacgtttcctaattaccgacgttcccgtctctacaagtacgtcgacgtaccaccatactctcgtagaccaccgtcagacaatcgttaccgtttaccagactntgtacgttctcgtacgaccgtccgcgtacgtacgtacgggttctttatcgtgtacgacgagtacggacgtttcgtaagtttcgttaggtttacgttttaggggtagttttaggttttaaccgtttcggaaccccgttaacgtagggtaccggtaccggggtacccgggggtcccttaccccgggtccccggggttaggggacccgggtaaagggtaaccgttaccggttaccgggtaccgttacccccgtttcccggtttaccccttacccggtccccgtaaacccccgg

SEQ ID NO: 140037 - DNA, 820 bp, Homo sapiens
  misc_feature: GYAE6OF01C0VSY.46.67.G01.1.454.CMB.1.raw
  modified_base (146)..(146): a, c, t, g, unknown or other
  misc_feature (146)..(146): n is a, c, g, or t
tcagactagcagtacacgaccggtgctcgatttagagtatacatattgggtttggggagtctcggtcaggacacagcatggacatgagggtccccgctcagctccgtggggctcctgctactctggcctcggaggtgccagatgtnacatcgagctcgacccagtcctccactccctcccgtgtctacgaccgtaaccggtgggacacgtaggtcgtaccaaccgtactccgtacgttcgggaccgggacgaaacggtcggtaaactacgttacgtaacctaaccttttaaagttttaaacgttacggtaacttaacaaacgtacggtaacggaacccggaaggggtaccccgtacctaacgccttacttactacgtagtcgtactacgactacgtacttacggttacgaacggttaacgggtcggtaccctaggtacggtagttacgacggtcgtagtacggtagtacgttcggaggtacgtactacttaccgactcgtaacctagtaactacgtaagttactcggtaacgacgttaacgtaagggtttaaccttacgtttaacgtaaccgttaaattttacggttaccgttaagaaccgtaaattaacggtttacgtaagttaccgtttaagggtttcccggttaacgggacccgtaaagggttaaccccctaaaagggttaactaaaaccgttaaaggtaaaccccgtttgggtacggtaacggtaccttaacccgggtactaccgtttaacttcccgtttcgtaaaaccctttccgtaaccctttccccggaaccctccttaaaggtccttaacgg

SEQ ID NO: 140038 - DNA, 613 bp, Homo sapiens
  misc_feature: GYAE6OF01BD314.46.67.G01.1.454.CMB.1.raw
  modified_base (218)..(218): a, c, t, g, unknown or other
  misc_feature (218)..(218): n is a, c, g, or t
  modified_base (355)..(355): a, c, t, g, unknown or other
  misc_feature (355)..(355): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacgttgccgggnaagtcggaacattgacactatttaaatgtatcaacatagaccagggacgccctaagctcctaatctatgctgcatccagtttgacgtaaagtcggggtacccatcgaggttcagtggcaggtgatcgtgggacagtntttcactctacacatacagtaatcgtagactaacggttgaaacgttattttacgactaaactttatttaccgttagtacctaaataacgttaaatttaacgtaaagtttcggttttacggaaccgtaaggggtaacctaacgtaaccgttaaactaaacgttaaacgaaccttaggtacggtactacggacctacctaattcgtcgttaccttacgtaacctttccttacccccgacctaactttccgtagttaaccg

SEQ ID NO: 140039 - DNA, 984 bp, Homo sapiens
  misc_feature: GYAE6OF01BXPTU.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtccgggcccacgactggtgaggccttcggacgaccctgtccctcacctgcgctgtctctggtcgcctccatcagtagttgtttctcgtcgggctgggtccgcagcctaccgaggggacgggctggaatacattaggagtcgtctcgtcagtaggtggtaggttcctattacacgttccgtcttcctagaagacgtcgaacgtccaactattacttccgtacgtacggaactaccgtccgagtactattaccgttacgttttacccgtaggtaaacgtcgtacggttacggtttacgtcggtacccggtaccccggtcccggtaccgttacggtaacccgggttacccggggtttacgttttttaacggttaccgttcgggtaccgggtaacgggtaacgggtaaccgggtaaccggttaaccgtttaagttttaaggtttaacggttttagggtttttaacggggtaacggttttacgggttttaaccgtttacccggtaaaccccgttaacccgttaacggtaccggggttaacccggggtacccgggggttaccccggttacccccgggaacccccggggttacggggtaacccccggttaaaagggggtaacccgtttaaccgggttaccgggttaaccccgttaccccgggtttaccccgtttaacccgggttaacccggttaccccccggttaaaccccgggtaaacccccgggtaaccccgggggttaccccccgtttaacccgggggtttcccccccggtttaccccccggtttccccccccgggttaacccggggtacccccccttaacccccggtttaaccccggttaacccccggtaaacggtacccccgggtaaccccccggg

SEQ ID NO: 140040 - DNA, 868 bp, Homo sapiens
  misc_feature: GYAE6OF01CPY0G.46.67.G01.1.454.CMB.1.raw
tcagactagcagtacacgaccggtgctcgatttagagtatacatattggggtttgggggacctcctgtgcaagaacatgaagcactgtggtttgtcctcctgctggtggcagcctccagatgggtcctgtccctggtgcaactgcgaggacggtccgggcccacgacgttgggtaggacggtccgttcgggacaccccgttcgtcccctacaccgtgcgcttcgtctcgtggtcgtcctacctatcgaggtttacggttcggttttccgttcgggtcggggtcggttccggggccggtcacggtcccgtacggaaggggggtacggtcgtaggaactacgtaggttaggaagttcgtacctacgacgtaagttacgggtggggttaccgtttacttaacgttaccgtacggtttccccgttacttacgtaccgtaaaggtcgttaccggaacgtacctaacctaagttccttacgtcggtaacgaaccgtacccgtacgaacgtaacttaactttaccgttaccggttttaccgtaagtaaacgggtttacgtcggtttacgtttccgaacgggttccgacccgggtccgtacggtaaccggttacgggtttaaccgggtttaccgttttatcgggttacggtcggtaaccgggtaaggaaccggtttacttagtttaagtttaaggtttacggttttaacgggttttgggttaacgttttggttttaaaccttaccggtaaccctacggtgggtacccggtacgggggtacccgggtacccgtaacccggggtcccgtaggggaacgaaacgggttaccgtcggtacgttcccgactttacccgttccgtaaccgacccgtacccgg

SEQ ID NO: 140041 - DNA, 901 bp, Homo sapiens
  misc_feature: GYAE6OF01BOY72.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccggagtgccagatgtgacatcgagctacgaccagtctccatcctccctagtctgccaaccggtgggacacacgtcgtaccacctatcgacgttcggaccgggactaacggtcggaaacctagttacgaacctaaccttaaggttttaaactggttaactactaaaaccgtaattaacggaacccgacgggggtaaacccggtaccccttaaaacggtccttaaccccgttaaacgtttacctaacggttaacgtcccggtcggttaaccaaccgttacccgtagggttttacgaacggttaaaaacggggttcccgggggttacccctaaaggttcccggttaaaggtttacccggtaaaggttacggggtccctaaggggttacccggtaagttacccggttacgggggaacctaacgggttttaaccttttaccgtaaccggtttacccttaaccccggtaaaccgaaccttttaaccgtaaacgtttaaacttccggttaaccggtaaacgttaacccggtaaagggttaaaccgtttacgtttttacgggaaactttaaaaccccttttaagttaaacccgtttacggtaactaaaacggacggtttaaactttaacgtaacgtttacggtttacccggaacggtaacggtaactaaccgggtaacttaaactaaacgttaaacgaaccgttgtacggtaccgttacacctacgtactcgttaccgtactttaccacgttccctaccgtaccctattcgtggttaaacc

SEQ ID NO: 140042 - DNA, 976 bp, Homo sapiens
  misc_feature: GYAE6OF01EIZ94.46.67.G01.1.454.CMB.1.raw
  modified_base (266)..(266): a, c, t, g, unknown or other
  misc_feature (266)..(266): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgacgtggtgaggcccttcggagacccctgtccctcacctgcgctgtctctggtcgcctccatcagtagttggtttcttcgtggggcgtgggtccgcacgcctcccgaggggaacgggtctaggaatacagttggaagtgtctctnagtggtggtagttccttattacagttccgtctctacgaagtgtcgagtaccacctattactcttcgtacggaccaccgtccacgtactaacttaccgttaccgtttttacccgtaaggtaaacgtagttacgttaacggtttaccttcgggtacccggtaccccggacccggtaccggttaaccggaacccgggttaaaccgggggtttaccgttttttaaacgtttaaccgggttcggttacgggaaccgggaaggggttaacccgggtaaccggttaacgttttaagttttaacggttttaggtttttaagggtttttaggggtttaacgttttaacggggttttttaaccgtttaaccccggtaaccccgttaaaccccggttaacgggttaaccgggtaccccggggggttaacccggggggttaccccgttacccgggggtaaccccccggggtcggggggtaacccgtaaagggggttaaccctttacccggggttaccggtttaccccgttaccccggttccccgtttacccggttaaccccggtcccccgttaaccccggtaaaccccgggtacccgggggttacccccctaccgggttttcccccgttaccccccggttttcccccccggaccccgggttaacccccgtacccccccgttaaccccgtaacccggaaacccgggtcgtaaacccccccggg

SEQ ID NO: 140043 - DNA, 926 bp, Homo sapiens
  misc_feature: GYAE6OF01EB1LN.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagcctcccagatgggtcctgtccctggtgcaactgcagggacgtccgggcccagacgtgggtgacggtccttcggacgacccttgtcccctcacctgccgtctgtctcgtcgggctccctctatcgtaaggttggtttcggttttccttcgggtcgggggtcgttcgggggtaccccggacgtaaccggtccggacccgggtaaaggggggtaacggggtaccgtaagggtaaacttaacgtaggttacgggtaaagttcgttacctctacgtagttaggtggtaccggttcctaagttaccgtcggttacccgtctacgtaacgaaggtacgttacgacgtaccctaaccgtaattaccttacgtaccgtacggaacccgtaccgtaacccgtaacggaacttaacttccgtttaacccggttttacccgaaggtaaaaccggttattacgggttaacgtttccgacggttaccccggaaccccggtccgtaacgtaccgggtaacccgggtaaccggtttacgttttaaccgttacgttagggtaaccggtacccggtaagggtaacccgggttacgtttaacgtttaaggttttaacgttaggtttttaacggggtttcgttaagggtttttaccgtttaacgttttaaccccggaaccttaccgttaagggaacccgggttcccggggaaacccggggttccctaaccccggggttaacccggtggggtaaaccggtaagggttaaacctcccgggttacccgttcccgaccccgtttcccgttacgttcccggacccttaaacccccgggg

SEQ ID NO: 140044 - DNA, 809 bp, Homo sapiens
  misc_feature: GYAE6OF01CDF5G.46.67.G01.1.454.CMB.1.raw
  modified_base (467)..(467): a, c, t, g, unknown or other
  misc_feature (467)..(467): n is a, c, g, or t
  modified_base (557)..(557): a, c, t, g, unknown or other
  misc_feature (557)..(557): n is a, c, g, or t
  modified_base (683)..(683): a, c, t, g, unknown or other
  misc_feature (683)..(683): n is a, c, g, or t
tcagactagcagtacacgaccggtgctcgatttagagtatacatattgggtttgggggacctcctgtgcaagaacatgaagcacctgttggtttgtcctcctgcgtggtggcagcctacccagtagttcgggtcctcgtcccgtggtcgaccaactgcgaagggcggtccgggacccacggtacgtgggtcggacggtccgttcggacgtaccccgttcgtcccctcgacccgttgccgtcgtcgtccgttccgtgggtcctcccgttaccagttcgtaaggtttggtttcgggtttccgtttcgggtacgggggtccggttccggggtacccggacgtaaccggtcccggtaacccggggaaggggggaacggttcgtaagggtaaactacggttaaggttaggtaacgttcgtactacgtataggtcggttaggtaccgttacttagtaccgtaccgtaccgttntaaaccgtagtaaacggcgttacggtaacctcctaactagttacctctcgtaacggacctacgtacacgtactacgttctaccggtttanacgtaagtcgttgtacgttcgtacgcccggtaccgtcgtacgaggttaccgtacggttatttacgcgttgaggaacgtagtagacgtattaactggttgtttaggttagttacggttagtttaccnctaaccgtcgaagggtccgggtccgggttccgggacctaaccccggggttcggacccggtaggtaaccgttacgtccgggaccgttacccttacggtccttaacggtccccggacccttaaccggg

SEQ ID NO: 140045 - DNA, 833 bp, Homo sapiens
  misc_feature: GYAE6OF01DH3NW.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctcgacccagtcctcctatccctccctgtctgacgaaccggtgggacgacaggtcgtaccacctatccgtacgttggcccggggtacaaacggtaccgggaaactacgtttacggaacctaaccgtttaatttttaaaagtcggttaactaccgaaactacgtaacggaacccggaacggggtaacccggtaccccgttaagtacccgttaaccccttaaaattaccgttaaacgtcgggtaccttacggtaaccttaacttacccgtaaggttttacgaaccggttaaaacgggttccggggtaaccccgtaagtcgggtaacggtttcgaacgggtacggtacgtaggtaggtacgtacgtacgggactagtactttacactaccgtctaaccattacgaacgtaactaccgtagacgtaacgttagtaacgttagtttacgtaacttaactttacgttaacgtacgtaaccgtaaacgttaacgttaaacttaacgttaacgtttacgggtttaaccggaaaccggtaaccgggaaccgtaacgtaaaccttaaacgtaaaaaccgttaacgggaaccgttagggtacggtaccgtaacgtacccgtaacctagttaccgttcgttaacccttacgtaccctttacctacccgtacctacgttaccgtagttaacccg

SEQ ID NO: 140046 - DNA, 1200 bp, Homo sapiens
  misc_feature: GYAE6OF01C1ECD.46.67.G01.1.454.CMB.1.raw
  modified_base (176)..(176): a, c, t, g, unknown or other
  misc_feature (176)..(176): n is a, c, g, or t
  modified_base (211)..(211): a, c, t, g, unknown or other
  misc_feature (211)..(211): n is a, c, g, or t
  modified_base (348)..(348): a, c, t, g, unknown or other
  misc_feature (348)..(348): n is a, c, g, or t
tcagactagcagtacacgaccggtgctcgatttagagtatacatattgggtttgtcctcctgctggtgacagctcccagatgggtcctgtccctggtgcaactgcaggagtccgggacccacgactggtgaggcccttcggacgaccctgtcccctcacctgcgctgtctctggtnccctcatcagtagtgtttctcgtgggctgggccgnagcctaccgaggggagggctaggaatacgtagttaggaagttcgtctcgtactagttaggtgggtacggttaccttattaccgtaggtccccgttctctacgaagtacgtcggacgttaccacgtattatccttcgnggtaaccaccggttaccaggtaacctaacgttaccgttacgttttttaccccgtaggaaagttacgttcggtaacggttttccgttcggtacccggtaacccggtcccggtacgttacgggaaaccccggttccggggtttaaccggttttttaaactttacccggtttcgggtacgggtaccgggtaaacgggtaaacccgggtaaccggggtttacccttttaaaggtttaaccggttttaacgggtttttaagggtttttttacgggggtttaaaccgggttttaacgggttttttttaacccgttttaacccccgggttaaaaccccggtttaaaccccccggttttaaccgggggtttaacccgggttttaaacccccggggggggtaacccccgggggggggttttacccccgttttaaaaccccccccgggggggttaaccccccccccggggggtttaggggggggttaaaacccccccccgggttttaaacggggggggttaaaaacccctttttaaccccggggggttttacccccggggtttaaaccccccgggtttaccccggggttttaaaccccccgtttttccccccccgggggtttttaaaacccggttaccccccccccggttttaaaaccccccccggaaacccccggggggttaaacccccccgggggttacccccccgggtttaaaacccggttttttccccccccgggggtttaacccccccccgtttttaccccccccccgggggtttaaaccggggtttacccccccccctttaaaaccccccccccccgggtttttaacccgggtaaacccccccggtaaaaccgggg

SEQ ID NO: 140047 - DNA, 632 bp, Homo sapiens
  misc_feature: GYAE6OF01DD0GF.46.67.G01.1.454.CMB.1.raw
  modified_base (217)..(217): a, c, t, g, unknown or other
  misc_feature (217)..(217): n is a, c, g, or t
  modified_base (227)..(227): a, c, t, g, unknown or other
  misc_feature (227)..(227): n is a, c, g, or t
  modified_base (246)..(246): a, c, t, g, unknown or other
  misc_feature (246)..(246): n is a, c, g, or t
  modified_base (250)..(250): a, c, t, g, unknown or other
  misc_feature (250)..(250): n is a, c, g, or t
  modified_base (613)..(613): a, c, t, g, unknown or other
  misc_feature (613)..(613): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccggtggagacagtgtcaccatcacttggccgganaagtcgaacnttgacactatttaatgtancaanatagaccagggacgaccctaagcctacaatctatgctgctatccgtagtttgactaaaggtcgggtcccagtcgtaaggttcagtggcaggtggaatcgagggaactacggtactttcgacttctaccaactacttagaagttaactcgtgtaactaacggtagtaacgttattttacgaacttaactttatacgttcgtaaccaagtataaattacgtaatttgggtttaccgaaccgtaaagggtaaccctaacggtaaaccttaaacgtaaactttaaaccggacgttaaggtcgaccgtttacggacctaaccttaagtttcgttaggttacctttacgtaacgtttccctaaccccgntaaacttcgtaggtaaacc

SEQ ID NO: 140048 - DNA, 817 bp, Homo sapiens
  misc_feature: GYAE6OF01ECB70.46.67.G01.1.454.CMB.1.raw
  modified_base (214)..(214): a, c, t, g, unknown or other
  misc_feature (214)..(214): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagacccctgtcccctcacctgcgctgtctctggtcncctccatcagtgtgtttctcgtgggctgggtccgcagccgtcccgaggggaacgggctaggaactacagttggaagtcgtctctcagtaggtggtacggtttacctattacgacgttcccgtctctacgaagtcgtacgacgtccacagtactcgtctggacctacgtaccagactaactcgttacgttttccctagaacgtagtagtacgtttcgtcggttaccgacccggtcccggtcttacggtaaccggtaccgggtttacgtttttaacttacgtttacggtcggtaacggtagggtaacggtaaccggttcgtttaaagttttaacggttggttttaaggttttttacggggtacggttttaacgggttttaacttttaccccgggtaacccgttaccccgttaagggtaaccggttaccccgggggtaaccgggggttccccgttaccccggggttaaccccccgggttcggggggtaaaccccgggtaaacgggggttaaacctttaaccccggggttacgggttacccccgttaacccgggttttaccccgtttaaccccgttaccccggttacccccgttaaacccccccggg

SEQ ID NO: 140049 - DNA, 806 bp, Homo sapiens
  misc_feature: GYAE6OF01A8XR3.46.67.G01.1.454.CMB.1.raw
  modified_base (97)..(97): a, c, t, g, unknown or other
  misc_feature (97)..(97): n is a, c, g, or t
tcagactagcagtacacgaccggtgctcgatttagagtatacatattgggtttggggagtctcggtcaggacacagcatggacatgagggtccccgntcagctcctggggctcctgctactctggctcgaggtgccagatgtgacatcgagctgacccagtcctccatccctcccgtgtctgaccaaccggtgggagactagtcgtaccacctatccaccgttcggaccgggacaaggtaccggaaactagttacgaacccttaacctttaatttttaaaaggttcggttaactaccgtaaaactaacgtacggaacccggaacggggtaacccggtacccctaaagtccctaaccgttaatccttaacgtcggaccttcgaccgtaacgttcccggttaaggtttcggaacggtaaaacgggttcggggtaccccagttacccggtaggtttcgaaggttcggacgtagggtacgtacggttacggtagggaaccttaggttacctttaccgaccgttcctaaccgaaccgtattacgtaaaggtttaactaccgttacgaaccgtaacggttaagtaaagtttacgttttacgtaaccttaaactttacttaacgttacgtaaacctaacgtaactttaagtttaaccttaacggtttacggtttaaccggaacggtaaacggtaccgtaacgttaaacttaaacgtaaacgttaacgtacgttaggtaccggtactacgtaccgtactagttacgtacgttcttacctaccgtttcccgtacctaccgtcttacgtagtaccg

SEQ ID NO: 140050 - DNA, 831 bp, Homo sapiens
  misc_feature: GYAE6OF01CQ3DD.46.67.G01.1.454.CMB.1.raw
  modified_base (177)..(177): a, c, t, g, unknown or other
  misc_feature (177)..(177): n is a, c, g, or t
  modified_base (803)..(803): a, c, t, g, unknown or other
  misc_feature (803)..(803): n is a, c, g, or t
tcagactagcagtacacgaccggtgctcgatttagagtatacatattgggtttgtcctcctgctggtggcagctcccagatgggtcctgtccctggtgcaactcgcaggagtccgggcccacgactgggtgaggccttcgggacgaccctcgtccctcacctgcgctgtctctggtncctccatcagtgttgttctggtcgggtctcgggtccggcacgccgtacccggaggggaagggtcctaggaactacgtagttagggaagtcgtaccgacgtctaagttaggtcggttacggttcccttaagttacgtaccgttccgttaccgtaccgtacgtaacggtaccggtacggtaccgtaacctaacccgtaattcctaccgttaccggtacggaacctacccgtaccgacgtacctaacgttccgttacccgttttccgaaggtaacgtatacggttacttcggttacggacccggtaccgtcccggtcgtaacggtaaccggtaccgggtttactttaacgtttaacggttcggcgggttaccggaagggtacgaccggttaactttaacgttaaggttaggttttacggtttacggttaaggtttcggtttacttaccggtaccctaaccgggtagtaccggtccgggtacccgggacccgttaccggacccgggtacgggtaaccggtaacggtacggttacgtacccggtacgtacccgtcccgttaccggttacgtcccctaaccggaaccgtaccggtcccttacggttccccgtcccgttacccgccctacccncccgtacctaaccgccgtccgtacccgg

SEQ ID NO: 140051 - DNA, 653 bp, Homo sapiens
  misc_feature: GYAE6OF01BXNU4.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtggagacagtgtcaccatcacgttgccgggcaagtcggaacattgacacttattaaatgtatcaacatacgacgaggacgaccctaagtctacctaatctatcgctgcatcctagtttgacgtaaaggtcgggtcccaagtcggtagttcacgtggcaggtgattcgagggactagtacttcgactcgtacaccatcaagtactctagcaacgtagaacttagtttcgacttaacgtttattactacgtataacgaataacgtttaacaatttcggtttaaccggacgtaaacgggacctaaacggtaacccgttaaaacgtaaacttaaaaccggtaacgttacggtacgggtaccttaccggtaacctaaaccccgttaagttacccggtttacggttacccctttactaacccgttttaccccgtttacccccggaaccctttaagtaccgtttacgttaaaccg

SEQ ID NO: 140052 - DNA, 716 bp, Homo sapiens
  misc_feature: GYAE6OF01DE2QC.46.67.G01.1.454.CMB.1.raw
  modified_base (198)..(198): a, c, t, g, unknown or other
  misc_feature (198)..(198): n is a, c, g, or t
  modified_base (250)..(250): a, c, t, g, unknown or other
  misc_feature (250)..(250): n is a, c, g, or t
  modified_base (705)..(705): a, c, t, g, unknown or other
  misc_feature (705)..(705): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctcgaaccctagtctccactccctcctgtctcgcaaccggtggaanactagtcgtccaaccatccacgttggtaccgggactaacggtccggaaactnttacgaacctaacctttaattttaaagtggttactacaaaactacgtaacggaacccgagggtaacccggacccttaaacgccttaaccttaatccgttaatcgacttgctacgtccttaaggttgacgtaaagggtcgggtacccaagtccggtaagttcgaaggtcgtcgtaaggtaggtacgttcggagggtaactaacggtactttaccaccgtttacacccctacgtaaacgtctaagttaacgtcctggtaaccgtaacggtagttaaagtttcttaacggtaaccttaactttagttacgttacgaactaaacgtaactaaactttaacgtaagttttcggtacgaaccgtaaggacctaaggtaacctaaacgttaaacgttaccgaattcgacggtatccgtacacttatcttacgacttcgaccctttcccggaccctattactnttccggtaaac

SEQ ID NO: 140053 - DNA, 676 bp, Homo sapiens
  misc_feature: GYAE6OF01D8HZ5.46.67.G01.1.454.CMB.1.raw
  modified_base (364)..(364): a, c, t, g, unknown or other
  misc_feature (364)..(364): n is a, c, g, or t
  modified_base (666)..(666): a, c, t, g, unknown or other
  misc_feature (666)..(666): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtctccatcctccctgtctgcaaccggtgggagacaggtgtacaccatccacttgccgggacagtaccggaacattgactacttaattaacgttggtatacgaacatacgaccgacgggaccggaccctaagcttacctaattcctagttagctgtacgacttccgagtttagacgtaaaggtcgggtccagtcgacggtttnacggttggactaggtaggacttcggacgggaactaaggtacttccgaactttcgactaaccgaacttcgaaagttaactacgtgaacgtaagtacggtaaagttatttcgtacttaaactttattaacgtacgtaactaactaacgtaatttaacgtaagtttacgttttacgggacctaaacggggaaccttaacggtaaccttaaactaaacttaaaacggtaacttacggtacggtacgtacgttacgaaccgtacttacgtacgttccttacgtaccgttacttacccacgtacgttntacgttaacg

SEQ ID NO: 140054 - DNA, 787 bp, Homo sapiens
  misc_feature: GYAE6OF01DPQYS.46.67.G01.1.454.CMB.1.raw
  modified_base (421)..(421): a, c, t, g, unknown or other
  misc_feature (421)..(421): n is a, c, g, or t
  modified_base (478)..(478): a, c, t, g, unknown or other
  misc_feature (478)..(478): n is a, c, g, or t
tcagactagcagtacacgaccggtgctcgatttagagtatacatattgggtttgggggacctcctgtgcaagaacatgaagcacctgtggtttgtcctcctgctggtggcagcctcccagatgggtcctgtccctggtgacaactgcgagggagtccgggcccagactgggtcacgggtcctttcgggacacccccgttgtcccctacaccgtggcccgtctgttcctcgttcggtcctccctccgatccgtaggtttcggtttcggttttccgttcggtgggggtccgttacggggtcccggcaacggtccgtacccggagggggaacgggtccgtaggaatacgtagttaggaaggttcgtctcgtacgtaagttacggtaggttacggttaccttaacgttacgtacggttcccgttntcctacgaagtacgtcgtaagtcctaaccgattactccttcgagactacgtacccanccgtaaatccttacgttttacccagacgtattacgtagttctgtacgcccgtcgtcgtacgacgtacgggttctttaacgtcgttcgtagacggagtaagtccggttacttagttagtttggttttaacgttttgggttacgttttagggttttaacccgtttcgaaacccgttaccgttagggaccgggttccgggaaacccgggtccgttcccccggaacccgggttacgggacccggttaagggtaaactacgggttcggtacccttacccgttacggtttcccgtaacccgtcctaacccccggg

SEQ ID NO: 140055 - DNA, 850 bp, Homo sapiens
  misc_feature: GYAE6OF01B5GMV.46.67.G01.1.454.CMB.1.raw
  modified_base (174)..(174): a, c, t, g, unknown or other
  misc_feature (174)..(174): n is a, c, g, or t
  modified_base (679)..(679): a, c, t, g, unknown or other
  misc_feature (679)..(679): n is a, c, g, or t
  modified_base (811)..(811): a, c, t, g, unknown or other
  misc_feature (811)..(811): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggtccttcggagaccctgtccctcacctgcgctgtctcgtggtcncctccatcagtagttggtttcttcgtggggctcgggtccgcacgccgtccggaagggggaagggtctaggaactacgtagttagggaagttcgtcgtacctgtaaggttagggttcgggtaacggttttaccctaagtttaccacggtttcccgttactaccgtaacgtaaacgggtcgttaccggtaacttaccaacccgtaattacttccgtaccgtacgggtaccctaaccggttcccaaggtaccctaaaagtttcccgtttaaccggtttttaccccgaagggtaaaacggtacttcggttaacgttccgttgggtacccgacccgtcccggtagtaccgtacggtacgggtttaccgtttaatcggtggtacggacgagggtacgtaccgttgttaactttggttagtttagggttttacgggagttttcggtttaccgttacgaacccgtttaacgacggtacggtccggggacgggtccctaccccgggtaccgggnggggtaacccaaggggttacctcggttcccgtaccctaccgttccgttaacccgtacggaccccctaacggtaacccggcggttccccttacggttccccggtacccccttcccccggaggttaaccccccnccccgtttaacccggaacgaaccgggtcctaacccccgg

SEQ ID NO: 140056 - DNA, 922 bp, Homo sapiens
  misc_feature: GYAE6OF01ELTDN.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcgaggagtccgggcccacgacgtggtgaggtccgttcggacgaccctcgtcccctcacctgccgctgtctcgtggtcgcctccatcgagttacgttcggttttcgttcggtcggggtcgtcggggtcccggcgacgccgtacccggaaggggaagggtcctagggaatacgtagttaggaagttcgttcctctacgagttaggtacggtacggtttacccttaagtttaccgacggttcccgtccttacgtaccgaaaggtacggtccgtaacgtacccaacctattacctccgtcggtacgacctaccgaccaagaaccttacttcctttaccgttttacccgtaggaaacgtgttggtacgtttcgtacggttaccggacccgtccgtaccgttacggaaaccgggtttaccgggttactttttaaccgttcggtacggttacggaacggtacggtacgggttaaacccggtttctttaaagttttacggttaggttttttaacggggttttttagggttaacggggttttttaccggttttttaaccgtttaaccccggtaacccggtttaaaccccgggttagggttaaacccgggttccccggggggttaaccccgggggtacccccgtttacccccggggttaacccccggggtacggggggttacccgggtaaacggggttaaaccgtttccggggttaccccgggttaacccgttacccccggtttaccccttaccccgggtttacccgaccccccgttaacccccgggg

SEQ ID NO: 140057 - DNA, 932 bp, Homo sapiens
  misc_feature: GYAE6OF01ASYJS.46.67.G01.1.454.CMB.1.raw
  modified_base (271)..(271): a, c, t, g, unknown or other
  misc_feature (271)..(271): n is a, c, g, or t
tcagactagcagtacacgaccggtgctcgatttagagtatacatattgggtttgggggacctcctgtgcaagaacatgaagcacctgtggtttgtcctcctgctggtggcagcctcccagatgggtcctgtccctggtgcaactgcagggacgtccgggccacgacgtggtgacggtccttcggacgtaccctcgtccctcaccgtgcgtctcgtcctcgtggtcgccctccatcagttaggttcgtttctggtcggggctggggtccggnacgtccgtccggagggggaacggggtctagggtaactacgtaggttagggtagttcgttcctcgtactaggttagggtagggttacgtttcccttaagtttacctaccgggtttcccttactaccgtacgaacggtaccgttaccgacgtccaactacgttatcccgtagtaccggtactaccggtacctaggaaccgtaactttaccccggggtttacttttcccggtaaaggtaacgtacgtttacggtaacgtttcggtccggtacccgggaccccggtccccggttggttaccggaacccgggtttacgggttaacccgtttttagtttaccggttcggttaacgggacggtaacgggtaaccgttaccgggttaaccttttaagttttaagggttcggttttttaggtttttacggggttacggttttaacggtttttaccgggttaaccgtacccccggtttaaccggttacgggtaccgggttacccggggtaccccgggggtaccccttaccccgggggtacccccggggtagggggtaaccccggttaaaggggttaccccgggtttaaccgtttacccggggaaccctttacccccggggttttcccttaacccccgggttacccggtaaccccccgttaaacccccgggg

SEQ ID NO: 140058 - DNA, 862 bp, Homo sapiens
  misc_feature: GYAE6OF01B39EM.46.67.G01.1.454.CMB.1.raw
  modified_base (173)..(173): a, c, t, g, unknown or other
  misc_feature (173)..(173): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactgggtgaggccttcggagaccctgtccctcacctgcgctgtctcgtggtncctccatcagtagtgtttctcgtgggctgggtccgcagctcccgaggggagggctaggaatacattggaagtgtctctacataggtggacgttcctagttacaggtccgttctctacgaagtacgtcgaacgtccaacctattactctcgtaggacctaccgtccaacgactaaacgtccttaacgtttttcccaaggtaaacgtacgttcggtaagtttcgtggttaccgacccggtccgacgtacgaaccggtaccgggttacgttttaacttacgtcgggttacgacggtaggtacggtacggtactttaatttacgttaggtttaacggtttttagggacggttttacgggttttaactttacccggtaaaccggtaccccgttaaagggtacccgttaccgggggtaacccgggggttaccttaaccccgggtaacccccggggttacgggggaaccccggttaaacggggggtaaaccttttacccgggttcggttaaccccggttaccccggtttacccgttaccccgtttaaccgtcccccggttaaccccgaaacccgggtaaccccgggtaccccttacccgggtttaccccgggttcccccttttcccccccgggtacggtacccccctttaacccccgttaccccgtaaccccgtaaacgggcccgttaacccccgg

SEQ ID NO: 140059 - DNA, 700 bp, Homo sapiens
  misc_feature: GYAE6OF01BII0F.46.67.G01.1.454.CMB.1.raw
  modified_base (674)..(674): a, c, t, g, unknown or other
  misc_feature (674)..(674): n is a, c, g, or t
tcagactagcagtacacgaccggtgctcgatttagagtatacatattgggtttggggagtctcggtcaggacacagcatggacatgaggggtccccgctcagctcctgggggctccctgctactctggctccgaggtgccagatgtgacatcgagctgacccagtctccatccctccctgtctcggaccaaccggtgggacacgtagtcgtccaacctataccacgttcgggacccggggacaaacggttccgggaaactatttacgacctaaaccttaagttttaaaacttcggtaataccaaacataacggaccggaacggggacccggtacccctaagcctacctaactctatcggctcgactactaccgtagtttaggaccgtaagggttccgggaccctaacgtcggtacggtttacgacggtggacgtaggttaggtatccggtagggtacaggttacttctaccgtcaccgtaccattacaacgttactacgttacggaccgttaaacggttggaaacgttttagtttacaaccgttaaacttttaacgtaacttcgtaacaaaccggtaattaaacttactaagtttcggttaccgaccgaacggtactacgtaaactaactaaacgtaactagtcgacgtagtcacgtacctatacgtcttactnaccgttccctaccgctatctagtccg

SEQ ID NO: 140060 - DNA, 631 bp, Homo sapiens
  misc_feature: GYAE6OF01EN7BO.46.67.G01.1.454.CMB.1.raw
  modified_base (222)..(222): a, c, t, g, unknown or other
  misc_feature (222)..(222): n is a, c, g, or t
  modified_base (233)..(233): a, c, t, g, unknown or other
  misc_feature (233)..(233): n is a, c, g, or t
  modified_base (384)..(384): a, c, t, g, unknown or other
  misc_feature (384)..(384): n is a, c, g, or t
  modified_base (439)..(439): a, c, t, g, unknown or other
  misc_feature (439)..(439): n is a, c, g, or t
  modified_base (570)..(570): a, c, t, g, unknown or other
  misc_feature (570)..(570): n is a, c, g, or t
  modified_base (619)..(619): a, c, t, g, unknown or other
  misc_feature (619)..(619): n is a, c, g, or t
tcagactagcagtacacgaccggtgctcgatttagagtatacatattggggtttggggagtctcggtcaggacacagcatggacatgagggtcccgctcagctcctggggctcctgctactctggctccgaggtgccagatgtgacatcgagctgacccagtctccagtcctcctgtctgcaaccgtgggacacaggtcgtacaccatcgacgttgccgggnaacgtcgaacnttgacactagtttaaatggtatcaactatagaaccagggaccgcccttaagcttacctaatcgtagtgactgacgtactcctaggtttagaccgtaaaggtcggggttaccccaagttcggtaacggttatacggtgctaggtcgatcggngggacaagtgttccagtcctaacacctagtacctagtactacgactgacggttanaacggttagttttacacgtaaactttattagtaactcgaaccttaagaaactttaccgaaagtttccgtttaacgggacgaacgggtacctaaacgacgttaacctaaagttaacgtaacgtgttaccggntaccgtacgacctagtaccgtcttaccgtactaccgttctaaccccggntacttcgtgtac

SEQ ID NO: 140061 - DNA, 855 bp, Homo sapiens
  misc_feature: GYAE6OF01D5C8I.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagcctcccagagtcgggtcctcgtcccgtggtcgacaacgtgacgaggacggtccggacccagacgtggtcgacggtccgttacggacgtacccgttcgtcccctcgaccgtgcgtcttcgtctcgtggtcctcctactatcgtaggttcgttcgttttcgtcgggtcggggtccgttcgggccgactacggtcccggtaccgggaaggggtaacggtcgtaggtaaactacgtagtaggtacgtcgttactcgtacgtaggttacggtagggttacggtttaccttaacgtttaccggacgtttcccgttaccgttaacgaacgtaacggtacgtacgtaccgtaaccgtaacctattaccgtactacggtacggtaaccctaccgtactaagtacctacgttaccgttttaaccgtttaccgaaggtaacttacgtacggtttacgttacggtacggttacccgaccggtcctacggtacggtaaccggttacggtttacgtttaacgtcgttacggtacgtaagggtacgtacggtaacgttactttaagttacggtttagtttaagggtttacggttaagggtttcgttttaacgtaccgtaaccgttaacgaccgggttaacggccgggttaaccgggtccctaccgggacccggggttcgggaaacggtcgggttacctacggttcccggaccgttaacccggttacccttacccggtaccgtccccgtaaaccccggg

SEQ ID NO: 140062 - DNA, 761 bp, Homo sapiens
  misc_feature: GYAE6OF01BFEA3.46.67.G01.1.454.CMB.1.raw
  modified_base (481)..(481): a, c, t, g, unknown or other
  misc_feature (481)..(481): n is a, c, g, or t
tcagactagcagtacacgaccggtgctcgatttagagtatacatatttgggtttggggagtctcggtcaggacacagcatggacatgagggtccccgctcagctcctggggctcctgctactctggctccgaggtgccagatgtgacatgagctgacccagtctccatcctcctgtctgaccaccggtgggagacagtcgtcacctatctacgttcggaccggactaacgtacggaaactagttacgaacctaaccttaatttaaaagttggtaactacaaacgagtaacggaccgaacgggaccgaccctaagtcctacctaagtacctagtacgcgtagtccacgttacctagttcgtaaccgtaaaggtcccgggtaccgtaacgttaccgggtaacggttcggtaacggtgggtactaacggggtgtacggtacggttacggaacgtagtacctttacgaccttcgtactaacgtanacgtaagtctcgtagaaccgtaaggttcgtaaagttacgtttactaaacgttactttaacgtacgtacgtaacaaacttaaggttaaactttaacggtttaacgtttaccgggtttaacccggtaaacgggaaacggtaccttaaacgtaaaccgttaaaaacgtaacgtttaaaaggtaccgtacggttacgaaccgttccgaacctaaccgtcggttactttcgtacctttaaccccgtactttaccccgttaccacgtttaaccgtgtacgtaaccg

SEQ ID NO: 140063 - DNA, 704 bp, Homo sapiens
  misc_feature: GYAE6OF01B3EAD.46.67.G01.1.454.CMB.1.raw
  modified_base (225)..(225): a, c, t, g, unknown or other
  misc_feature (225)..(225): n is a, c, g, or t
tcagactagcagtacacgaccggtgctcgatttagagtatacatattgggtttgggggacctcctgtgcaagaacatgaagcacctgtggtttgtcctcctgctggtggcagcctcccagatgggtcctgtccctggtgcaactgcaggacggtccgggcccacgactggtgacggtccttcgggacgaccctgtcccctcacctggccgtctgtctcgtggtcncctcatcgagtagttggtttcttcggtggggtcgttcgggtcccggcacgtccgtacccggaggggaacgggctaggtaatacgagttaggaagtcgtctctcagtaggtgggtacgttaccgttattacgtacggttcccgtcttcgtacgaagtcggtaccgtagtaccaacctattacgtcgttcgtacggaccctacgtccaacgactaacgttccttaaccgttttcccgagtaacgtgtaggttacgttcgtggtaccgacccgtccgactacggaaccgttccgggttatttactacgtcggtacgacggaaggacggtcggtactttagtagttacggtttagtttggtagtttggttacttacggacctacggttagcggtcgggtaccgggtctcccggtaccggtgggaccggtaggtaaccttggaccgttaccgtacccgttaccgtcttaccggccctaacccgg

SEQ ID NO: 140064 - DNA, 881 bp, Homo sapiens
  misc_feature: GYAE6OF01DC7J4.46.67.G01.1.454.CMB.1.raw
  modified_base (521)..(521): a, c, t, g, unknown or other
  misc_feature (521)..(521): n is a, c, g, or t
tcagactagcagtacacgaccggtgctcgatttagagtatacatattgggtttggggagtctcggtcaggacacagcatggacatggacgggtccccgctcagcctccggtgggtcctcctcgccttctcgtcggcctaccggaggtcgaccgagtagttcggtacgacacgtcggacgtaccgtaccgaaccctcgttccctccctaccttcccgttccgttcgtaccgtacggaaccggtacgggtacgggacgtaacgtagtccacctaaccgtactacgtaccggtaccgggaccggtaacgtaacggtaaccgtaacgtacgttaaccgtaacctttaaacgtttaacgtttaacgtactaacaacctaaacgaccggaacggtaaccggaccgggtaccctacctaccgtactaacttagtacgtacgtcgtaccgtcgtacgtaccggttagtaccggtacgttaacggtaccgggtacgtacggtacggtacgtacggtaggtacgacggtgnggtacgtcggtaggtactacgttcttacgaccttactactaccgtaacgtactaacgtactacgtacgtaacgttaacggtacgtttacgttaacgtttaaccttaacggttaaccttaacgttataacccgttaacgtaaacgttaacgtttaaaccggtttaacgttaccggtttaaccgggttacggaaacccggttaacgtaaaccgttaaacggttaaacctaaacgttaaaccggtaacggttacgtagtacccggtatacccgtacgttacccttaacgttccgtttcctaacccggttttacaccccgttttaccgacccgtttaactacgttaaccgtcgttacggtaacg

SEQ ID NO: 140065 - DNA, 701 bp, Homo sapiens
  misc_feature: GYAE6OF01DCIFQ.46.67.G01.1.454.CMB.1.raw
  modified_base (229)..(229): a, c, t, g, unknown or other
  misc_feature (229)..(229): n is a, c, g, or t
  modified_base (250)..(250): a, c, t, g, unknown or other
  misc_feature (250)..(250): n is a, c, g, or t
  modified_base (263)..(263): a, c, t, g, unknown or other
  misc_feature (263)..(263): n is a, c, g, or t
  modified_base (310)..(310): a, c, t, g, unknown or other
  misc_feature (310)..(310): n is a, c, g, or t
  modified_base (340)..(340): a, c, t, g, unknown or other
  misc_feature (340)..(340): n is a, c, g, or t
  modified_base (351)..(351): a, c, t, g, unknown or other
  misc_feature (351)..(351): n is a, c, g, or t
  modified_base (507)..(507): a, c, t, g, unknown or other
  misc_feature (507)..(507): n is a, c, g, or t
tcagactagcagtacacgaccggtgctcgatttagagtatacatattgggtttgggggacctcctgtgcaagaacatgaagcacctgtggtttgtcctcctgctggtggcagcctcccagatgggtcctgtccctggtgccaactgcagggacggtccgggcccacgtactgggtgacgggtccttcgggaacgcccctgtcccctcacctgccgctgtctctgggtcncctcatcagtagtgtttctgngggctgggtccgnagcctaccggagggagggctaggaatacagttaggaagtgtcctctnagtaggtggtacgttctatacacggtcctntctacgaaggngtacgacgtacacctaatactctacgtcggaacctccgtaccagtacaattccgtacgttttcccgaagtagattcggtacgttatggtacggacccgcgtactcgacggtacggttacgtttacgttacgtggtcgtacggacggagtaccggtntttaagtttagttaggttagttttacgggtaggtttggtttacgttaccgtaccgtaccggttagacccggtaccgggggaccgggtcctaccccgggtacccgggtaggggaacccgtaaggggtaaccttaccggtacggggttaccctacccggggtttcccttaacccggtcgtacccccgtaaccccgg

SEQ ID NO: 140066 - DNA, 838 bp, Homo sapiens
  misc_feature: GYAE6OF01CTIS7.46.67.G01.1.454.CMB.1.raw
  modified_base (228)..(228): a, c, t, g, unknown or other
  misc_feature (228)..(228): n is a, c, g, or t
tcagactagcagtacacgaccggtgctcgatttagagtatacatattgggtttggggagtctcggtcaggacacagcatggacatgagggtccccgctcagctcctggggctcctgctactctggctcggaggtgccagatgtgacatcgagctgacccagtctccatccctcctgtctgccgaaccggtgggacgacaggtctcaccatctacgttcggaccggganaagtccggaactattcgacctaactttaattttaaagtggtaacttacaaactacgttaacggaacccggaacggggtacccggtaaccccttaaggtaccctttaaccgttaaaacgttcctttaaagttcgggaaccttcggtacctaactttaccccggtaaggtttttaccggaaacggtaaaaccggggttttccgggggaccccttaaggtaccgggttaagggtttaccgaagggtttccggggaacgtaggggttacgggtacgttaccgggtaggggtaaaccttaagggtttaaccttttaccgaaccgttttccctaaccggaaacccttacttaacgtacgggtttaaactccggtttacgaacggttaaaccgtaagttaaacggttttattttaacggaactttaaacggtttactttaacgttacgtaaacgtaacttaacgttaaatttaacgttacggtttacggtttaacccgaagtaacgggtaactaccggtaaacttaacgttaaaacgtacgtaacgttggtacgactacgaaccgtactattcgtacgttcttaaccgcttcccgtaccgctactccgttgtaaccg

SEQ ID NO: 140067 - DNA, 718 bp, Homo sapiens
  misc_feature: GYAE6OF01C3HRN.46.67.G01.1.454.CMB.1.raw
  modified_base (200)..(200): a, c, t, g, unknown or other
  misc_feature (200)..(200): n is a, c, g, or t
tcagactagcagtacacgaccggtgctcgatttagagtatacatattgggtttggggagtctcggtaaggacacagcatggacatgagggtccccgctcagctcctggggctcctgctactctggctccgaggtgccagatgtgacatcgagctcgacccagtctccactccctccctgtcctgaccgaaccggtggganacgagtcgtccaccgtatcctacgttcggccgggacaacggtccggaacagttacgaaccgttaaccttaattttaaacgttaggaacttacaacaagtacggaccgaaccgggacccggtaccccgtaagcccttaacttaaaatcgttacgtacgtcgtcgacctacgtaccttacggttagacggtaacggttccgggtacccgtagtaccgtaggtcgtaggacggtcctaggtacgtatcgggacggtaactcggtaacttccgtactcctaacgacctacgtactagtactaccgtagacgtaacgtaagtaacgttatttacgacgttaatttacttacgtaacttacaaacgttaattaaacgttaattacgttacggttacgtaacggaacgtaacgtaaccgtaaattaaacgtaaacgtaacgtcgtaagtccgattccgaacctactcgttataggtttcccctacgttacccttccgtacccgtactattacgcgttaaataccg

SEQ ID NO: 140068 - DNA, 772 bp, Homo sapiens
  misc_feature: GYAE6OF01EGG4Z.46.67.G01.1.454.CMB.1.raw
tcagactagcagtacacgaccggtgctcgatttagagtatacatattgggtttggggagtctcggtcaggacacagcatggacatgagggtccccgctcagctccgtggggctcctgctactctggctccgaggtgccagatgtgacagtcgagctcgaccctagtcctccactcccgtccctagtcctgccaaccggtgggacgacgtaggtcgtaccaccgtactacctaccgttcgggccgggtactaacggtaccgggtaaactcgtttacggaaccttaacctttaaagttttaaagtcggttaactaccaaacgtaacgtaacgaacccggtacgggggacccgtaccctaaaggtccttaacccttaaatccttaagtcgtcgttacgactaacgttcccgtaggtttacggacgtaacgggttccgggtaccctagttacggtacggttcgaggtcggacgtaggtcggtagtccggttaggacgtacgttacttcacctctaccgactactacgtaagtactctacggaacgtaacgttagtaagtttactaccgtaattaccgtttatcgttaacgtactaacgtaacgtaactttaaccgtacgtttacggttaccgggaacctaacgggtacctaacgttaaccgttaaacgtaaacgttaccggtaacgttgttaaccgcgtaaccgtacaaccgttagttacccttagttcccttacgtaccgtttccccgttacaaccgttcttaacgcgttaaccg

SEQ ID NO: 140069 - DNA, 768 bp, Homo sapiens
  misc_feature: GYAE6OF01ARGF9.46.67.G01.1.454.CMB.1.raw
  modified_base (176)..(176): a, c, t, g, unknown or other
  misc_feature (176)..(176): n is a, c, g, or t
  modified_base (315)..(315): a, c, t, g, unknown or other
  misc_feature (315)..(315): n is a, c, g, or t
  modified_base (394)..(394): a, c, t, g, unknown or other
  misc_feature (394)..(394): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactgggtgaggccttcgggagaccctgtccctcacctgcgtctgtctctggtcncctccatcagttagtggtttctcgtggggctgggtccgcagcctacccgagggggacggggtctagggaatacagttaggaagttgtctcgtcaagttaggtggtacgttcctaagttacgacggtcctctcacaaggngtcgagtaccactatatccgtacgtggacctacgccagactaacgttccgttacgttttccaggaatcgtgttagttcnggtccgaccggtcgtactaggtaaccggtcggggttacctttagtcgtgacggtacgtaaggtacggtacggttacttaacgttaggttacgtttaggtttttagggtaaggtttacggttttacgttacccgtaaccgttaacccgttaggtaccgggtacccgggtacggggttcccgtacccggggtacccggtacggggtaaccggttaagggtaaccggtttccggttacgggtacccgtacccgttaccggtcccgttaccgtaccccgtacccggaaaccggtcccggtacccgtacgttcccccggtccccttaaccccggcggtaccccctaccccgttacccgtaaccaacggtccgtaccccg

SEQ ID NO: 140070 - DNA, 736 bp, Homo sapiens
  misc_feature: GYAE6OF01CC1LG.46.67.G01.1.454.CMB.1.raw
  modified_base (212)..(212): a, c, t, g, unknown or other
  misc_feature (212)..(212): n is a, c, g, or t
  modified_base (242)..(242): a, c, t, g, unknown or other
  misc_feature (242)..(242): n is a, c, g, or t
  modified_base (298)..(298): a, c, t, g, unknown or other
  misc_feature (298)..(298): n is a, c, g, or t
tcagactagcagtacacgaccggtgctcgatttagagtatacatagttgggtttgggggacctcctgtgcaagaacatgaagcacctgtggtttgtcctcctgctggtggcagcctcccagatgggtcctgtccctggtgcaactgcgaggagtccgggcccagacgtgggtagagggtccctttacgggacgtaccccttggtcccccttnaaccttgccggcttggtacctcgtgggtcnccctcaattccgaagttgttcggttttctccggtagggggccttaggggtccgganagccgtaccggagggaacgggtcttaggaatacgtagttaggaacgtgtctacgctaagtaggtcggtacggttacctagttaacgcgttccgtcgtctacgaagtacgtcgacgtaccacctagtactcgtcgtaggactacgccgagctaagtccttaaggtttcccagaagtcgttagtacgttcgtgtaccgaccggtctacgtacggtaaccgtcgggtttaacttttagtcgtacggttcggacggagtaacggtacgtacgttaagtttacgttaggtttagttttagggaccgtttggtttaaccttcggtaaccctaccgtagtaccggttaacgggccgggtaaccgtcccgtaaccgggtgggaacggttaacgtacggacgtttcggacctacccgtttacctcgttacccgccgttaaacccggg

SEQ ID NO: 140071 - DNA, 686 bp, Homo sapiens
  misc_feature: GYAE6OF01E4RUE.46.67.G01.1.454.CMB.1.raw
tcagactagcagtacacgaccggtgctcgatttagagtatacatattgggtttggggagtctcggtcaggacacagcatggacatgagggtccccgctcagctcctgggggctcctgctactctggctccgaggtgccagatgtgacatcgagctgacccagtcctccactccctccctgtctcgacaaccggtgggacgacagtcgtaccaccatcctacgttcggcccgggactaaggtccggaactattacgaacctaaccgtttaattttaaatttcggtaactacaaacaattaacggaccgaaggggacccggaccctaacggcctacctaatacctagtaggtcctgacactcgtagtttaggacgtaaggtcgggtacccagtacggtggttacaggtcgactaggtggattcggacgggactagtactttcactccctacacctaactacgtaacgttacgtacgtagtaaccgtaacggtagtaaagtttacgtttagtaactaaactttacgttacgttacgtactaactaagtaacttaacgtagttcgtttaaccgaccggaacggtacaaccgtaacttaactaaaacgtaacgtacgttgtacggtctacgaccactactacgttcttacttacctaccgttcccttacccgaccttacttcgagttaccg

SEQ ID NO: 140072 - DNA, 703 bp, Homo sapiens
  misc_feature: GYAE6OF01BD4IK.46.67.G01.1.454.CMB.1.raw
  modified_base (215)..(215): a, c, t, g, unknown or other
  misc_feature (215)..(215): n is a, c, g, or t
  modified_base (239)..(239): a, c, t, g, unknown or other
  misc_feature (239)..(239): n is a, c, g, or t
  modified_base (251)..(251): a, c, t, g, unknown or other
  misc_feature (251)..(251): n is a, c, g, or t
  modified_base (524)..(524): a, c, t, g, unknown or other
  misc_feature (524)..(524): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgacggccttcggacgaccctgtccctcacctgcgctcgtctctggtcncctcatcagtagttcgtttctcgngggctgggccgnacgtctccgagggacgggctaggatactagtaggaagtgtctctacgtagtacggtggtacggtttcctagttaccgtacgttcccggtcttcgtacgtaaagtacggtacgtacgtaccaaccgtatacttctacgtggactacgtccacgctaactcgtttacgtttcccaggtaacgtattgtacgttcgtcggtacgaccggtccgaccgttacgtaaccgtcgggttacgtttaacgtcgttacggtcgtacgtaggacggtaccgtnttaattttacgttgtttacggttttaggagttttcggtttaacttcggaacccttacggtagtaaccgtccggggtaaccgggtcccgttacccggacccgggtggggaacccgtaagggtacccttaggtaccggttaccctaccgttccgtacccgtttaccgcccgtaacccccgg

SEQ ID NO: 140073 - DNA, 761 bp, Homo sapiens
  misc_feature: GYAE6OF01E3VFX.46.67.G01.1.454.CMB.1.raw
  modified_base (172)..(172): a, c, t, g, unknown or other
  misc_feature (172)..(172): n is a, c, g, or t
  modified_base (211)..(211): a, c, t, g, unknown or other
  misc_feature (211)..(211): n is a, c, g, or t
  modified_base (233)..(233): a, c, t, g, unknown or other
  misc_feature (233)..(233): n is a, c, g, or t
  modified_base (259)..(259): a, c, t, g, unknown or other
  misc_feature (259)..(259): n is a, c, g, or t
  modified_base (278)..(278): a, c, t, g, unknown or other
  misc_feature (278)..(278): n is a, c, g, or t
tcagactagcagtacacgaccggtgctcgatttagagtatacatattgggtttgtcctcctgctggtggcagctcccagatgggtcctgtccctggtgcaactgcaggagtcggcccacgactggtgaggccttcggagaccctcgtccctcacctgcgctgtctctggtcncctccatcagtagtggtttctcgtgggcgtcgggtccgnagcctccgagggagggctgaanacgagtggaagtgtctcacgataggnggtacggttctattaacgngtccgtctcagaacgtgtcgacgtacacactactcctcgtacgacaacctccagctaagtccttacggtttcccgtaagaacgtacgtagtacgttactcgttaccggacccgtcgtaccgtaccggtaacggtacgggttacttttaacgtacgttaggttacggacgtaacggtacggtacgttacttaatttacggttaggttttaaggtttaggggtaacggtttcggtttacgttaacccgtaccgtaaccgtaacggagttccgggggacccgggtaccctacccgggtccccgggaggggtacccgtaacggggttaacgtaccgggttcgacccgtaacccggttcgttaacccggttaccgtccccgaacccgtaaccggacccggttacccgtaccgggtttcccgttaccccgttccccggttaccccgaccccctaaccccgtccctaaacccgtcggaccccgtaacccg

SEQ ID NO: 140074 - DNA, 872 bp, Homo sapiens
  misc_feature: GYAE6OF01EDPSL.46.67.G01.1.454.CMB.1.raw
  modified_base (635)..(635): a, c, t, g, unknown or other
  misc_feature (635)..(635): n is a, c, g, or t
  modified_base (663)..(663): a, c, t, g, unknown or other
  misc_feature (663)..(663): n is a, c, g, or t
tcagactagcagtacacgaccggtgctcgatttagagtatacatattgggtttgtccctcctgctggtggcagctcccagatgggtcctgtccctggtgacaactgcgaggacgtccggacccacggactgggtgacgggtcccttacgggacgtaccccttcgtccccctacgacccgttggccgtacttcggtccttacggttgggtccgaccccttaccaagttcgtaagggtttcgttttcggtttttcctacgggtcggggtccgttaccgggggtcccgataccggtcccgtacccgggaaggggggacgggtccgttaggaaactacgttggttagggaacgttcgtcctacgtagtaagggttagggtacggttaccggtttaaccttaacgtttaaccgtaccggttacccgttacttccgttaaacgtaacgggtaccgttaccggtaaccttaaccaaccgttaacgttacgttccgttaccggtacggtaacccgtaccgtaccgactaccgttaaagtttcccgtttaaccgtttaccgaagtacgtaggttacgtttagttcggtacggtacccgcccgtcgtacgtacggtaacgggttaccggtttatttaacgtcggngtacggacgagacggtacttattagttnttagtttaggtggttagttacgttactacgaaccgtacgtagccgggtcgggtaccggtaccgtccgggaccgggaacggtacggtacgtaccgttggcccgtactcccgttacgtcctacccgtacccgacggaaccgtccggttacccgtacgttccccgtacccgtcccgcctaccccctaccacgttacggacctcccgtaccgg

SEQ ID NO: 140075 - DNA, 780 bp, Homo sapiens
  misc_feature: GYAE6OF01EJG2M.46.67.G01.1.454.CMB.1.raw
  modified_base (224)..(224): a, c, t, g, unknown or other
  misc_feature (224)..(224): n is a, c, g, or t
  modified_base (410)..(410): a, c, t, g, unknown or other
  misc_feature (410)..(410): n is a, c, g, or t
  modified_base (451)..(451): a, c, t, g, unknown or other
  misc_feature (451)..(451): n is a, c, g, or t
tcagactagcagtacacgaccggtgctcgatttagagtatacatattgggtttgtcctcctgctggtggcagctcccagatgggtcctgtcctggtgcaactgcaggagtccgggcccacgactgggtagacggccttcggacgacccttgtcccctacaccgttgcgtcctgtcctcgtggtcacctccatctagtgttgtttcttcgtggggctgggtccgncgtcctccggagggagggctaggaatctagtggaagtcgtctactactagttacggtaggtacggttacttaactacgtacgtccggttctcgtacaaaggtcgtacggtacttacccgaccatactttcgtcgttaacggaccacgttaccgagaactaccttctttaaccgtcccctaaggtanaagttacggttcacggttacgtacccggtaccggccccggngtaaccgtaaccgggtacgtttaaccggttttacgttaccggtacggttgggtacgtaacggtaggaacgttcggttaacttacgtttaaggtttacggttttaagggtcggtttaacgtttacggttaccgtaacccgttaacgtaacgtacgggcgggtaccgggtccggtaccgtaccgggtaccggaccggtaagggtactacgggtccttacgaccgttccgtaccgttccctaccgtacccaacggtacccgtacgtaccggttcccgttccccgtaccgttccccgaccctccctacccccgaacgtccgtaccgtaacccg

SEQ ID NO: 140076 - DNA, 780 bp, Homo sapiens
  misc_feature: GYAE6OF01CTQ3B.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgcctactctggctccgaggtgccagatgtgacatcgagctcgacccagtcctccactccctccctgtctcgcgtaaccgggtgggacgactagtcgaccaccactctacgttcggccggacaaggtacgaactagttcgaacctacttatttaaagttgtacctacaactacgtacgaaccggaggggacccgtacccgtaacgtccttaccgttaatccttaagtcgtctcgacctacgttccctaaggtttcgaaccggtaagggtccgggtaccctagtcggtagtcgaggtcgagtaggtggtattacggtacggtaactagttacttaccgtaccttacgtaccaacgtactacgtaacgttactcgacgtaactaacggtgtaagtttacgttactactttaaacgttcttaacggttacctaactaaacgttagtttaaacgtacgtttaaacggttttacgggtttacccgaaacggtaaccgggttaactaacccgtttaaacgttaaaaccgttaaaaccgttaacgtaccggttaggtacccgttaccgtacgtaccccgtaagttacctttacccgtttagtttaacccgttaccctttaccccgttaccccgttaccccctaacgttttacctcgggtttaacccttaaacg

SEQ ID NO: 140077 - DNA, 736 bp, Homo sapiens
  misc_feature: GYAE6OF01D5R2F.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtccgggcccacgactgggtgaggccttcggagaccctgtccctcacctgcgctgtctcgtggtcgcctccatcagttaggttggtttctcgtcggggcttggggtccgcacggccgtaccggaggggaagggtctaggaaatacgtagttaggaagttgtcctctacagttagtggtacggtctagttacacgtcctctctacaagtcggtacgacgtaccacctagtacttaccgtcgtacggtaccaccgtccaacgtcaattcttacgttttcccgtagtaacgagtagtagttcctaggtccgaccggccgtcgtacggaccgtacgggttctttaagttacgtcgtgtacggaagaacggtacggtacttattaagttagtttacggttttaggtacgtttggtttaacgtttacgtaacccgtaccgtaggtacgtcgggtacgggtccgtacccggtaaccccgggtacggggaccgtacgggtaaacttccgttacgggtacccgtccgttacttaccgttaccgccctaaccgaaccggtacggtaccgtacccggtcgttccccgttaccccggtaccgtccctaccccgtaccctacccgtacgaccgtacccgg

SEQ ID NO: 140078 - DNA, 834 bp, Homo sapiens
  misc_feature: GYAE6OF01B3QP2.46.67.G01.1.454.CMB.1.raw
  modified_base (199)..(199): a, c, t, g, unknown or other
  misc_feature (199)..(199): n is a, c, g, or t
tcagactagcagtacacgaccggtgctcgatttagagtatacatattgggtttggggagtctcggtcaggacacagcatggacatgagggtccccgctcagctccgtggggctcctgctactctggctccgaggtgccagatgtgacatcgagctgacccagtctccactccctccctgtctgaccgaaccggtggganacagtcgtccaaccactccacgttcggcccggggactaacggtaccggaaacctagttacgaacctaacccttaattttaaaagttcggtaactacaaactaagtaccgaacccggaacgggtacccgtaccctaaagtccttaccctaaagtactaagtcgtactcgtacctacttaccgtagtttaggaaccgtaaacgggttccggggtacccaacgttaccggtaacggtttcgaacggtcggtacgtagggtacgtacggtaccggtacgggtaactaaggttaaccttccgtaaccttaccgtacgaaccctagtactaacgttaactcgtagtacgtaaacgtagttaagttatttacgacgtttaaacttcgttaactacgtaactaaacgtaagttaaacgtttaacgtaggtttacgggtttaccggaaaccggttaaacggtaaccgtaacccgttaaaactttaaacggtaaaaaccggtttaacgtaaaccgtaccgggttacggtaaccgtacggaacccttaacccttaagtttcccggtttaaaccttacctttaccccggtaaccgtttaccccggttaccccctaccgtttaaacttccgttaaacgttaaacccgg

SEQ ID NO: 140079 - DNA, 756 bp, Homo sapiens
  misc_feature: GYAE6OF01A2SSZ.46.67.G01.1.454.CMB.1.raw
  modified_base (195)..(195): a, c, t, g, unknown or other
  misc_feature (195)..(195): n is a, c, g, or t
  modified_base (217)..(217): a, c, t, g, unknown or other
  misc_feature (217)..(217): n is a, c, g, or t
  modified_base (257)..(257): a, c, t, g, unknown or other
  misc_feature (257)..(257): n is a, c, g, or t
  modified_base (396)..(396): a, c, t, g, unknown or other
  misc_feature (396)..(396): n is a, c, g, or t
  modified_base (545)..(545): a, c, t, g, unknown or other
  misc_feature (545)..(545): n is a, c, g, or t
tcagactagcagtacacgaccggtgctcgatttagagtatacatattgggtttgggggacctcctgtgcaagaacatgaagcacctgtggtttgtcctcctgctggtggcagctcccagatcgggtcctgtccctggtgcaactgcaggagtccgggcccacgactggtgaggtccttcggacgaccctgtcccncacctgcgctgtctcgtggtcncctcatcgagttagttgtttctcgtgggctcgggtccgcncgcctcccgagggacgggctggaactactagttaggaagttcgtctcgtcagttacggtggtacggttccttagttacgtacgttcccgtccgtacttacgaacggtagtcgacgtccactactatcctcgtacgaccnccgtacacgtactaacgttaccgttacgttttaccccgtggtaaacgtacgttgtacgtttacgtgtaccgggacccgtcccggtctcggaaccggttaccggggttacgttttacttacggtcggtagcgtaaggtacgtaaccggtntttaactttagtttcggtttaagtttttacgggttaggtttaggttttacgtttaacccgtaaccgttacccgttagggtaacccggtcggggtaacccggggtccgtaccccgggtcccgggttaccgggaccggtaaacgggacttacggttccgggtaacccttacccggttacccgttaccgttccccggtaccccgtaaccccggg

SEQ ID NO: 140080 - DNA, 938 bp, Homo sapiens
  misc_feature: GYAE6OF01B316N.46.67.G01.1.454.CMB.1.raw
  modified_base (99)..(99): a, c, t, g, unknown or other
  misc_feature (99)..(99): n is a, c, g, or t
  modified_base (185)..(185): a, c, t, g, unknown or other
  misc_feature (185)..(185): n is a, c, g, or t
tcagactagcagtacacgaccggtgctcgatttagagtatacatattgggtttgtcctcctgctggtggcagcctcccagatgggtcctgtccctggtncaactgcgaggcgtccgggcccacgacgtgggtgacggtccttcgggactccctcgtccctcaccgtgcgtctgtctcgtggtccncctcatcgtagttgttcggtttctcggtgggtcgtcgggtccgcacgtccgtaccgggaagggggacgggtctaaggtaatacgtaggttacggtagtcgttacctcgttacgtaaggttagggttcgggttaaccgtttaccttaacggtttaaccgtcggtttcccgttacttaacgtaacggaaacggttccggtacgtaaccgttaccgtaaaccttattacccgttccgttaacggtacggtaacccctaaccgttacccgaaagtacccgtttaaacgtttacccggttttacccgtttaacgaagggtaaaacgttggttacggttaaccgtttcggaccggtacccggacccgtcccgtacgggtaaccgtaccgggtttaacgggttttaccgttttagtccgggttacggaggtaaccggtaacgggtcggtaacgttaagttttacggtttaggtttacggttttaagggttttggttaacggttttacgtttaacccgttccgtaaacctacggttacggtaccgggtaccgggtaccgggtaccccgttaccggggaccgggttaccgggaacgtacgggtaccttacggttcccgtaacccttaccgtccgttacccgtaccggtacccctaaaccggtacccgggtaccccggtccgttacccggttccccgttaaccccccggttcgcccctaacccgttcccccttacccgaaacggttacccgccggtaccccgg

SEQ ID NO: 140081 - DNA, 765 bp, Homo sapiens
  misc_feature: GYAE6OF01D916P.46.67.G01.1.454.CMB.1.raw
  modified_base (196)..(196): a, c, t, g, unknown or other
  misc_feature (196)..(196): n is a, c, g, or t
  modified_base (199)..(199): a, c, t, g, unknown or other
  misc_feature (199)..(199): n is a, c, g, or t
  modified_base (202)..(202): a, c, t, g, unknown or other
  misc_feature (202)..(202): n is a, c, g, or t
  modified_base (208)..(208): a, c, t, g, unknown or other
  misc_feature (208)..(208): n is a, c, g, or t
  modified_base (211)..(211): a, c, t, g, unknown or other
  misc_feature (211)..(211): n is a, c, g, or t
  modified_base (223)..(223): a, c, t, g, unknown or other
  misc_feature (223)..(223): n is a, c, g, or t
  modified_base (235)..(235): a, c, t, g, unknown or other
  misc_feature (235)..(235): n is a, c, g, or t
  modified_base (293)..(293): a, c, t, g, unknown or other
  misc_feature (293)..(293): n is a, c, g, or t
  modified_base (305)..(305): a, c, t, g, unknown or other
  misc_feature (305)..(305): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccactccctccctgtctgccaaccggtgganacngtntccacntcncttcggccgganaaggtcgaactnttcgactaactttaattaagttgtatacaactatacgaaccgacgggaccgaccctancctactatctantctgctacttcgtagttagacgtaaggtcgggtcctagtacggtaggtctacggtacggtagtacggtggtacgtcggtacgggtaagttacgtactttaccgacctaccttaaccgacctaacgttacgttaaagttactacgttaccggtaaccgttaagttaacggttaagttttacgtttaaccgtaaccttttaaaccgtttatttaaccgttaaccgtaaacgtaaacccgttaaatttaaacgttttaccgtaacggtttttacggttaacccggggtaaccgtaaacgggtaaccctaaaccgtaaaccttaaaaacgtttaaacccttaaacggttaacccgttaaggtaccggtacgttacccaacgttacccgttattacccgtttattaccccgttactttaccccttccccggttaacccctacgtttaactcgttaacggttaacc

SEQ ID NO: 140082 - DNA, 888 bp, Homo sapiens
  misc_feature: GYAE6OF01BU1OT.46.67.G01.1.454.CMB.1.raw
  modified_base (141)..(141): a, c, t, g, unknown or other
  misc_feature (141)..(141): n is a, c, g, or t
  modified_base (557)..(557): a, c, t, g, unknown or other
  misc_feature (557)..(557): n is a, c, g, or t
tcagactagcagtacacgaccggtgctcgatttagagtatacatattgggtttggggagtctcggtcaggacacagcatggacatgagggtccccgctcagctcctggggctccctgctactctggctccgaggtgccagntgtgacatcgagctcgaccctagtcctccactccctccctgtctgacgaaccggtggagacagtcgtaccaccatccacgttcggccgggactaacggtacgaactagttcgaacctaacctttaattttaaagttggtactaccaaactaagtacgaaccgacgggtacccgtacccgtaagcctacctaatcttacgtagccgtgacctacgttcctaggtttacacgtaaacgggtcgggtaccctagttacgggtaacggttcgtaagggttcggactacgggttagtacgttaccggtagggtaactaacggttactttaaccacccgttacgtacccaacccgtacttacgtaacgtttaaccgttcgtaacggtacgtaaaccggttagtaaacgtttaaccgtttaanaaaccttttaacgtttacgttacgtttaacgtaaaccccttaaaggtaaacgtttaaacttttaacccggtttaaagggttttaccggttttaaaccccggggaaacggtaaaccccgggttaagttaaaacccccggttaaatttaaaacccgttaaaaacccgttaaacggtaacccggttacggttaaccggttacctaaccgttaaacccgttcccgttaaactttccggtttaaaccctttacccgtttaaccctttaaccccggtttaccccttttaaacccccggaccgtttaaaccgttttacggtaaaccccggtttacccg

SEQ ID NO: 140083 - DNA, 690 bp, Homo sapiens
  misc_feature: GYAE6OF01AZ56C.46.67.G01.1.454.CMB.1.raw
  modified_base (145)..(145): a, c, t, g, unknown or other
  misc_feature (145)..(145): n is a, c, g, or t
  modified_base (209)..(209): a, c, t, g, unknown or other
  misc_feature (209)..(209): n is a, c, g, or t
  modified_base (225)..(225): a, c, t, g, unknown or other
  misc_feature (225)..(225): n is a, c, g, or t
  modified_base (237)..(237): a, c, t, g, unknown or other
  misc_feature (237)..(237): n is a, c, g, or t
  modified_base (674)..(674): a, c, t, g, unknown or other
  misc_feature (674)..(674): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatttgngacatcgagctgacccagtcctccatcctccctgtcctgcaaccgtgggagacagtcgtcaccntccacttggccggganaacgtcggaacngttgaccaccttatttaaagttggtaatcaacatacgaccgagggacggccctaaggcctacctaagtctatcgactgtcattcccgtagtttacgacgtaaacgttcggggtaccctagttcggacggtttcaaggtcgggactaggttggagttccgtacgggtacaaggtactttacccacgttccgtacaacccgtaatccaaaggtttactcgtagtaccaacggttagtaacgtacgttttcgacttaaacgtttacgtactcggttacaaactacgtaatttacgaagttttcggttaaccggaccgaaacggggttaccctaaacggttaaacccgttaaacgtaaaaccgtttaaacgaacgttaggtcgtacctacgaacctacgtacctacttggtaccgttaccaacgtttccgttaaccccgtnacttcgtaacggtacc

SEQ ID NO: 140084 - DNA, 681 bp, Homo sapiens
  misc_feature: GYAE6OF01B8XBD.46.67.G01.1.454.CMB.1.raw
  modified_base (334)..(334): a, c, t, g, unknown or other
  misc_feature (334)..(334): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctcgtggtcgcctccatcagttagtggtttctcgtggggctgggtccgcagctccgagggagggctggaatacagttggaatgtactctacatacggtggtaggttacctagttaccaggtccgtctactacaagagtcgagtcacctatactctcgtacgacacgtccanactaatcgtacgtttcctagaagatgtacgttctgacgaccgccgtcgtacggaacgtacgggttactttatacgttgtgacggtacggacggtacggtacgttaattacgttaggtttaagttttggtaggtttaggttttacgttacgtaacctaccgtaagtacggtacggggtaccgggtccgtacccggtacccggtacggggaccgtaacgggtactaccggtcgtaccgtccgttcctaccggtacctcccgtaccgaccggtaaccggcccgtacgttcccgtaccccgttccccgtaccggtacccctaccccttcccgacgtaacgtacgtaccccg

SEQ ID NO: 140085 - DNA, 812 bp, Homo sapiens
  misc_feature: GYAE6OF01CIYFP.46.67.G01.1.454.CMB.1.raw
  modified_base (761)..(761): a, c, t, g, unknown or other
  misc_feature (761)..(761): n is a, c, g, or t
tcagactagcagtacacgaccggtgctcgatttagagtatacatattgggtttggggagtctcggtcaggacacagcatggacatgacgggtccccgctcagctcctggggctcctgctactctggctccgaggtcgccagatgtcgatatcgagtctacgaccctgtcctaccgacttccctcccgtgtaccgtcggaccgtaaccgggtgggaactacgtacggttcgtaccaacctacttacgtaccggttcgggaccgggacgtaacgtaccgggtaactagttacgaccttaaaccgttagtttttaaaggtcgttaacgtactaacgaacgtaacggaaccggtaccggggtaccccgtaacctaagtccctaacttacgtacgtgtaccgtagtcgtacctacgttccggtaggtttacgaaccgtaacggggttccgtaccgaggtcggttacgtacgcgggttacgcgtaaggtcggtaacgtcggacggtaactacgttacctttacacccgttaccacgtactacgtacttaacggtaccttacggtaccgaacgttaacgggtaagtttaaccgtttactttacggttaaacctttaagttttacctacgttacggtaaccaaagttaccgtttaaattaccgtttacggtttaacggtccgtaaacggtaaccggtacgtaaaccgttaagtaaacccgtaaaggttacgaacgttgggtaaccacgttaccaccggttctccggttntaccgttccctaacttccgtcccgtttaccctagttccacgttaacgtccg

SEQ ID NO: 140086 - DNA, 644 bp, Homo sapiens
  misc_feature: GYAE6OF01AHP4V.46.67.G01.1.454.CMB.1.raw
  modified_base (356)..(356): a, c, t, g, unknown or other
  misc_feature (356)..(356): n is a, c, g, or t
  modified_base (372)..(372): a, c, t, g, unknown or other
  misc_feature (372)..(372): n is a, c, g, or t
  modified_base (385)..(385): a, c, t, g, unknown or other
  misc_feature (385)..(385): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagaccctgtccctcacctgcgctgtctctggtcgcctccatcagtgtggtttctgtgggctgggtccgcagcctccgaggggaggggctaggaatacagttggaagtgtctctcagtaggtggacggtttcctattacgagttccgtctctacaagcgtcgagtccactattactcgtctggacctacgtccagacatcttacgttttcccagaatntagtgtctgcgccgcnctgaccgtcggtntttagtcgtgtgcgacggtggacgtcttaagtgttacgtttagttttgggagtttaggtttacgttacgtaacctaccgtaggtacgtcggggtacccgggtcgtacccggtccggtccggggaccggaagggttacgtaccggtggtaccctaccggtcccttcgtccgacccgtacccggaccggtaccgcccgttacggtccctttccccgtccccgacgtcccctaccccgttacccaccgtacggccctcccgg

SEQ ID NO: 140087 - DNA, 716 bp, Homo sapiens
  misc_feature: GYAE6OF01BWKID.46.67.G01.1.454.CMB.1.raw
  modified_base (495)..(495): a, c, t, g, unknown or other
  misc_feature (495)..(495): n is a, c, g, or t
tcagactagcagtacacgaccggtgctcgatttagagtatacatattgggtttgggggagtctcggtcaggacacagcatggacatggagggtccccgctcagctcctggggctcctgctactctggctccgaggtgccagatgtgacatcgagctgacccagtctccatcctcctgtctgacaaccggtgggagacagtgtcaccatccacgttcggaccgggactaacggtccggaaactagttacggacctaaccttaattttaaagttggtatacaacatacggaccgacggggtaccggaccctaagctacctaattctaatgctgctacgttcctaggttagacggtaaacgggttccgggtacctacgtcggtaggtcgaggtggacagggtgtacgtcggtagggtaacgtcgttactttcacctcgtaaccaccgtaatacgtaagtttaactccgtactaacggtaacggttagtaaacggtttntttaacggtacttaaaccgttttacgttactacggtacaaacttagtaaactttacgtacgttttacggtaccggactaacggggtacctaacgtaaaccttaacgtaaaacgttaaccgagtttcgggtacctacgtaccgtaaccgtaacgtaccgtttcgttaccgtttccttaaaccgtcttccccgttaccctaccgttacttcccgttagtaacc

SEQ ID NO: 140088 - DNA, 852 bp, Homo sapiens
  misc_feature: GYAE6OF01C1POD.46.67.G01.1.454.CMB.1.raw
tcagactagcagtacacgaccggtgctcgatttagagtatacatattgggtttgtcctcctgctggtggtagctcccagatgggtcctgtccctggtgcaactgcaggagtccggccccacgactggtgacggccttcggagacccctgtccctcacctgcgtctgtcctcgtggtcgcctccatctagttgttgtttcttcgtggggctcgggtccgcacgcctaccggaggggacgggctaggaactcgtagttgggagttcgtctcgactagttaggtggtacggttcctaattacacgttccgtctctacgtaagacgtcgtacgtccaaccgtattactcgtcgtacggaacctaccgtcaacggtctaaacttccgttacgttttacccgaagtaagtagttacgtacgtttcgtacggtccgtacccggcccgtacgtacggaccggttacgggtttaccgttttaagtaccggttaggttcgggaaccggtacgggtaaccgggtaccgtttacgtttaagtttacgttagggttttacggtttttagggttaacggttttacgtttacgttacccgtaacccgttaccgttaaacggtccggtacggggtaacccggggtcctaccccgggtacccgggtcgggtaaccgtaacgggtaccttacggtccggtacctacccggtttcctacccggttcccgtaccccgtacccgtaacccggtaccgggtaccccttacccgggtttccccggttacccccgtttcccccggtcccgtaccccccgtcccccgtttaacccgtacccggtaaaccgtccccgtaaccccggtttaacccgggg

SEQ ID NO: 140089 - DNA, 861 bp, Homo sapiens
  misc_feature: GYAE6OF01B5ZD3.46.67.G01.1.454.CMB.1.raw
  modified_base (179)..(179): a, c, t, g, unknown or other
  misc_feature (179)..(179): n is a, c, g, or t
  modified_base (216)..(216): a, c, t, g, unknown or other
  misc_feature (216)..(216): n is a, c, g, or t
tcagactagcagtacacgaccggtgctcgatttagagtatacatattgggtttgtcctcctgctggtggcagctcccagatgggtcctgtccctggtgcaactgcaggagtccggcccacggactgggtgacggccttggacgaccctcgtccctcaccgtgcgtctgtctcgtggtcncctcatcagtagtggtttctcggtgggctgggtccgnacgccgtaccggaggggtacgggctaggaactactagttggaatcgtctacgtagagttacggtggtaacggtttcctagttacgtcggttcccgtactacgtacgaaaggtcgtacgtacgtaccaacctaatcttccgtacgtaggaacctaccggttcaacgtacctaacgttaccgtttacgttttcccgaagtaacgttaacgttcggttaacgttcgttacgggaccgtaccccgacgggtacttccggtaaacggttacgggtttaccttttaaagttccgtaggtacggacggtaagtacggttacgtacgtttaagttgttaggttttagtttagggtaacgttttacgttacgtttacgaaccgttaccgtaacgtcggtaccgggtacgggttcccgtaacccggtcccggtaacggggtaccgtaaacggggttaacgttaccggttccggttaacccgtacccggttcccgtttaaacccgggttccgtaaccccgtttaacccgaaacccgggtacccggttaaccccgttacggtttcccccggttaacccccgttccccggttaaacccgtaccccccgttaaccccgtttaccccgaaaccggtaccgggtaacccgttaccccgggg

SEQ ID NO: 140090 - DNA, 834 bp, Homo sapiens
  misc_feature: GYAE6OF01AR7H5.46.67.G01.1.454.CMB.1.raw
tcagactagcagtacacgaccggtgctcgatttagagtatacatattgggtttgggggagtctcggtcaggacacagcatggacatgacgggtccccgctcagctccgtggggctcctgctactctggcctccggaggtgccagatgtgacagtcgagccgtcgaccctagtcctcccacttcccctcccgtgtcctcgaccgtaaccgggtgggacaacgtgtcgtaccaacctatcctaccgttcgggacccgggactaaacggtaccggaactagttaccgtaacctaaccttttaagttttaaacggttcggtaactaacctaacaacgttaaccggaaccggaacgggggtaaccccgacccttaagtccccttaccgttaaacgtaccttaggtcgccttaccggactaaccgttaccgttaggtttacggaccgggttaaacgggtccgggttaccctaacgggttcggtacgtttcggaagggtcggtacggtaggtcgggtaacgtcggtaaggggtaacttacgttaccttacctctacctaaccgaccgttattacgaacttagtaccgtaacgtaccgtaagtacgttaatttaacgtacgttaacttaacgtttacttaccgaacgttaaacctaacggttaaactaacgtttaactaccggtttacggtaacccgggtaacgtaaaccggtaccgtaaacgtaaaccttaaagtaaacctaacgtaccggttacgtagtcctaaccgtacgtacccttaggtactttcgttaccttaacctcccttcccggttaacctccgtaaccgtcgttaactccgg

SEQ ID NO: 140091 - DNA, 783 bp, Homo sapiens
  misc_feature: GYAE6OF01B01E3.46.67.G01.1.454.CMB.1.raw
  modified_base (439)..(439): a, c, t, g, unknown or other
  misc_feature (439)..(439): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctcgacccagtcctccactcccttccctgtctcgaccgtaaccggtgggacgactagtcgtaccaaccagtcctacgttcggacccgggacgtaaggtaccgaaccgtaattacggaacctaacctttaattttaaacgttcggtaacttaccgaaacgtacgtaaaccggacccggtaacggggaccccgtaccctaagccttaccgtaattcctagtgacctacggactaacgttccgtaagtttcgaacgtaacggggtccggtacctacgttcggtacgttanacggtgtacgtaggtgtacgtcggtaggacctagtacctttcacttccgtacaccctatacgacgttactgtacgtaacgaacggtagtagttactttacgaactttaacgttacttacgtacgtaactaaaccgttaattaaaccgtttaacgtaacgttttacggtttcccgaaaccgggtaacgtaacccgtaaaccgtaaaccttaaaacgttaaaccggttaacgttaacccggtggtaccgtaccgtaccggtactaaccggttacgtttacccgtcttacccgttaccttacccgtacccgttaacccctagtaaccgtttccgtaacgttaacccg

SEQ ID NO: 140092 - DNA, 707 bp, Homo sapiens
  misc_feature: GYAE6OF01BQPQP.46.67.G01.1.454.CMB.1.raw
  modified_base (210)..(210): a, c, t, g, unknown or other
  misc_feature (210)..(210): n is a, c, g, or t
  modified_base (349)..(349): a, c, t, g, unknown or other
  misc_feature (349)..(349): n is a, c, g, or t
  modified_base (425)..(425): a, c, t, g, unknown or other
  misc_feature (425)..(425): n is a, c, g, or t
tcagactagcagtacacgaccggtgctcgatttagagtatacatattggggtttggggagtctcggtcaggacacagcatggacatgagggtccccgctcagcctccgtggggctcctgctactctggctccggaggtcgccagatggtagacatcgacgctcgaccctagtcctccactcccgtcctgtctgaccgtaaccgggtgganacgtagtccgcaacctcgtctacgtgggaccggtactaacggtacggaaacttgtacgacctaactttaagtttaagtggtaactacaatagtacgaaccgacgggtaccaccctagtacctctaagtctagtgtcctnacctataccttaggttagaaccggtacgggttcccgacgtattaccgggtaggttactagggtcggagtacggtanccggttaggacgggacttaggttactccgtacgtctaaccactgtactaattacgtactagtaccgagtagtacgttagttactaacgttaacttacgttaacgtactaacgtaagtacgttaagttacgtttaacgttacggttaccggaacttaacgggaaccttaacgtaaataacgttaaacgttacgaggtacgtaccggtactaccggactaacttacttaccttaccgttaccttcttaccgttccgttacctaccgtacgttcgtagttaaccg

SEQ ID NO: 140093 - DNA, 840 bp, Homo sapiens
  misc_feature: GYAE6OF01ATBD8.46.67.G01.1.454.CMB.1.raw
  modified_base (230)..(230): a, c, t, g, unknown or other
  misc_feature (230)..(230): n is a, c, g, or t
tcagactagcagtacacgaccggtgctcgatttagagtatacatattgggtttgggggacctcctgtgcaagaacatgaagcacctgtggtttgtcctcctgctggtggcagcctcccagatcgggtcctcgtccctggtgcaactgcgaggacgtccgggacccagacgtggtcgaggtccttcggacgtaccctcgtccctcaccctgccgctcgtctcgtacggtcncctcagttcagttagttcgtttctcggtgggcctggggtccgctacgtccgtaccggagggacggtctaggaactacgtagttaggtaagttcgtactctacgtagtacggtggtacgttaccttagtaaccgacgttccgtctaccactaaggcggttacgacgttaccactaagtctacgtgacggtaccacgtaccgacgtactactaccgttacccgttttaccgaaggtaactacggtttacgttaccggttccgtacggttaccgggacccccgtccggttaaccgttaccgggtaaacccggttaacccggggttttacgtttttaaacggttccccggttaagggtaccgggtacgggttaaacggacgggttaacccggtttactttaagttttaaccggtttaggttttaaccgggtttttagggttaaccgggtttacgtttaaccgttttaacccgaccgttaaccgggtagtacccgggttaccggggtacccggtacccgttaccccgggtacccgggtcccgggaaacggtaccgtaacgttccggacggttaccctaccgtttaccccgtacccgttccgccccgtaaacccgg

SEQ ID NO: 140094 - DNA, 833 bp, Homo sapiens
  misc_feature: GYAE6OF01A6HP9.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagcctcccagatgggtcctgtccctggtgcaactgcaggagtccgggcccacgactggtgaggtcccttcggacgtaccctgtccctcacctgcgtctgtctcgtggtcgcctcagtcaggttagtcggtttctcgtggggcgtcgggtccgcacgcctaccggaaggggacgggtctaggtaactacgtagttagggtaacgttcgttaccttctacgtagttagggttgggtaacggtttccttacgttaacgtaccggttccgttccgtcgttaaccgaaggtacggttaccggtaacgtacccgtaaccctagttaccgttaccgttccgtaacgggtacccgtacccggttaccacgtaaccgtaactttaccgtttacgtttttacccgtaggtaaaaccgttgttacggtaacggttttccggtcggttaacccggtccccgtccccgtagttacccggtaaccgggttacccggggttaacttttacgttacgtgggtccgaaccggtaagggccggtttaagtcttttaagttacggtttgttttacgggttttaggtaggttttacggtttacgttacccgaccgtaccgtaaggtccggtacgggcccgggtaccgtacccgggtacccgggtagggacccggtaagggtacccgttacggacccggtccgtaacccccgtttgttaccccgttcgacccccgtaacccggg

SEQ ID NO: 140095 - DNA, 775 bp, Homo sapiens
  misc_feature: GYAE6OF01EWR6P.46.67.G01.1.454.CMB.1.raw
  modified_base (194)..(194): a, c, t, g, unknown or other
  misc_feature (194)..(194): n is a, c, g, or t
  modified_base (674)..(674): a, c, t, g, unknown or other
  misc_feature (674)..(674): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctcgacccagtcctccactcctccctgtctgcaacggtgganacagtgtcacctactctacgttcgccgggacaacggtcggaacattcgaaccgtaacctttaattttaaaagttggttaactaccgtaaactaacgtaacggaacccgaacggggacccggacccgtaaagcccttaacctaattcctacgtcgtctcgtactacttacccgttaggttttacgaaccggtaaacgggttccggggtaccccgtaagttccggttagggttacgtacggtaggcgtaaggtacggtagttcggtacgggaacaacgttactttcctacctcgtaccaactataccgtaattacgttcgtaaggcgtaaacggtagtaagtttaactttagtaaccgttaatttacgtttacctacgttaacctaataacgtttaaattaaccgtagtttcggtttacccgggaaaccgtaacgggttaaccgtaaacgtaaaccgttaaactaaaaggtttaaacccggngttacgggtacgttccgaacggtaccctaacgtacgtttccgttacgttaccctttaccgacttttcccccggacccgttacctacggttctaagtaaccg

SEQ ID NO: 140096 - DNA, 780 bp, Homo sapiens
  misc_feature: GYAE6OF01C77JH.46.67.G01.1.454.CMB.1.raw
  modified_base (98)..(98): a, c, t, g, unknown or other
  misc_feature (98)..(98): n is a, c, g, or t
  modified_base (180)..(180): a, c, t, g, unknown or other
  misc_feature (180)..(180): n is a, c, g, or t
  modified_base (329)..(329): a, c, t, g, unknown or other
  misc_feature (329)..(329): n is a, c, g, or t
  modified_base (763)..(763): a, c, t, g, unknown or other
  misc_feature (763)..(763): n is a, c, g, or t
tcagactagcagtacacgaccggtgctcgatttagagtatacatattgggtttgtcctcctgctggtggcagctcccagatgggtcctgtccctggtncaactgcaggagtccgggcccagactggtggacggtccttcggacgtaccctgtcccctcacctgcgcttgtctcgtggtcncctccatcgtaggtagttggtttctcggtggggctcggggtcccgcacggtccgtaccggagggggtacgggtctagggaaattcgagttacgggaagttcgtctcgtatacggtgtacggtacgtttacctatacgtacgtcccgttntccgtaacgaaggtcgtccgacgtaccacctagttactccgtacgtacggaaccgccgtacagtaccttaacttacgttccgtttacccgaaggtaattacttcggttacgtttcgtacggtcccgaccgtccgttacgacgttaaccgggtcggttttaagtttaactgttcgggatacggaggtacgtacgttacgttattaacggtaggttttagtttagggtagtttaccggttcttaaccgaaccgttcgtaaggtccgtccgggtacgggtccctacgggtacccggtgggacccgtaggttacgtccggttcgtacccgttacccgtcgtttaacccgccgtacctacccggtaaccggaaccgtttccccgtacggttcccgttcccccgttacacccgggtaccccttaccctaccggtaaaccncggtttacgaccccggg

SEQ ID NO: 140097 - DNA, 555 bp, Homo sapiens
  misc_feature: GYAE6OF01A9882.46.67.G01.1.454.CMB.1.raw
  modified_base (288)..(288): a, c, t, g, unknown or other
  misc_feature (288)..(288): n is a, c, g, or t
  modified_base (355)..(355): a, c, t, g, unknown or other
  misc_feature (355)..(355): n is a, c, g, or t
  modified_base (547)..(547): a, c, t, g, unknown or other
  misc_feature (547)..(547): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaattggtatcaacatagaccagggacgccctaagctcctaatctatnctcgcatccagtttgacaaaggtggggtacccagtcgtaggttcaggtggcgagtggatcgtggganagtatttcactctcacatcatactctgacaacgtagaagtatttagactaactttattactgtacaactagtaacttactaattggtttccggaaccgtaagggacctaaccgtaactaactaaaacgttaacgaacttggtacggacctgacctaactattcgtcttccttactacttccttccgaccttntctgtacc

SEQ ID NO: 140098 - DNA, 782 bp, Homo sapiens
  misc_feature: GYAE6OF01ASHM8.46.67.G01.1.454.CMB.1.raw
  modified_base (116)..(116): a, c, t, g, unknown or other
  misc_feature (116)..(116): n is a, c, g, or t
  modified_base (425)..(425): a, c, t, g, unknown or other
  misc_feature (425)..(425): n is a, c, g, or t
  modified_base (433)..(433): a, c, t, g, unknown or other
  misc_feature (433)..(433): n is a, c, g, or t
tcagactagcagtacacgaccggtgctcgatttagagtatacatattgggtttggggagtctcggtcaggacacagcatggacatgagggtccccgctcagctcctggggctcctnctactctggctccgaggtgccagatgtgacatcgagctggacccagtctccatcctccctgtctgaccgaccgtgggagacgagtcgtaccaccatccgacgttcggcgggacaaggttccgaacgtattacggaacctaaccgttaattttaaagttgtactacaacgtagtaacgaccggacgggaccggtacccctaagtcctacctaattctaagttcgcctagacctacgtacccgtagggtttacgtaccgaagggtccgggtaccctaaggtcggtaggttcgaggtcggacgtaggtacgngttacggnggaactatacgtttaccagtccaccgtactacgtactagtaactcgtacgtacgtacgtacgtaagtttacgtttaccgtacttaaacgtttcgtttacgtaaccttaacgtaaatttaaccgggtttaaacttttaacgtttaacgggtttaacccggtttaccggtaacccgggtaaaggttaaaccccgaaaccgttaaacgttaaaacccttaaaggtttaaaccgtaacgtacggttaccgtactaaccgtacccggtaaacctttggttaccccgttagtttccccgtaaccctttaccgtacccctttacccggtacccttaggttacccttcgttaaaccg

SEQ ID NO: 140099 - DNA, 742 bp, Homo sapiens
  misc_feature: GYAE6OF01BWZHZ.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatccacttcggccgggcaaggtaccggaacattacgaacctacctttaatttaaaagttggttaatactaactacgtaacgaccgaacggggaccgtacccctaaagccttacctaactcctagtcgcttggctacgtccgtagtttacgacgtaaacggtcggggtccctagtcggtaggttacgaggtggacgtacggtaggacgtacgttggggacgtaacgtacgtttacgtacctctaccctaacctacgttacgtacgttaacgtccgtagaccgtaacggttaggtaagttacgttttacggacttaaaccgtttagttaaccgttacgtaaccgtaaacgtaagttaaacttaacgttaacgtttacggtttaaccggaaccggttaaaggggaaccttaaaccgtaacttaaaaccgtaaacgttaaacgtaacggtacggttcggtacctacgggtaccaacccgttattaccgttacgttccttaccgttacttcccggttaacccctactacgttacgtcgtaaccc

SEQ ID NO: 140100 - DNA, 1101 bp, Homo sapiens
  misc_feature: GYAE6OF01CG2ZG.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtccgggcccacgtactgggtgagggtcccttcgggacgacccccttcgttccctacgtacgtcggccgttcgtcgttctacggtgggtccaccctactatacgtaggttcggttttcgttttcgtcggggtcggtcgggtaccgggtccgcgaccgtcccgacgggtaacgggggtaccggtagttaaggtaacgttacgttaaggttacgggtacgtccgttctacgtagtaacgttcgggttaacggttccggtttacttaaccggtaccgttacggtttccttaccgtacgtaacggtaacggtaccgtaacggttcccaaaacctaccgttacgttaccgtaccgttcggaccggtacctacccgtaccgttaagaacccgtttactaacccgtttttacccggttacgtaaaggttacgtaaggtttacgtttaccccggttagggttacccgtacccggttacccggtcggtacggttaaccgggtaaccggtttaccgggtttttaacttaaacggtttcccggttaaagggtaccggtaaacggtaccgggttaaaccggtacccggttttaagtttaacgggtttaacggttttaacggtttttaacggggtttaccgggttttacgggttttaacccgttttaccggttaaccccgtaaacgttacccgggtaacggttaacccgggggttacccggggttaccccggggttacccgggtaaccccggttaacccgggggtttaacccgggtaaacccggggttaaacggtttaacccgggttccgggtttaacccggttcccgttacccggtttaacccgttaacccggtaccccggttaccccgaaacccgggttccgggtaaccccggtttaccccgtccccgggtttaacccccgtttcccggttaaacccccggtcccggtttacccccttaaccccggtaaccctaacccgtcgggttaaacccgtcccccgggg

SEQ ID NO: 140101 - DNA, 677 bp, Homo sapiens
  misc_feature: GYAE6OF01EKILM.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccactcctccctgtctgccgaaccggtgggagacagtgtccaccatcctacgttcggccgggacaacggtccggaactagttacgaactacctttaatttaaaagttggtaactacaaactagtaacgaccgacggggacccgtaccctaaggcctacctaatcttatcgctgctactccgtagttcgacgtaacggttcgggtacctagtcggtagttcgaggtggcgtaggtgacgtcggtaggactagtacttcactctacacctagtacgtagtactcgtacgaacgtagttagtaagtttacttacgaactttaacgtttacgttacgttacgtaaccgtaacgtaacttaagttaaccgtaagtttccggttaaccggaaccggtaacggacctaaccgttaaacgtaaactaaacgtaacggtacgtcggtacgtccgactaccgaccttacgttactcgttactttcccgtaccttcccgtccgaacttcttcgtacgttaccg

SEQ ID NO: 140102 - DNA, 729 bp, Homo sapiens
  misc_feature: GYAE6OF01A7YF9.46.67.G01.1.454.CMB.1.raw
  modified_base (489)..(489): a, c, t, g, unknown or other
  misc_feature (489)..(489): n is a, c, g, or t
  modified_base (674)..(674): a, c, t, g, unknown or other
  misc_feature (674)..(674): n is a, c, g, or t
tcagactagcagtacacgaccggtgctcgatttagagtatacatattgggtttggggagtctcggtcaggacacagcatggacatgagggtccccgctcagctcctggggctcctgctactcgtggctccgaggtgccagatgtgacatcgagctcgacccagtcctccactccctccctgtcgtgacgaccggtgggacgacgtagtcgtaccaccgtattcctacgttcggaccgggtactaacggtacgaactagttccgaacctaaccttaagtttaaagttcggtataccaactataacgaccgagggtacccgtaccctaagtaccttaccgtaatcctagtacgtctcgactacgtccgtagtttacgacgtaacggtcggtaccagtacggtagttacgacggtggacctaggtacgtacgtcggtagggactagtttacgtacctacgtcctaacgtacctacgtactaagttaaccgtntacggtaacgaacgttaagttaacgttaacgtttcgtaaactttaacgttacttaacgtaacgtaaccgtaagtaacgttaacttaaccgttagtttaccggtttaaccgaaccgtaaaccggtaaccgtacgtaacttaaaacgtaacgttaactaacgtcgtacgtctaacgtcaaccgttancgttaactcctaaccttccttacccggtaccctattacgtacgttaagtacccgg

SEQ ID NO: 140103 - DNA, 783 bp, Homo sapiens
  misc_feature: GYAE6OF01B0FK2.46.67.G01.1.454.CMB.1.raw
  modified_base (150)..(150): a, c, t, g, unknown or other
  misc_feature (150)..(150): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaacgtgcaggngtccgggcccacgactgggtgacggccttcggacgaccctgtccctcacctgcgctgtctcgtggtacgccctacatcgaaggttgttcggttttccttcggtgggggcgttgggggtcccggctacggccgttcccggaagggggaacggggtccgttagggtaaactaccgtaggtttagggaaagtcggttaccttcgtaccgaagttacggtcgggtacggtttacctaagtttaccaggttccgtacgtcctacgaaaggtcgtacgaagttaccaacctaattacgtcgtattacgggaactaccgtacacgtacgtaactacgtttacgtttacccaggaaatacgtagttactttcgacgttacgacccgacgtacgtacgaaccggtacgggttacgtttacgttcgtagttcggtacgagtacggacggttacgtttaattacgtaggtttagttttaggggtagtttacggtttacttaccggaactaccccggtagtacgtaccggggtacgggtcccgttaaccgggcccggttagggggtaacccgtacggggtaaacttacgggttaccggtacccttacccggttcccttaacccggttacggcccctaaacccggg

SEQ ID NO: 140104 - DNA, 781 bp, Homo sapiens
  misc_feature: GYAE6OF01CX5LB.46.67.G01.1.454.CMB.1.raw
  modified_base (372)..(372): a, c, t, g, unknown or other
  misc_feature (372)..(372): n is a, c, g, or t
  modified_base (377)..(377): a, c, t, g, unknown or other
  misc_feature (377)..(377): n is a, c, g, or t
  modified_base (776)..(776): a, c, t, g, unknown or other
  misc_feature (776)..(776): n is a, c, g, or t
tcagactagcagtacacgaccggtgctcgatttagagtatacatattgggtttggggagtctcggtcaggacacagcatggacatgagggtccccgctcagcctcctggggctcctgctactctggctccggaggtgccagatgtgacatcgagctacgacccagtctaccactccctccctgtcctgaccgaaccggtgggaacgacgtaggttcgaccaaccacgtactaccggttcgggaccgggtacaaacggtccggaaactactttacggaccttaaaccttaagttttaaaagttgggtaactacaaacgaagtaacgaccggaacgggtaccggtaccctaagtcctaactaacgtacttacgngtacncgtactaacgttacccgtaggtttacgaacgtaaacgggttccgggtaccctaagttccggaacgggtttcgaaggtcggacgtagggtagtagttacggcgggaaactaggttaacttaccgttaacctcgtaaccgaacctaagtaccgtaagttaacgttcgacggtaaccgtaaacggttagtaaacggtttatttacgtaaacctttaacgtttaacgttacgtaacgtaaacctaaagtaacgttaaacgtttaacttaacgggtttacggtttaacccgggaagtaaaccgggaaccgtaacgtaaaccttaaacaaaacgtttaacgaacgtaggtcgtacgtacgtacctacctagttctcgttactactactccctacgactcttagtntaacg

SEQ ID NO: 140105 - DNA, 839 bp, Homo sapiens
  misc_feature: GYAE6OF01BNOOF.46.67.G01.1.454.CMB.1.raw
  modified_base (763)..(763): a, c, t, g, unknown or other
  misc_feature (763)..(763): n is a, c, g, or t
tcagactagcagtacacgaccggtgctcgatttagagtatacatattgggtttggggagtctcggtcaggacacagcatggacatgagggtccccgctcagctcctggggctcctgctactctggctccggggtgccagatgtgacatcggagctgacccagtcctccactccctcctgtctgacgaaccggtgggagacctaggtcgtcaccgtatctaccgttcgggacccgggtacaacggttacggaaacctagtttaggaaccctaaccgtttaaattttaaacgttagggttaactaccgaaacgtaacgtaaccggaacccggaacggggacccggtacccccttaaggaccctttaaccccgttaaagttccttaacgttaccggtaccgttacggtacccttaacgttccccgttaagggttttaccgggaaccgttaaaacgggggttcccgggggttacccctaggtttaccggggtaacggtttccgtacgggttcggaccggtaagggttaccggtagtttaccgggaagggtacctaaggttacgtttacccacttacccgtaccgacttactacgtaaggttacctcgtacgaccgttaaggtagttaacttaggtttactacctttaaacgtttacctagttacgttaacgtaaacgtacttaaattaccgtacgttttacgggttacgaccgtaaagggtacccaaggttaacctaagtaaacgttaacgtacggtactaccggtntaccgtaccgtacgttcttacgttacgtcccttcgtacccttccgtccctacgtattactaccgggtattacccgg

SEQ ID NO: 140106 - DNA, 904 bp, Homo sapiens
  misc_feature: GYAE6OF01AHSP8.46.67.G01.1.454.CMB.1.raw
  modified_base (176)..(176): a, c, t, g, unknown or other
  misc_feature (176)..(176): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgacggtccttcggacgaccctcgtccctcacctgcgctgtctctggtcncctccatctagttaggttggtttcttcggtcggggtctcggggtccgcacgcctcccggagggggaacgggtctaggaactactagttcggaagttcgttctctctagttaggtgggttacgttcctaagtttaccgtacggttcccgtcttacctacgtaaagtcgtacgacgtacctaccgtaagttactcctacgtacggaactacccgtccaagtaccgaacttccgttacgtttcccgaagtaaggtacgttaggtttaacggtttcgttcggtacccggtacccggtcccgtcggttacggtaacccggtaccgggggtttacctttttaacgtacggttcggacgggttaccggtaacggtacgggtaccggttactttaaggtttagtttaagggttttacggtttttacgggttacgggtttttaacggttttaccggtttacccgaaacccgttcccgggttaagtaccgggtaccgggggtaaccggggtcccgttaaccccgggtccgggtacccggggtaccgggtaaggttaacccggtttacggtacccgggttacccttaccccgggtttcccttcccggttaccctacccccggtaaacccgtaaccccggtacccgggttacccttacccggttcccccgttaacccccggtttcccccacccggtccccttaccccgtaacccgtaccggaaccgtcccggtaccccgg

SEQ ID NO: 140107 - DNA, 707 bp, Homo sapiens
  misc_feature: GYAE6OF01EJL33.46.67.G01.1.454.CMB.1.raw
  modified_base (176)..(176): a, c, t, g, unknown or other
  misc_feature (176)..(176): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgagggccttcgggagaccctgtcccctcacctgcgctgtctctggtcncctccatcagtagttggtttctcgtggggctgggtccgcagcctccgaggggagggctaggaatacagttaggaagtgtctctcagtagtggacggttcctattacacgttccgtctctacaagagtcgacgtcaccattactctcgtggacacgtccagcatctacttttccagaagtatgtacttctcgtacgaccgccgcgtcggacgtacgggtacttttacttacgtggtacgacggaggtacgtacggtaccttagtttaagtagtttaagtttttcgggtaaggtttggtttaaccgtttacgaaccctacccgttaggtaaccggtcgggtaccggggtccgtacccggtacccggtcgggacccgtaagggtaacttaccggttcggtaccgtacccgtccttaccgtaccgtcccgtaccgtaacccgaccgggtaccctaaccggttccccggttaccccctttccccgtaccggtaccccctaccccgtaccccaaccgtaaccgacccgtacccccgg

SEQ ID NO: 140108 - DNA, 737 bp, Homo sapiens
  misc_feature: GYAE6OF01EVS9H.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatcctcctgtctcgacaaccgtggagacagtcgtacaccatcgacgttggccggcaagtcggaactattagactaccttaattaagttggtatacgaacagtaacggaccgagggaccgtaccctaagcctaccgtaatccttagcgtactacgactacgttccgtaggtttcgaccggtaaacggttcgggtaccctagttaccggtaggtttcgaaggttcggaccgtaggtaggtacttcggtagggtaactaacggttaccttttaccgaccgtttccgtaccgtaaaccgtattaccgtaaggttaaccgttcgtacgtaccgtaacggttaagtaacgttacgtttacgaaccgtttaaactttacgtttacgtacgttaaccaaacggttaacgttaaactttaacgtaacgtttacggtttaaccggaaccggttaacggaaccgtaacgtaaccgttaaacgtaaacgttaacgtaacgtacggtacggtactacgtaccgtacgttatccgttgtacctttacgaccgttcccttacccgtactacgttccgtagtaacg

SEQ ID NO: 140109 - DNA, 795 bp, Homo sapiens
  misc_feature: GYAE6OF01C81RF.46.67.G01.1.454.CMB.1.raw
  modified_base (153)..(153): a, c, t, g, unknown or other
  misc_feature (153)..(153): n is a, c, g, or t
  modified_base (570)..(570): a, c, t, g, unknown or other
  misc_feature (570)..(570): n is a, c, g, or t
  modified_base (579)..(579): a, c, t, g, unknown or other
  misc_feature (579)..(579): n is a, c, g, or t
  modified_base (721)..(721): a, c, t, g, unknown or other
  misc_feature (721)..(721): n is a, c, g, or t
  modified_base (730)..(730): a, c, t, g, unknown or other
  misc_feature (730)..(730): n is a, c, g, or t
  modified_base (738)..(738): a, c, t, g, unknown or other
  misc_feature (738)..(738): n is a, c, g, or t
tcagactagcagtacacgaccggtgctcgatttagagtatacatattgggtttggggagtctcggtcaggacacagcagtggacatggacgggtccccgctcagcctccgtggggcctcctgctacgtcgtggctccggaggtcgaccaggtntgtacgactagtcgagctcggaccctcgtcctcccactccccgtcccgtgtcgtccgaccgaaccggtgggaacgtacgtagtccgaccacccgtactaccgtaccggttaccgggacccggaacgtaacggtacggaactacgttaccgaaccgttaaacttttaagtttaaacgttacggtaactaaccgtaaacgtaagtaaccgggaacccggtaacggggtaccccggtaacccctaaggtacccctaccgttaaacttcgtaacgtcgtacggtccacttaacctaccgttacgggttaacgaaccggtaacgggttcccggtaccgtacgggttaccgttaaggttaccgtaggtcggggaccgtaggggtacgtacgttacggacgggtaataccgttcttacctaccnccgtaacanagttaccgtataactcgacacgtaacgtaggttattacggttatacgttaattactattgaacaagttaacgtaagttaccgtagtttacggtaccgtaaggaaccgaacgttaacgtaaaccaacgttaaactgtaaacgnggtagtccngtaacccncttactcgttacgtcttaacggtcccttaacccggtccacgttacctattaccggtc

SEQ ID NO: 140110 - DNA, 788 bp, Homo sapiens
  misc_feature: GYAE6OF01EI0HD.46.67.G01.1.454.CMB.1.raw
  modified_base (171)..(171): a, c, t, g, unknown or other
  misc_feature (171)..(171): n is a, c, g, or t
  modified_base (208)..(208): a, c, t, g, unknown or other
  misc_feature (208)..(208): n is a, c, g, or t
  modified_base (286)..(286): a, c, t, g, unknown or other
  misc_feature (286)..(286): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttctcgtgggctgggtccgnagctccgagggagggctaggaatacagttggaagtgtctctcagtagtggagttcctattacagtccgtctctcaagngtcgagtcacatactctctggacacgtccagcaatctacgttttcccagaacgtatgtacgtttcgtacggtacggacccgtcccgcgtacggaaccgtaccggggttcgtttttaacttaccgttggtcggacggtaaggtaacggtaccggtactttaagtttacgttaggtttaaggttttttaggggaggttttacgggttttacttttacccggaaccgttaaccccgttaaggtaaccggtttacccggggtaccggggggtacccttacccgggtaacccccgggtacgggggtacccggtaaggggtaaaccttaccggttcgggtaccccgttacccggttcccgttacccgttaccgtcccccgttaacccgaacccgggtaacccggggtacccctaaccggtttccccgggttaccccccgtttccccccggtaccgggtaccccctaccccccttaccccgtaacccggaacgtaccggtaacccccgg

SEQ ID NO: 140111 - DNA, 761 bp, Homo sapiens
  misc_feature: GYAE6OF01A0LDT.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtccgggcccacgactggtgaggcccttcggagaccctgtccctcacctgcgctgtctctggtgcctcatcagtagtggtttctcgtgggctgggtccgcagcctccgaggggaagggctaggaactacagtttaggaagttgtacctctacaagttaggtgggtacggtttccttaagttaacacggttcccgttctcctacaaaggtcgttaccgacgttaccaacctagttaacttccgtccgtaggacctaccgtccaagacctaaactcgttacgttttcccgagaacgtgttagtacgttcgtgtaccggacccgctcgtacgaaccggtaccgggttacttttaatcgtgtcgacgagacgtacgtcttagttacgttgttacgtttttagggagtttacggtttacgttaccgaccgttaacccgtaggtaccggtcggggtacggggtcccgtacccgggtacccggtacggggtaccgaacggggttaacgttaccgttcgggtacctacccggttccgttacccggttaccgaccccgtacccgtaacccggtaacccggtacccgttaaccggttcccggtttccccctccccgttaccggcccctaccccgttacccgccgtaaaccgccgtaccccgg

SEQ ID NO: 140112 - DNA, 587 bp, Homo sapiens
  misc_feature: GYAE6OF01CRS1G.46.67.G01.1.454.CMB.1.raw
  modified_base (96)..(96): a, c, t, g, unknown or other
  misc_feature (96)..(96): n is a, c, g, or t
  modified_base (195)..(195): a, c, t, g, unknown or other
  misc_feature (195)..(195): n is a, c, g, or t
  modified_base (208)..(208): a, c, t, g, unknown or other
  misc_feature (208)..(208): n is a, c, g, or t
  modified_base (324)..(324): a, c, t, g, unknown or other
  misc_feature (324)..(324): n is a, c, g, or t
  modified_base (350)..(350): a, c, t, g, unknown or other
  misc_feature (350)..(350): n is a, c, g, or t
  modified_base (355)..(355): a, c, t, g, unknown or other
  misc_feature (355)..(355): n is a, c, g, or t
  modified_base (357)..(357): a, c, t, g, unknown or other
  misc_feature (357)..(357): n is a, c, g, or t
  modified_base (359)..(359): a, c, t, g, unknown or other
  misc_feature (359)..(359): n is a, c, g, or t
  modified_base (382)..(382): a, c, t, g, unknown or other
  misc_feature (382)..(382): n is a, c, g, or t
  modified_base (392)..(392): a, c, t, g, unknown or other
  misc_feature (392)..(392): n is a, c, g, or t
  modified_base (581)..(581): a, c, t, g, unknown or other
  misc_feature (581)..(581): n is a, c, g, or t
tcagactagcagtacacgaccggtgctcgatttagagtatacatattgggtttggggagtctcggtcaggacacagcatggacatgacgggtcccnctcagctcctggggctcctgctactcgtggctccggaggtgcagatgtgacatcgagtctgacccagtctccactccgtcctgtctgcaacggtggganactagtcgtcacntcacgttcgccggacaagtacggaactattacgaactaacctaattttaaacgtgtaatacaaactataacgacaacgggaccgaccctaagctacctaatactatcgactgactntctagttgacaggtcggcctagtcgngtacngngnagtgctcgtgacagtactttacnctctaccaantaacacgtattctagactaagtaagaacttaatttagaaccttaatacgttaactacgtaactaacgtaataataacttaaagttcggtttacggaaccgtaacggtaaacacgtaaacctaaagtaaacgttaacgaacgtagacgactcgacactatctacgttctacgaattccgacctactactntgtaac

SEQ ID NO: 140113 - DNA, 858 bp, Homo sapiens
  misc_feature: GYAE6OF01A1QKN.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgccgaaccgtgggacgacctagtcgtccacctatctacgttcggaccgggtacaaacggtccggaaacctagttacggtaacctaacctttaaacgttttaaaaacgtttcgggttaaacttaccaaaacgtaacgttaacgggaacccgaaaccggggggtaacccggtacccctaaaacgttccgttaccccttaaattaccgtaacgtcgtaccgtacgtacctacttaccggtacgtttacgtaccggtaaagggttcccggggtacccgtagttacccgggtaggtttaccgaggtcggtaacgtaggtcggtaccgttacggtaacgggactaggttactttcgaccttccgtactaccgtacttacggtaacttactaccgtagaccgttaacggtacggtaagttacgtttacggaacctttaacctttacgttaaccttagtaacctaataacgttataacgttaccgtttacggtttaccggacctaaagggtaaccctaaccgttaagtaaaacccgttaaacgtaaacccgttacggtttacgaacggggttacctacgggtaaccctaccgtaacgtttaccggtttaccgttacccgtttaaccccttaccggttaacccgttacccccggttaaccttaacgtttccccgttagtttaaaccccg

SEQ ID NO: 140114 - DNA, 876 bp, Homo sapiens
  misc_feature: GYAE6OF01ERSJ6.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctcgacccagtcctcctactcccttcccgtgtcgtgaccgaccgggtgggacgtacaggtctaccaccatcctacgttcgccgggacgtaacggtaccggaactagttacggaaccttaacctttaaagttttaaacgttcggttaactaccaaaccgtaagtaacggaaccccggaacgggggtaccccgtaaccccgtaaggtacccttacctaaacgttccttaacgtcgccgtcggtaccttacgtacccgttaaggtttacgaacggtaacggggttccgggtaccctaagtcgggttaacgtccgtaggtcggacgtggtacggtatacgggtacgggtaactaggttaaccctttacgacgttccctaaccgaactaacgtcctaaaggttactaccgtacaaccggttaacgtaaggttaacgtttacttacggtaaacctttaattaacctttaccgtacgtttaaaccaacgttaacgtttaaatttacccttaagggttttaccgtttaaaccgggaaaccggtaacggtaaaccgtaaaccggtttaaacgtaaaaccccggttaaaagtttaacccggtaaccggttggttaaacccgttccgaaccggttaccctaaccgttttacgttaccgttaccggttaaccctttcccgtacccgttttaaccgacccctttaaccgttacggttttaacctcggtttaaacccg

SEQ ID NO: 140115 - DNA, 678 bp, Homo sapiens
  misc_feature: GYAE6OF01APS26.46.67.G01.1.454.CMB.1.raw
  modified_base (200)..(200): a, c, t, g, unknown or other
  misc_feature (200)..(200): n is a, c, g, or t
  modified_base (215)..(215): a, c, t, g, unknown or other
  misc_feature (215)..(215): n is a, c, g, or t
  modified_base (231)..(231): a, c, t, g, unknown or other
  misc_feature (231)..(231): n is a, c, g, or t
  modified_base (338)..(338): a, c, t, g, unknown or other
  misc_feature (338)..(338): n is a, c, g, or t
  modified_base (660)..(660): a, c, t, g, unknown or other
  misc_feature (660)..(660): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctcgacccagtcctccactccctccctgtcctggaccaacggtggganacagtcgtccaaccntcacgttggccggganaaggtacggaactattacgaactaccttaattttaaacgttgtaactacgaaacaagttacgaccgaggggaccgtaccctaagtcctacctaactactatcgcgtncacttacgtagtttagacgtaaggtcgggtaccctagtcggagttacgaggtcgcgaggtaggagtcgtggactagtacttacgactccgtacactacgtacgataacgtctagactaacggtagtaagtacgtttacgattaaaccttacttacctacgttaaccaactaagttaacttaacgttaacgtttcggtttaacccggaacgtaacgggtaaccctaacgttaacaaacgttaaacgttaaacgacgttacgtacgggtactaccggtaacctaccgtacggttactcgttcctaccgtacgttcccttacccnttaacgttcgtaacgtac

SEQ ID NO: 140116 - DNA, 761 bp, Homo sapiens
  misc_feature: GYAE6OF01AYQMW.46.67.G01.1.454.CMB.1.raw
  modified_base (173)..(173): a, c, t, g, unknown or other
  misc_feature (173)..(173): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggccttcggagaccctgtccctcacctgcgctgtctctggtcncctcatcagtagttggtttctcgtgggctgggtccgcagcctaccgaggggagggctaggaactacagttggaagtcgtctctcagtaggtggtaggttccttattacagtccgtctctacgaagtgtacgagtccaacatactcctcgtcggacctaccgtaccagacctaattccttacgttttcccaggaagtagtagtagtttctaggtcgtacccgcccgtcgtacgacggtacgggttacttttaacgttacgttggtcggacggtaggacggtacggtattaacgtttagttacgtttagtttttagggtaggtttacggtttacgtttaccggaaccttaccccggttaaggtacggttaccggggtacccggggtcccgttacccgggaccccgggttcggggaccggtaagggtaacgttaccggttacggtaccctacccggttccgttaccgttaccgtccccgtacccgtaacccgggaccgggtaccccttaggttcccccgggttaccccgttaccccccgtccgggtaccccctaccccggttacccgtacccgtaacgtccgtaaccccgg

SEQ ID NO: 140117 - DNA, 655 bp, Homo sapiens
  misc_feature: GYAE6OF01ES7I5.46.67.G01.1.454.CMB.1.raw
  modified_base (180)..(180): a, c, t, g, unknown or other
  misc_feature (180)..(180): n is a, c, g, or t
  modified_base (192)..(192): a, c, t, g, unknown or other
  misc_feature (192)..(192): n is a, c, g, or t
  modified_base (258)..(258): a, c, t, g, unknown or other
  misc_feature (258)..(258): n is a, c, g, or t
  modified_base (361)..(361): a, c, t, g, unknown or other
  misc_feature (361)..(361): n is a, c, g, or t
tcagactagcagtacacgaccggtgctcgatttagagtatacatattgggttgggggacctcctgtgcaagaacatgaagcacctgtggtttgtcctcctgctggtggcagctcccagatgggtcctgtccctggtgcaactgcaggagtccgggcccacgactggtgaggccttcgganaccctgtccccncacctgcgctgtcctcgtggtcgcctaccatcagttgttcggtttctcggtggggtctgggtccgnacgtcctaccggaggggaacgggtctaggaactactagttaggattcgtctctctagttacggtggtacggttccttattacgacgttccgtctctacgaagngtcgactacactatatctcgtacgacctacgtcacgtactaactcgttactttcccgagaacgtagtagttacgttcgtgtaccgaccgcgtcgtaggaccgtacgggttactttactcgtaggtcgacggtagcgtacgtacttattgtagtttagttggtgtttacgttattaccgacgtaccgtagacggtccgggtaccgggtcctacccggtacccgggtagggaccgtaacgggtacgtacgtccggtacccttaccggttaccttacccgtacccgcccgtaacccg

SEQ ID NO: 140118 - DNA, 770 bp, Homo sapiens
  misc_feature: GYAE6OF01AFU7Y.46.67.G01.1.454.CMB.1.raw
  modified_base (316)..(316): a, c, t, g, unknown or other
  misc_feature (316)..(316): n is a, c, g, or t
  modified_base (333)..(333): a, c, t, g, unknown or other
  misc_feature (333)..(333): n is a, c, g, or t
  modified_base (409)..(409): a, c, t, g, unknown or other
  misc_feature (409)..(409): n is a, c, g, or t
  modified_base (765)..(765): a, c, t, g, unknown or other
  misc_feature (765)..(765): n is a, c, g, or t
tcagactagcagtacacgaccggtgctcgatttagagtatacatattgggtttggggagtctcggtcaggacacagcatggacatgagggtccccgctcagctccgtggggctcctgctactcgtggcctccgaggtcgccagatgtgacagtaccgaactcgaccccagtcctaccacttccctacctgtctcgaccgtacggtgggacgacgtagtgtaccaccatcctacgtcggccggactaaggcgaactgttacacctactttaatttaagtcgtaatacaactagtacgaccgagggacccgtacctancgtacctagtctagcgngtcgactacgtacgtacgttacgaacgtaacggtccggtaccctaggtccgtaagttccgaggtcgacgttacggngtaccgttaggtaccggtaacgttacgttacgttaccgtacgtaccctaccgtaacgttaaccgtttaccgttaaacggttacttccggtaacgtaaacccggttaaacggttacggttaaacgttttaccgtttaaacccgtaaccgttttaaaccctttagggttaacctaccgggttaaacctaaacgtaacggtttaacctttaacggttacgtttacgggttaaccgaccggtaaaccgtacttaacccgtaaagttaaacctaaacgggttaacgtacgttcggacttaccggtataccgtaaccggtctttacggacttctaccgtctaccgtcgtcaagtctaacgtntacgg

SEQ ID NO: 140119 - DNA, 699 bp, Homo sapiens
  misc_feature: GYAE6OF01CKCJS.46.67.G01.1.454.CMB.1.raw
  modified_base (202)..(202): a, c, t, g, unknown or other
  misc_feature (202)..(202): n is a, c, g, or t
  modified_base (206)..(206): a, c, t, g, unknown or other
  misc_feature (206)..(206): n is a, c, g, or t
  modified_base (248)..(248): a, c, t, g, unknown or other
  misc_feature (248)..(248): n is a, c, g, or t
  modified_base (264)..(264): a, c, t, g, unknown or other
  misc_feature (264)..(264): n is a, c, g, or t
  modified_base (268)..(268): a, c, t, g, unknown or other
  misc_feature (268)..(268): n is a, c, g, or t
  modified_base (315)..(315): a, c, t, g, unknown or other
  misc_feature (315)..(315): n is a, c, g, or t
  modified_base (378)..(378): a, c, t, g, unknown or other
  misc_feature (378)..(378): n is a, c, g, or t
  modified_base (683)..(683): a, c, t, g, unknown or other
  misc_feature (683)..(683): n is a, c, g, or t
  modified_base (692)..(692): a, c, t, g, unknown or other
  misc_feature (692)..(692): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtcgccagatgtgacagtcgagtctcgacccagtcctccactccctccctgtcgtgacgaccggtggganacgngtgtccactatactacgttcggccggacaaggtaccgatatnactactattaatgtancaanagtacgacgacgggaccgtacctaagcctactacttacgatcgtctntactacgtccgtagttacggagtaacggttcgggacctagtcggtagtcgaaggttcggacgnggtacgtagtcggtaggaacgtacgttaccttacggtaccttcccggtaactacccgtacttacgtaacgttaacgttccgtaacggtaaccgtaagttacggttaaagttagtttcgtaaacctttaactttacgtaacttaacgtaactaacgtaactttaaacgttaacttacggtttaacggttaccgaacggttaacggaacctaaccgtaaacgttaacgtaaacgttaacgtacgtggtaccgtacgtcgaacctccgtagttacgttcgttacctactaccccttaccgtccgtacncgtttaccnggttacc

SEQ ID NO: 140120 - DNA, 868 bp, Homo sapiens
  misc_feature: GYAE6OF01AKUCN.46.67.G01.1.454.CMB.1.raw
  modified_base (194)..(194): a, c, t, g, unknown or other
  misc_feature (194)..(194): n is a, c, g, or t
  modified_base (852)..(852): a, c, t, g, unknown or other
  misc_feature (852)..(852): n is a, c, g, or t
tcagactagcagtacacgaccggtgctcgatttagagtatacatattgggtttggggagtctcggtcaggacacagcatggacatgagggtcccgctcagctcctggggctcctgctactctggctccgaggtgccagatgtgacatcgagctggacccagtctccatcctccgtgtctcgcgaaccgtggganactagtcgtccaccagttcacgttcggcccggtacgaaggtaccggaactattcggaacctacctttaagttttaaagttcggtataacaacgtaagttaacgaccggtaaggggacccgtacccgtaacgtccgttaaccttaaacttaccgttagtaccggtccgttacgtaccgtaaccgtttcccggtaacggttttacggaaccggttaaacgggttccggggtaacccctaagggttacggttaacgggttttaccggaagttaccggacggtaacggttgtaacccggtacggttacgggaaccgtaggttaactttaccgtaccgttcgtaacccgaacttacgttaacgaacgtttaactccgggtaacgtaccgtaacgttacggtaaagtttacgtttaccgtaacgtttaaaccgtttacgttaacccggttagtaaaacccgtaaggtttaaacctaacgttttaacccgttaaggttttaccgggttttaccgggaaacccgggtaaacggtaaacccgttaaccgttaaaccgttaaaagttaaaaccgttaaccggtacgtaggttacggaaccgttacgtaaccgtaccgttacgttacgttcgtttaaccgtacttacccgggttactacccgtaaactnttaaaccgtcgtaacg

SEQ ID NO: 140121 - DNA, 720 bp, Homo sapiens
  misc_feature: GYAE6OF01D15UF.46.67.G01.1.454.CMB.1.raw
  modified_base (669)..(669): a, c, t, g, unknown or other
  misc_feature (669)..(669): n is a, c, g, or t
tcagactagcagtacacgaccggtgctcgatttagagtatacatattggggtttggggagtctcggtcaggacacagcatggacatgagggtccccgctcagctccgtggggctcctgctactctggctccggaggtgccagatgtgacatcgagctgacccagtcctccactcctccctgtctgccaaccggtgggacgacagtcgtcacctatcacgttcggcccgggataacggtccggaactagttcgaacctacctttaattttaaagttggtatacaaactataacgaccgacgggaccggaccctaagcctactaatctatgctgctacgtctagttgacgtaacggtcgggtaccagtcggtaggtcgaggtcggacgtaggtaggtacgtcggtaggaacgttagttacttaccacgttacctccgtaactacttaccgtagttaacctcgttacgaactaaggtagttaaacgttacgttttacgaacctttaacttttacgttaactaccgttaaccaaaacgttaagtaaacttttacgtaaacggtttccgggtttaacgaaccggtaaagggtaaccctaagtaaaccttaaacggttaaacgttaaaccggtatcggtaacggcctacggaaccctaccgttattacccggttnttaccctttacctaacccgttccttacccccgatttactcgttaacgtaac

SEQ ID NO: 140122 - DNA, 709 bp, Homo sapiens
  misc_feature: GYAE6OF01B4NS6.46.67.G01.1.454.CMB.1.raw
  modified_base (222)..(222): a, c, t, g, unknown or other
  misc_feature (222)..(222): n is a, c, g, or t
  modified_base (382)..(382): a, c, t, g, unknown or other
  misc_feature (382)..(382): n is a, c, g, or t
  modified_base (392)..(392): a, c, t, g, unknown or other
  misc_feature (392)..(392): n is a, c, g, or t
  modified_base (606)..(606): a, c, t, g, unknown or other
  misc_feature (606)..(606): n is a, c, g, or t
tcagactagcagtacacgaccggtgctcgatttagagtatacatattgggtttgtcctcctgctggtggcagctcccagatgggtcctgtccctggtgcaactgcgagggagtccgggcccaacgcgtgggtggacgggtccctttcgggaacgaccccttggtcccctcacctgccgtctcggtctcgtggtcgccctaccatcagtagttgtttctcggnggggtctcggggtccgcacgccgtcccggaaggggagggcttaggaatacgtagtagggaagttcgtctactacgtagttaggtcggtacgttccttaagtacctagttcccgtatctacgaagtcgtcacgtccaacatactctcgagactaccgtcanactaacgttnttccgttacaggaatgtgtacttcgaggtaccgcccgtcgtcgttacggaccggttacgggttttaatttcgttacgcgggtagaccgggagaacggtacgtattagtttgtgtttagtttggtacgttagttactacggacctacgtacgacgtcgggaccgggtctacccggccgtacgggacgtaacgggtactacggtcgtaccgtaccncggttacctaccgaccgtacccgaaaccggtcgaccccgtacgttcccggttccccccttacgcccgtaccctcccgtaccctaacgaacgtcccgtacccgg

SEQ ID NO: 140123 - DNA, 829 bp, Homo sapiens
  misc_feature: GYAE6OF01CPV1C.46.67.G01.1.454.CMB.1.raw
  modified_base (200)..(200): a, c, t, g, unknown or other
  misc_feature (200)..(200): n is a, c, g, or t
  modified_base (209)..(209): a, c, t, g, unknown or other
  misc_feature (209)..(209): n is a, c, g, or t
  modified_base (306)..(306): a, c, t, g, unknown or other
  misc_feature (306)..(306): n is a, c, g, or t
tcagactagcagtacacgaccggtgctcgatttagagtatacatattgggtttgggggacctcctgtgcaagaacatgaagcacctgtggtttgtcctcctgctggtggcagcctcccagatgggtcctgtccctggtgcaatgctaggacgtccgggcccagacgtggtagaggtccttcggacgtacccttgtccccnctttaccgngcgtcttcgtccttcgtgggtcctaccctacctagttacgtaggtttacggtttcggtttttacttccgggtgggggtccgttcgggggtcccgacnccggtccccggtaccgggaagggggtaacgggtaccgtacggtaactaaccgtaggtttaggaacggtttcgttccttaccgtgtaacgttggttcgggttaccgttttccttaacgttaccgtaccgttcccgttacgttaccgtacgtaaggttacgtacccgtacgtaccccgtaaccgtaattcgttaccgtccgtaccggaccgtaacccgtcgtaacgtactaactttaccgttacgttttacccgaagtaacgtcgtacggttacgtttccggtcgttaccgacccgtccgtacgacggtaccgtttacggttactttacgtacgtcgtacggacgaacggtacgtacgttacttagtttagtttggtttaggtttacggtggtttgttaaccgttccgtaaccgtcgttaacggtcggtccgggtaccggtcccgtcccgggtccggtacgggtacgtacggtacgttacgtccgtacccgttacttccccgtacgttccgccccgttaacccgg

SEQ ID NO: 140124 - DNA, 854 bp, Homo sapiens
  misc_feature: GYAE6OF01BWPOG.46.67.G01.1.454.CMB.1.raw
  modified_base (141)..(141): a, c, t, g, unknown or other
  misc_feature (141)..(141): n is a, c, g, or t
  modified_base (478)..(478): a, c, t, g, unknown or other
  misc_feature (478)..(478): n is a, c, g, or t
tcagactagcagtacacgaccggtgctcgatttagagtatacatattgggtttggggagtctcggtcaggacacagcatggacatggacgggtccccgctcagcctccgtggggctcctgctactctggctccggaggtcnccagatgtagacatcgagctcgacccagtcctccactccctcctgtctcgaccgaaccggtgggacactagttcgaccaaccgtattaccgaccgttcgggaccgggaataaaccggtaccggaacttacgttacgaaccttaaccgtttaaagtttttaaagtcggtaactaaccgaaacgtaacgtaaccgaaccgggacgggaccccgtacctaacgtaccttactattcttagtctacgtctactacttccgttaggttaccgaccgggtaaggttcccgggtaccttaggtaccggtaggttacgacgggttacggacgtacgggttacggngttacggggtacggtaactaggtttaccttacccgtacccgttacccgttaacaaccgttaacgttacggtaacttaacggtcctaacgggtaaccgttaacggttaacgttaaagttttaccgtttaaggttaaacccttttaaacgtttaaccggtttaccgtacggttaaaacccctaaagttaacggttaactttttaacggtacggtttttaacgacccgggtaaacgtaaacgggttaacctaaacggttaaaccttaaacgtaaaagttaacccggtggttaacggactaccgtaacgtaccgaacctttccttcggtacctttcgaaacccttccgttaacccgtcccagttaccttagtcctaaccg

SEQ ID NO: 140125 - DNA, 807 bp, Homo sapiens
  misc_feature: GYAE6OF01B19JO.46.67.G01.1.454.CMB.1.raw
  modified_base (194)..(194): a, c, t, g, unknown or other
  misc_feature (194)..(194): n is a, c, g, or t
  modified_base (225)..(225): a, c, t, g, unknown or other
  misc_feature (225)..(225): n is a, c, g, or t
tcagactagcagtacacgaccggtgctcgatttagagtatacatattggggtttggggagtctcggtcaggacacagcatggacatgagggtccccgctcagctcctggggctcctgctactctggctccgaggtgccagatgtgacatcgagctgacccagtctccatcctccctgtctgcgaaccgtggganacgagtcgtcaccatcacgttcggccggganaacggtcggaaactattcgaacctacctttatttaaattggtatacaacagtacgaccgagggaccggaccctaagcctacctaatctagtgctcgctactcctaggttttcgacgtaaacgggttccggggtcccagttacgggacggtttaccgaggtcgggtacgtagggttacggtaacggttcggttacggggaacctaagtttacgttttacctaaccgttccgttaccaacccgtacgttaccgttaaacggtttaaccttaccgttacggtaacccgtaaacgggttacggttaaagtttacgtttttacggtaacccgtttaaacctttttaagtttaaccgtttacgtaaccgtaaaacttacggttaaaacttttacgtaaacgtttttcggtttaaccggggaacccggtaaaggtaacccgtaaccgtaaaccgttaaaccgtaaaagttaaacccggtaagttccggtaacggtaccgttacggaccctaaacgtaactttccgtaccgttaccctttactaccccgttccctttaaccccggacctttacttccggtcgttaaaccg

SEQ ID NO: 140126 - DNA, 900 bp, Homo sapiens
  misc_feature: GYAE6OF01BUHM0.46.67.G01.1.454.CMB.1.raw
  modified_base (567)..(567): a, c, t, g, unknown or other
  misc_feature (567)..(567): n is a, c, g, or t
tcagactagcagtacacgaccggtgctcgatttagagtatacatattgggtttgtcctcctgctggtggcagctcccagatgggtcctgtccctggtgcaactgcgaggacgtccgggcccacgacgtgggtgagggtccttcgggacgacccctcggtcccctcaccgtggccgtcttcgtctcgtcggtcgtccctccatcgtaaggtttggttcggttttcgttcgggtgggggtccgttcgggggtacccggcgacggtccgtacccgggaagggggtaacggggtctaagggtaaactacgtaggttaggaacggttcgtcctacgtacgtaggttagggtacggttacgtttaccctaagttccgtacggttccgtactacgtaagtaaaggtcggtacgtacgtacctaactagtactcgtacgacggtacccacgacagtactaacttcgtttacgttacaaggtagtactggtactttcgtacggacccgaccggtcgtacggttacggtaaccgggttacggtttacgtttaattaccgggtggaccgtaaacgggnggtaaacggtaccgtttagtttaagttagggtttacggttttagggtttacgggttacgttttaacggtttactacccgtaaactccgggttaaggtcccgggtaccgggggtaccggtacccgtaaccccgggtaccgggtacggggaaaccgttacgggttaccgttaaccgtttccggaaccccgttccggttaacccttaccggacccgttacccccaaaccgggtaacccggccgggtttaaccctcccggttccccgggttaacccccttcccccgggactaccccccgtaaacccttccggaaacccgtggtcccgtaacccccgg

SEQ ID NO: 140127 - DNA, 857 bp, Homo sapiens
  misc_feature: GYAE6OF01EV3BF.46.67.G01.1.454.CMB.1.raw
  modified_base (599)..(599): a, c, t, g, unknown or other
  misc_feature (599)..(599): n is a, c, g, or t
tcagactagcagtacacgaccggtgctcgatttagagtatacatattgggtttgggggagtctcggtcaggacacagcatggacatgagggtccccgctcagctccgtggggctcctgctactcgtggctcggaggtcgccaggactggtagactagtcgacgtctacgaaccctagtcctaccgacttccctcccgtgttctacgaccgtaccgggtgggacgactagtcgtacaactacgtctacgttccggaccggtacgacggtacgaactagtacgaccttaacgttaatttaagtagtacaacgtaactaacgtacggaacgacggggtaccgtacccgtaacgtaccttaaccgtaacttaccgtaagtccgtaccgtaccggtaaccttacgttaacccgttaggtttaacgaacggtaacggggttcccggtacgtacggttacggtacggttacggtaggtggtacggtagggtacggtagttaccggggtacgtacggttaagtttcgttaaccacgttaacctaccctaacgttacgttaacctaaggttacctccgttaacgaacgttaacgttaggttaacgttntttaacgtacttaacgtttaatcgttaaacgtacctaaagtaactttaacgttaacgttacgttacgggttaaccgtaaacggtaaccgtaacgtaaccgttaaacttaaaccgtaaaagggtttaaccgttaacgttagggaaccttcccggtaaaaccgtaccggttaaccttacccggtttagttaacccgtttacttacccgtttacccgtacccgttaaccccttaaggtttaccttaccggtcttaaacccg

SEQ ID NO: 140128 - DNA, 814 bp, Homo sapiens
  misc_feature: GYAE6OF01DT48P.46.67.G01.1.454.CMB.1.raw
  modified_base (186)..(186): a, c, t, g, unknown or other
  misc_feature (186)..(186): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactgggtgacgggtcccttcgggacgacccctcgtcccctccacctgcgtctgtctcgtggtcncctccatcgtagttaggtttcggtttcgttcggtggggtcgttcggggtcccgcgacgtccgtacccgggaagggggtaagggtccgtaggtaaatacgtaggttagggaagttcgtctctacgaagttaggtggtacgttcctaagttaccgtcgttaccctctactagaaacgtggtaccggataccaacctagtactccgtagacggacctaaccgtcgacgtactaacttcgttacccgtttacggaaggtaaacgtggtacggttacgtttacgtacgggtccggaacccccggtcggttacggtaaccgtaaccgggttacggggttttaactttacgtaccggttggtacccggtaagggaggtaaccgggtacgtactttaagtttacggttaggttttaggttttaggtacggtttacgtttacgttacctaccgtacgtaggtaccggtcggaccgggttccgaccggtcccggtagggaccggtaggtacgttaccggtcgtacccgtccgtaccttaccggtacctacccacccgtaacggccggtaccctccggtttacccgttcccctacccggtccctaccccaccctacctaccggacgtccgtaccccggg

SEQ ID NO: 140129 - DNA, 792 bp, Homo sapiens
  misc_feature: GYAE6OF01BZJQA.46.67.G01.1.454.CMB.1.raw
  modified_base (722)..(722): a, c, t, g, unknown or other
  misc_feature (722)..(722): n is a, c, g, or t
tcagactagcagtacacgaccggtgctcgatttagagtatacatattggggtttggggagtctcggtcaggacacagcatggacatgagggtccccgctcagctccgtggggctcctgctactctggctccgaggtgccagatgtgacatcgagctgacccagtctccactccctccctgtctcgaccgaaccggtgggacgacaggtcgtcaccatccacgtcggccgggacaacggtaccggaactattacgaacctaacctttattttaaacgttggtaactacaaactagtaacggaaccggacggggtacccggtacccgtaacgtaccttaccttaaacgtcttaagtcgtccgtacggtcctacgttaccgtacgttttacgacgtaaacgggttccgggtaccctagtaccggtaggttcgtagggtggtcgtaggggtcggtactaccggtaggggaaccttaggtactttacaccgttactaccgaacctacgttactaacggttactacgttacggaacttaaacgggttagtaaggtttaacttttacgaccgtttaactttacgttactacgtaacctaacgtaagttaacttacttaacggtttacggttaacggtaaccggaaaggtaacctaacggtaaactttaaacgtaaacgttaaacccggttaacgtacggtaccgtccgttaacccgacctaaaccgttnttaccgttaccgtttacttacccttacccggtttcccttaacccggtccttaacggtccttaagtaaccc

SEQ ID NO: 140130 - DNA, 696 bp, Homo sapiens
  misc_feature: GYAE6OF01CBBEN.46.67.G01.1.454.CMB.1.raw
tcagactagcagtacacgaccggtgctcgatttagagtatacatattgggtttgggggagtcgtcggtcaggacacagcactggacatgagggtccccgcctcagctcctggggtctcctgctactctggctcgaggtgccagatgtgacatcgagctgacccagtcctccatcctccctgtctgcgaaccggtgggagacgagtgtccaaccatcacgttcgccgggacaaggtaccggaactagttacgaaccaccttaatttaaacttggtaactacaaacactaacgaaccgaacgggtaccgaccctaagcctacctaatctatcgctgcctatccgtagttcgacgtaaaggtcgggtaccctagtccgtaggttaccaggtcggacgtaggtggtagtccgtagggacctaggtatttccgactctaccactactactactactcgacgtacgaacggtagtaacgttagtttacgaacgtttaacttttacttaacttacgttaaccgaacttaacgttaacttaacgtaagtttacgttttacgaccggtaaacggtacctaacgtaacctaaacgttaaacgttaacgtaacgttcggtacgggtacctaggtacctacgtaacgttacgttacgttcctttacgtaccttcccgttacccgtaccttaccgttcgttacgttacg

SEQ ID NO: 140131 - DNA, 1069 bp, Homo sapiens
  misc_feature: GYAE6OF01BYHE9.46.67.G01.1.454.CMB.1.raw
  modified_base (179)..(179): a, c, t, g, unknown or other
  misc_feature (179)..(179): n is a, c, g, or t
  modified_base (187)..(187): a, c, t, g, unknown or other
  misc_feature (187)..(187): n is a, c, g, or t
tcagactagcagtacacgaccggtgctcgatttagagtatacatattgggtttgtcctcctgctggtggcagctcccagatgggtcctgtccctggtgcaactgcagggagtccgggcccacgactgggtgaggccttcgggacgaccctgtccctcacctgcgctcgtctcgtggtcncctacctntctaggttacggttcggttttcgttcggtcgggggtcctcgggggtcccgacgacggtcccgtacccgggaagggggtaacggggccgttaagggtaaacttaccggtaagtttacggggtaacgttcgtccttaccgtacgtaacggttaagggttacgggttaaccgggtttacccttaaacgtttaaaccggaccggttttacccccgttaccgttcccgttaaacggtaaaacgggtaccggtttacccggggtaaccgtttaaccccgtaaaccccttaagtttaaacccgtttcccgtttacccggttaaccggggaacccttaaccccggtaccgaaaccgtacttaaccggtttaaccttacccggtttttaccccgtaaaggaaggttacgtcgttaagtttccggtacgggtacccggacccgtcccggtacggtccggtaaccgggtaacccggggttttacgttttaacttaccggttaggtacggtacgggtaacggtaaccggggtaaccgtttacgtttaagttacggtttacgggttttacgggttttttagggtaacgggttttggttttaacccgggttaacctaaccccgttaaccggttaggaaccgggttacccggggtacccggggtcccggttaacccccgggtaccccggggtgggtaacccgggttaagggggtacccgttcgggttaacccggttccccgttaaccggttcccctttaccggtaacccgttccccgtaaaccggtaacccggtacccggggtccccgtacgtttaccccccgggttcccctttccccgggttacccggtaccccctacccgttacccccctaaggacccggtaccgttaccccggg

SEQ ID NO: 140132 - DNA, 896 bp, Homo sapiens
  misc_feature: GYAE6OF01DLWMT.46.67.G01.1.454.CMB.1.raw
tcagactagcagtacacgaccggtgctcgatttagagtatacatattgggttggggagtctcggtcaggacacagcatggacatggagggtccccgctcagctccgtggggctcctgctactctggctcggaggtgccagatgtgacatcgagcttcgacccagtctaccatcccgtccctggtacctcggtaccgtaaccgggtggggaacgacgtacgggtttcctaccaacctaacgttacctaccgttcgggaccccggggtactaacggggtaccggaacttagttaccggaacctaaccgtttaagttttaaaacgttgtaactacaaaccgttagtaaaccggaaccggtacggggtaccccgtaccctaaaggtccccttaacgtaaatttccgtaacgtacggccttacgaaccggttaacttaccccggttaaggttttaccgggaacggttaaaaccggggttcccggggttaaccccaaggtttccggtaaaccgggtttcgaacgggttggacgtaagggtttacggactacgggttacgggaaattcgttaactttccgaactttccaaacgtaccctaacgttcgttaaggtaaccgttcgtaacggtaaacgtacgttaagtaaagtttacgtttaccgaaactttacgtttaacgttaccgttaacgaaaccttaaaggtaacttaaacggtttaaccgttagttttacccggttaaccggaaccgtaaacggtaccgtaaacgttaacccgttaaaattaaaccggaacgttaacggtacgtacgggtacctacggtacctaaccgttacggttactttacccggttaccttaacgtacccgttaccgttaccccgattaaccgttcgtaacgtaacg

SEQ ID NO: 140133 - DNA, 808 bp, Homo sapiens
  misc_feature: GYAE6OF01EXHR4.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctccactccctcctgtctgccaaccggtgggagacagtgtcaccatcacgttcggaccgggacaacggttcggaactattacgacctaacctttaagttttaaaagttggttaactaccgaaactaagttaacggaacccgaagggggaacccggtaccccttaaagtcccttaaccccgttaaattccttaacgtcggtaccttacgacctaacttcccgttaaggttttccgaacgtaaacgggttcgggggttacccctaagttaccggtacgggtttacgaaggttcggacgtagggtggtaacgttccgtaggggaactacggtactttaccgtaacctcgtacctacccgtattaaccgtaaattaacgttcttaacgaccgtaaacggttagtaacgtttaacgttttcgaacctttaaacgttttactttaaccgttacgtaacctaaacgtaaggtttaactttaaccgtaaggttttcggttaaccggtaaccgaacgggtactaaacccgttaacttaaacgtaaacgtttaaacgacgttcgggtacgtacgtacgtaaccgtaccttagttccgttacgtttaccttacctaaccgttccccgttaccccgaacttacgttacgtacgttaacg

SEQ ID NO: 140134 - DNA, 744 bp, Homo sapiens
  misc_feature: GYAE6OF01BCU69.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctcctgtctgaccgaaccggtgggacgacagtcgtccaccatccacgttcgggacccgggtacaacggtacggaacctattacggaacctaacctttaattttaaacgttggtaacttacaaactaacgtaacggaaccggaacggggacccgtaccccgttaaggtaccttaccttaacgtacttactgtccttacgctacttccgtaggtttacgaccgtaaagggttccgggtacctaggtcgtacggttcgaggtcggacgtaggtggtactcggtagggaactaacgttctttactaccgtcctacaacctatacgtagttactcgtacgaaccgttaaggtagtaagtttacgtttacgaaacctttaacgtttactttaccgtacgttaacgtaaactaagttaacgttaacttaggttttaccggttacggaaaccggttaacgggaaccttaacgtaaacgttaaacttaaacgtaacggtacttgggacgtactaccgtaacctctacgttacttcgtacctttacgtacttcccccttaccgacctttccttagtccgtaacg

SEQ ID NO: 140135 - DNA, 747 bp, Homo sapiens
  misc_feature: GYAE6OF01EVQ1L.46.67.G01.1.454.CMB.1.raw
  modified_base (194)..(194): a, c, t, g, unknown or other
  misc_feature (194)..(194): n is a, c, g, or t
tcagactagcagtacacgaccggtgctcgatttagagtatacatattgggtttgggggacctcctgtgcaagaacatgaagcacctgtggtttgtcctcctgctggtggcagctcccagagtggtcctgtccctggtgcaactgcaggaggtccggccagacgtggtgaggccttcggacgaccctgtcccctnaccgtgacgtctgtcctcgtggtcgcctccatcgagtagttgtttctcgtggggctaggggtccgcgacggtccgtaccggaaggggaacgggacgtaaggtaacgtactaggttaggtaagtcgttactctactagttaggtggtacgttcttaacgtacgtacgttccgtacgtctacgtaagacgtacgacgtacaacctatactctcgtacggactaccgtacacgactaataccgttacgtttccgtaagtaacgtagtcgtacgttgtacggtacgaccggtacgtacgtacggaacgtacgggttacgtttaagttacgttcggtacggtagacggtacgtaacggttacgttacttaagtagtttaacggttttaggtacggtttagtttaccgtttaacgtaaccgtacccggtagtaccgggtaccgggtacccggggtaccgtaccccgggtacccgggtacggggtaaccggaagggtaacgttacggtaccggttaccgtacccgttacccgtcccgttaaccggtccctaaaccccggg

SEQ ID NO: 140136 - DNA, 816 bp, Homo sapiens
  misc_feature: GYAE6OF01C3AY7.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtcctggtgcaactgcaggagtccgggcccacgactggtgacggtccttcggacgaccctgtccctacacctgcgctgtctcgtggtcgcctcatccgtaggttacggttcggtttttccgttcggtcgggggtcgttcgggggtcccgagtaccggcccgtacccggaaggggggaacggggtctacgggtaactaccgtagtttagggtaagttcggttctacctcgaagttaggtagggtacggtttaccttacgtttaaccgtacggtttcccgttccttacgtaacggtaaaggtacggttaccgtaacggtaccaaccgtaagttaccttccttaccggtaacgggtaacctaaccgtccgtaaagtcccgtaactttcgttaacccggtttttcccgaaggtaaaagtcgttagttacgtttcgtacgtaccggtacccggtccgtcgtacggtacgtaccgggttcgttttagtccgtaggtcggaacgtaggtacggtacgtactttaagttacggtagttttaggttttacgggagttttggtttacttacccgaaccttaccgtaggtaccggtccgggggacgggttcccgacccgggtacccggtgggggaacgttaaacggtccgttacttccggtaccgtacccgttctacccggtcctccccgtaacccggg

SEQ ID NO: 140137 - DNA, 789 bp, Homo sapiens
  misc_feature: GYAE6OF01DKZ4X.46.67.G01.1.454.CMB.1.raw
  modified_base (173)..(173): a, c, t, g, unknown or other
  misc_feature (173)..(173): n is a, c, g, or t
  modified_base (194)..(194): a, c, t, g, unknown or other
  misc_feature (194)..(194): n is a, c, g, or t
tcagactagcagtacacgaccggtgctcgatttagagtatacatattggggtttggggagtctcggtcaggacacagcatggacatgagggtccccgctcagctcctggggctcctgctactctggctcggaggtgccagatgtgacatcgagctgacccagtctccatcccncctgcctgcaaccggtggganacgagtcgtaccaacatctacgttcggcccgggaataaggtccggaaatacgttacggaacctaacctttaagtttaaaagtgggtaacttaacgaaactaattaacggaaccgaacggggaccggaccccttaaaggccttaccttaaacgtccgttaagttcggtacttacggtctaacgtaccgttaaggttttacggacgtaaaacggggttccgggtaaccctaagtcgggttaaggttacaacgggttcggacgtaggtagggtacgtcgttaaggggaacttaacggtcttttaaccgacttacccgtaaccaaacgtactaaccggttaaacgtaacgtcccgtaaggaaccgttaaacggtaaggttaaaccgtttacgtttaacggtaacttaacggttaacttaacggttagaaacgtaaactaaggtaaactttaacgtagtttacggttacgaaccgtaacggtactaaacgtaacctaaaacttaaagtaacgtagtcgttaacggcttacggaacctaacgtacttcttacggttacctactaacccgttccctacggtacctacgttacgtggttaaac

SEQ ID NO: 140138 - DNA, 737 bp, Homo sapiens
  misc_feature: GYAE6OF01DY6NK.46.67.G01.1.454.CMB.1.raw
  modified_base (214)..(214): a, c, t, g, unknown or other
  misc_feature (214)..(214): n is a, c, g, or t
  modified_base (257)..(257): a, c, t, g, unknown or other
  misc_feature (257)..(257): n is a, c, g, or t
  modified_base (438)..(438): a, c, t, g, unknown or other
  misc_feature (438)..(438): n is a, c, g, or t
  modified_base (453)..(453): a, c, t, g, unknown or other
  misc_feature (453)..(453): n is a, c, g, or t
  modified_base (530)..(530): a, c, t, g, unknown or other
  misc_feature (530)..(530): n is a, c, g, or t
tcagactagcagtacacgaccggtgctcgatttagagtatacatattgggtttggggagtctcggtcaggacacagcatggacatgacgggtccccgctcagctccgtggggctcctgctactcgtggctcggagtgccagatgtgacatcgagtctcgaccctagtcctccacttccctcccgtagtccgtacgaccgtaaccgggtgggaanaccgtagttccgtaccacctagtcctacgtcggacccgggtanaacgtcggaactagtacgaacctaactttaagtttaaagtgtaactacaaccgtagtaaccggacggaccgggtaacccgtacctacgtaccctaccttaaagtccgtaagtcgaccttcgacctacgttccgttagtttacgaacgttacggtccgggtacctaaggtcggtacgttacnggtcggatacgggtntacgtcggtagggacttaagtctttacacgtcacgaatctaacgtagtaacctcgtagtaacgtacggttaaacgtntttacgttaacgtaacttaaccggtttactacggttaaaccttaaagaaacgttttactaacgttacgtttgggtaaacccggaacaagggtaacctacgtaaacctaaagtaactaacggcttaggccctagaccgtaccttacgtctttacgtacttacttcgaccccgttcttaacccccggattagcttacgtcccgtttacg

SEQ ID NO: 140139 - DNA, 772 bp, Homo sapiens
  misc_feature: GYAE6OF01EN9YB.46.67.G01.1.454.CMB.1.raw
  modified_base (249)..(249): a, c, t, g, unknown or other
  misc_feature (249)..(249): n is a, c, g, or t
tcagactagcagtacacgaccggtgctcgatttagagtatacatattgggtttgtcctcctgctggtggcagctcccagatgggtcctgtccctggtgcaactgcaggagtcgggcccagactggtgaggccttcggagaccctgtccctcacctgcgctgtctctggtgccctccatcagtagtggtttcttcgtgggctgggtccgcagcctccgaggggagggctaggaatacattggagtgtctntcagtagtggtaggttctattacacgtccgtctctagaagtagtcgacgtacacctaatactcttacgtggaacctaccgtccaagtactaattccttacgtttttaccccgtacgaagtagttacggtacgtttccgtaggtccggtacccggtcccgtacgttacgaccggttaccgggtttacgttttaacgttacgttggtcggaaccggaggtaaccggtacggtaccttaagtttacggttagtttaaggtttttaggtaggttttacggtttacgtttaacccggaccttaaccccgttagggtaccggttaccggggacccgggggttccctacccgggtccccgggtacggggacccggtaagggtaacgttaccggtacggttacccgtacccgttaccgttcccgttaccgtcccgtacccgtaacccggaccggtaccctacggttcccgttacccccttcccccggtcccgtacccctaccccttacccaccgtaaccgccgtaccccgg

SEQ ID NO: 140140 - DNA, 954 bp, Homo sapiens
  misc_feature: GYAE6OF01CLSUL.46.67.G01.1.454.CMB.1.raw
tcagactagcagtacacgaccggtgctcgatttagagtatacatattgggtttggggagtctcggtcaggacacagcatggacatgagggtccccgctcagctccgtggggctcctgctactctggctccgaggtgccagatgtgacatcgagctgacccagtcctccacttcctaccctgtcctgaccgaaccggtgggagacctaggtcgtaccaacctagtccgtaaccgttggaccccggggaataaacgggttccgggaaaacctaaggtttcggaaaccctaaccgtttaaagttttaaaacgtttcgggttaaactaccttaaaaccgacgttaaccggaacccgtaaagggggacccggtaacccccgttaaacggtacctttacccttaaaccgttacgttaacgttcgtaccggttacaccgtaacttcccgttaaggttttacggacgtaaaacgggttccgggggttacccctaaacggtcggtaacgggtttccaaagggttacggtccgtaggttacgggtaattcggtaagggggtaaccaaggttaacttacaccttactacctaccgaacttaccgtaaggttaacttccgtaacggtaaccgtaacggttacggtaaacgttaacttttacggtaaccgttaacgtttaacttaacccgttagtaacccgtaaactaaacggttaaacctttaacgtaaaccgttttcgggtttaaccccggtaacggggtaaaccggtaaaccctaaccgggttaaaaccctaaaccgggtttaaaaccgttaaaccggtaaacggtttcgggttaaacgggtacccggttacaaacccgttaaaccgttacccggttaacgtttaggttaaccccgttaccgttttaaaccggttccccctttaaccccgtaaaccgtttacgttaacgtcccgttaaaacccg

SEQ ID NO: 140141 - DNA, 801 bp, Homo sapiens
  misc_feature: GYAE6OF01C1L3V.46.67.G01.1.454.CMB.1.raw
tcagactagcagtacacgaccggtgctcgatttagagtatacatattggggtttggggagtctcggtcaggacacagcatggacatggacgggtccccgctcagctccgtggggctcctgctctcgtggctccggaggtcgacagtagtgtagaacagtacgacgctacggggggacctacgtctcctaccttccctcctcgtcgtacgaccgaacggtggaagacgtacgtacaccacactcgtacgtcggacggaagtacggtacgaactacgtactaacttaacttaattaagttagtaatacaacgaacgtaacggaaccgaacgggaccgtaaccgtaacaccttaactatactacgtcgtctatacgtacttacgtagttacggacggtaacggtccggtacgtagtacggtagtacgcggtaggtagtacggtagacggtacgtaggtaactacgttacttactacctacgtaacctaacgtactacgttaagtacgtacgtaacgtaacgtaacggttaattaacggttttaactttaccgtaaacttaaacgttttacgtaactttaaccgaaattaaaccgttaaggtttaaacttaacggtttaaccggttcgggttaaacccggaaaccgtaaacggtaacccttaaacggtaaaaccttaaacgtaaaacgtacgttaacggttacggacgaccgtaacgaccttaaacgtcccggtttaattacccgtttacccgttaacgttacccgtaccccgttaaacggtccttaaataccggttaacgtaac

SEQ ID NO: 140142 - DNA, 838 bp, Homo sapiens
  misc_feature: GYAE6OF01EL5PJ.46.67.G01.1.454.CMB.1.raw
tcagactagcagtacacgaccggtgctcgatttagagtatacatattgggtttgtcctcctgctggtggcagctcccagatgggtcctgtccctggtgcaactgcgtaggacgtccgggcccacgactgggtgacggtccttcgggacgacccttcgtccctcacctgccgctgtcctcgtggtcgcctcatcaggttgttggtttctcggtgggcttcgggtccgacacgcctaccgggaggggacgggtctaggaactacgtaggttcgggtaagtcgttcctcgtaactagttagggtaggttaacggtttccttaacgtttaccgccggtttacccgtccttcgtacgtaaggttaacggtcggtaaccgttaccaaccgttattacgttaccgtaccggtacggtaaccgaaccgttaccaacgtaactaacgttcgtttaaccgttttcccgaagtaacgttacgtggttaaccgtttcgtacgggttccgacccggtcgtccgtaacggtacggttaccggggtttaactttacgtacggttcgacggacgaggtaacggtaccgtatttaagtttacggttaggtttaggttttaggtagttttacggtttaccttaccgtacccgtacgttaggtccggtaccgggtaccgggtccctaccccgggtaccggtacggggaccggacggttaacgtcccgtacggtcccgtaccgttcccgttcgtacccgtaccgacccgtaaccgggtccggtccgttaccggttccccggttcccccttcccggacccgtacccctacccgttacccgaacggtcgcccggtacccg

SEQ ID NO: 140143 - DNA, 693 bp, Homo sapiens
  misc_feature: GYAE6OF01C28OW.46.67.G01.1.454.CMB.1.raw
  modified_base (514)..(514): a, c, t, g, unknown or other
  misc_feature (514)..(514): n is a, c, g, or t
  modified_base (561)..(561): a, c, t, g, unknown or other
  misc_feature (561)..(561): n is a, c, g, or t
tcagactagcagtacacgaccggtgctcgatttagagtatacatattgggtttgtcctcctgctggtggcagctcccagatgggtcctgtccctggtgcaactgcaggagtccggcccacgactggtgaggccttcggacgaccctcgtccctcacctgcgctgtctctggtgcctccatcagtagtgtttctcgtgggctgggtccgcagcctcccgaggggaacgggctaggaatactagttaggaagtgtctctcagtaggtggtacgttcctattacgtacgtccgtctactacgaagtcggtcgacgtccacctatactccttcgtacggaccgtaccgtaccagtacctaactacttaccggttttacctaggaacgtagttacggtacgtttccgtggtaccggccccggtacgtccgtaacggtacccggtacgggtttacgttttacgttacgtggtacgtacggaggtaaccggtacggtattagttagttgttagttttcggngttacggtttacttacgaccctacgtgacggtcgggcccgggtaccnccgtccggtacggggacctaagggtcttcggacgtcctacccgtcgtaccctcgtccctccaaccgggtaccgccctacgtcccgttaccccgtcccgtacgccctaccccgtaccctaccgacgcgtcccg

SEQ ID NO: 140144 - DNA, 737 bp, Homo sapiens
  misc_feature: GYAE6OF01BF2BO.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccagacgtggtgaggtcccttcggacgaccctcgtccctcaccgtgcgctcgtctcgtggtcgcctccatcgaggttagttcggttttcttcggtggggtccgttcggggccggacgacggtcccgtaccggaaggggacggggtcgtaggtaaactacgtaggttagggtagttcgttctcttacgtaggtggttaggtacggtttaccttaagtttaccgtacggttcctccgtactacgaaggtcgtcgtacgtacctaacacttacgttctaccgtacggaccctacccgtacacgtacctaagttaccgtttaccgttttacccgaagtaacgtagttacggttacgtttcgtcggacccggtacccgtccgttacgtacggtaaccgggttccgtttacggtttaacttgggtcgtacggacgtacggtaacgtcggttattagttacggttgtttaggtttaggtgtttaggtttacctacgacctacgtacgtcggtcgggtaccgtacggtacccgtcgggagggacgtaggtactcggttacgtccctcgtacctcgtccgcccgtacccg

SEQ ID NO: 140145 - DNA, 725 bp, Homo sapiens
  misc_feature: GYAE6OF01AF1ZW.46.67.G01.1.454.CMB.1.raw
  modified_base (175)..(175): a, c, t, g, unknown or other
  misc_feature (175)..(175): n is a, c, g, or t
  modified_base (210)..(211): a, c, t, g, unknown or other
  misc_feature (210)..(211): n is a, c, g, or t
  modified_base (320)..(320): a, c, t, g, unknown or other
  misc_feature (320)..(320): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgacggccttcggagacccctgtcccctcacctgctctgtctctggtcncctcatcagtagtgtttctcgtgggctgggtccgnngcctccgaggggacggctagatacagttaggagttgtctctactagtagtggtacgttccttataacctacgtccgttctctacagagtcgacgtcacctatactctcnggacctacgtccagacctaatcttacgtttacccagaagtactagtattcgtgtccgaccgtcgtctacggacgtaccggttatttaacgttcgtgtacggtagacggtacggtacgtactttagttacgtttaggtttagttttacgggaggttttaggtttaccgtttacgtaaccctacccgtagacgggttacccggggtacgggtcccgttacccgggtcccgggtacggggtaaccgtacgggtacgttacccggttcggaccccgttaccgttccttcccgttacctccccgtaaccgtacccggtacccggtcccgtcggttccccggtttccccccttacccggttccccgtaccccttccccgtaaccccgacgtaacccgcccgttaaccccgg

SEQ ID NO: 140146 - DNA, 637 bp, Homo sapiens
  misc_feature: GYAE6OF01A13IP.46.67.G01.1.454.CMB.1.raw
  modified_base (207)..(207): a, c, t, g, unknown or other
  misc_feature (207)..(207): n is a, c, g, or t
  modified_base (235)..(235): a, c, t, g, unknown or other
  misc_feature (235)..(235): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtctcctatcctcctgtctgacaaccggtgggagacagtgtccacntcacgttggccgggataaggtcggaacnttcgactacttatttaaagtgtactcaacatagaccgagggaccgccctaagacctacctaatctagtgctgaccactccgtagtttacgacgtaacggtcgggtcccagtcggtaggtcgtagtggacgtaggtggtactacggtggtaacgtacggttaactttcctacgtacctaccgacctatacctaaggttacctcgttacgtacgtaacgtagtaaagttcgtttacgacttaactttaacgttactagtaactaagtactaagttcgtactagttcgtttacggacgtaacgggactaacaacgtaaactaaacgttaacgacgttaggtacgcttacgtcctaactcgtacgttctccgttactaccgttccctaccgtactagttccgtacg

SEQ ID NO: 140147 - DNA, 951 bp, Homo sapiens
  misc_feature: GYAE6OF01B7S3P.46.67.G01.1.454.CMB.1.raw
tcagactagcagtacacgaccggtgctcgatttagagtatacatattggggtttgggggagtctcggtcaggacacagcatggacatcgagggtccccgctcagctccgtggggctcctgctactcgtcggcctccggaggtcgccgagatggtcgacactcgacgctacgacccagtcctacctactccctccctggtctcgaccggtaaccggtgggacgacctaggttccgtaccacctacttacgtaccgtttcgggacccggggtaactaaacgggttaccggaaaacttagtttaccgaaccttaaaccttttaaagtttttaaaacgggttacggttaaactaaccgtaaaacgtaacggttaacccggaaccccgggtaaccggggggaacccgtaaccccgttaacggtaccctttaacttaacgttacgtacgtcggtccgtaccggtaaccttaccgttaacggtttcggtttaacgtaaccgggttaaccgggttaccgggtaccgtacgggttacggttacgggttacgtacggtcggtacggtaggtcggtaacggttcgggaacgtaaggttactttaccgtaccttacccgtacgtaaactaacccgtacgttaaccggttaacgttacgtaccgtaacgtaacggttaaggttaacggttaactttaacgttaaccgttaactttaacggtttaaccgttacgtaacgtaaacgtaaacgttaaacgttaaacgtttacggtttaacggtttaccggtaacccgggtaacggttaaccggaacgttaaaccggtaaactaaacggtttaaaccggacgttacggtaacggtacgtacgtaaccgtaccgtacgttaaccttccgggttacttacccgttcggtttaaccccttcccgttaacccgttaccgttaacgtttcggaaccttaccgg

SEQ ID NO: 140148 - DNA, 703 bp, Homo sapiens
  misc_feature: GYAE6OF01A75OP.46.67.G01.1.454.CMB.1.raw
  modified_base (234)..(234): a, c, t, g, unknown or other
  misc_feature (234)..(234): n is a, c, g, or t
  modified_base (260)..(260): a, c, t, g, unknown or other
  misc_feature (260)..(260): n is a, c, g, or t
  modified_base (270)..(270): a, c, t, g, unknown or other
  misc_feature (270)..(270): n is a, c, g, or t
  modified_base (294)..(294): a, c, t, g, unknown or other
  misc_feature (294)..(294): n is a, c, g, or t
  modified_base (296)..(296): a, c, t, g, unknown or other
  misc_feature (296)..(296): n is a, c, g, or t
  modified_base (394)..(394): a, c, t, g, unknown or other
  misc_feature (394)..(394): n is a, c, g, or t
tcagactagcagtacacgaccggtgctcgatttagagtatacatattgggtttggggagtctcggtcaggacacagcatggacatgagggtccccgctcagctcctggggctcctgctactctggctccgagtgccagatgtgacatcgagctgacccagtcctccacttccctccctgttctgcgaaccgtgggacacagtcgtcaccatcgtcttcgcgggacagtcgaacnttcgactacctatttaatgatacaanagtagaccgnggaccgcctagctcctatctatgntnctatctagttcgacgtaacggtcggtccagtcggagttcgacgttgcgtagtcggtagtcgtgggacctagttacttccgacttcctacctaaccgtntaacgtacgttacttacgtcggaaccgtacgtagtaaactttacgttttacgtaaccttaaccttttagttaaccgttagtaccctaaagtaactttaaacgttacgtttaacggtttacggtttcggaacccggtaaacggtaacccgtaaccgttaaagttaaaaaccgttaaaccggttaagtaaaccggtggtttacgggtaaccgttcgaacccgtactttaccggttacccgtttaccttccgtttaccgttaaccctttaccccgtacccccgtagtttcctttaacccgtcggtttaaccg

SEQ ID NO: 140149 - DNA, 822 bp, Homo sapiens
  misc_feature: GYAE6OF01D4Q93.46.67.G01.1.454.CMB.1.raw
  modified_base (155)..(155): a, c, t, g, unknown or other
  misc_feature (155)..(155): n is a, c, g, or t
tcagactagcagtacacgaccggtgctcgatttagagtatacatattgggtttgggggagtctcggtcaggacacagcatggacatggacgggtccccgctcagcctccgtggggctcctgctactctggctccggaggtgccagtatgtcgacntcgagctcgacccagtcctccactccctccctgtctgaccgaaccggtgggacgacaggtcgtaccaaccgtacttccgaacggtttacggaccgggtacgtaaacggtaccgggtaaactacgttcggaaaaccttaaaccgttttaaagtttttaaaacgtcggttaactaaccgtaaaacaacgtaacggaacccggaaacgggggtacccggtaacccttaaagtccgttaaccttaaagtaccgtataccggtcttacggaacctacgttaacgtacgtttaacgaacgggtaaaagggtccggtaaccctaggtacgttaacggtcgaagtcggggtaacgtggtacggtaacgtcggggtaagtacgtaacggttaacctttcgaaccttcaacccgtaaacgtaccttaagaagttacgtcgtaacgacgtaagttaagtaagttttacttacggtaacttaacggtttacttaacgtaacgtaacgtaaacttaaggtaaaccttaacttaaggttacggtttaaccgaacggtaaacggtaactaaacggtaaaccttaaacgtaaaacgtacgtaagtacggtacacgtacgtaactaacgtacgtccttcgtacctttaaccacgttacccctacgaccttatcctacggtttac

SEQ ID NO: 140150 - DNA, 879 bp, Homo sapiens
  misc_feature: GYAE6OF01D69L8.46.67.G01.1.454.CMB.1.raw
  modified_base (231)..(231): a, c, t, g, unknown or other
  misc_feature (231)..(231): n is a, c, g, or t
tcagactagcagtacacgaccggtgctcgatttagagtatacatattgggtttgggggacctcctgtgcaagaacatgaagcacctgtggttgtcctcctgctggtggcagctcccagagtcgggtcctgtccctggtgcaactgcgaggagtccgggcccacgacgtggtggacgtccgttcgggaacgacccgtcgtcccctcacctggcctctgttcctcgtcggtcncccttccatccgtaagttaggttcgttttccgttcggtcgggggtccgtgggggtcccgcacggtcccgtacccggtaagggggaagggggtccgtaagggtaaacttaccgtaggtttaagggtaaacgttcggttacttaccgtacgtaaggtttagggtacggggtacggtttacccttaaacgtttaccgtaacggttcccgttccttaccgtaagtaaacggtacggttacggaacgttacccaaccgtataaaccgttcgtaccgtaacgggaacccttacccggtaaccgaacgtacccgttaaacttccgtttaacccgggttttaacccagggtaaacgttagttaacggttcgttacgtacggtccggtaccccgccgtacgtacgggtaaccggtaccgggtttacgttttaccgttacgttcggtacgacggaacggtaccgggtacggttactttagttacgttacgggtttaggttttagggtaggtttaggtttaccgttaccgtacctaaccgttcggtacgggtaccgggacccggggtccctaccgggtacccgggtgggggtaaccgaagggtacccttaggtccggtaccgttaccggtccttaacccgtcggtaacccctacccggg

SEQ ID NO: 140151 - DNA, 923 bp, Homo sapiens
  misc_feature: GYAE6OF01DFFAH.46.67.G01.1.454.CMB.1.raw
  modified_base (234)..(234): a, c, t, g, unknown or other
  misc_feature (234)..(234): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgaccagatgtgacatcgagctgacccagtcctccatccctccgtgtctcgccgaaccggtggacactagtcgtccaccgatccacgttcggacccggganaacggtccggaactagttacgaacctaaccgtttaagtttttaaacgttggttaaacttaccgaaaacgacgttaaccggaaccccggaacgggggtaaccccgtaccccgttaaagccccttaaccgtaaacttcgttaacgttggtaaccttggacccttaacgttaccccggttagttttacggaaccggttaaacggggttcccggggttacccctaggttacccgggtaggtttcgaacgggttcgggaccgttaaggttcgggtaacgttcgggtaacggggtaacttacggttaacccttttacgacccttaccgtacctaacgttacgaccgttagttaacgtccgtacggtaacgtaaccggttagtaaaggtttcctttaacggaacctttaacgttttaacgttaaccgttaactaaccgtaaacgttaacggtttaaactttaacggttaacgttttaaccggtttacccggaaacccggttaaaacgggtaacccttaaaccggtaaactttaaaccggtttaaaaaccgttacggtacgtttacgggtacggaacccttcggtaccctaaaccgtttaacttccggtttaaaccgttacccgttttaaccaccccgggtttttaccccctacccgggtaaaccccttaacgggttttccaaacgggttttaaccc

SEQ ID NO: 140152 - DNA, 936 bp, Homo sapiens
  misc_feature: GYAE6OF01CJYE0.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgacgtggtgacggtcccttcggacgacccttgtcccctcaccgtgccgctgtcctcgtggtcgcctccatctaggttaggttcggtttcttcggtggggtcgtcggggtccggctacggtccgtacccgggagggggaacggggtcgtagggtaaacgttaaccgtaaggtttacgggtaaaggttcggttaccttaccgttaccgtaaggtttaggggttacggggttaaccgggttttaccctttaacgtttaaccggtaaccgtttccccgggttacctttaccgttaaccgtaaacgggtaggttacccggtaacggttaccctaaaccccgtaattaaccgtttccgttacccggtaacgggtaacccgtacccgggtaccctaacgggtaccttaaactttccgtttaacccggttttttacccgtaaggtaaccgttaagttacggttacgttaccgttaggtacccggtacccgtcccgtacgttaccggtaacggtaccgggtttacgttttaagttccgtaggtcgtaggaacgtacggtacgtacttagttagttagtttacggttttaggttaggtttagttttacgtttacccgaaccggttaccgttaaggtaccgggttaccggggtaccggggtcccgtaccccggggtacccgggtccggggtaaacccgggtaagggttaaccttacgggttacccggttaccccgttaccggttacccggtttacccgttaaccggtccccgttaaaccccccggg

SEQ ID NO: 140153 - DNA, 657 bp, Homo sapiens
  misc_feature: GYAE6OF01BRBMD.46.67.G01.1.454.CMB.1.raw
  modified_base (172)..(172): a, c, t, g, unknown or other
  misc_feature (172)..(172): n is a, c, g, or t
  modified_base (241)..(241): a, c, t, g, unknown or other
  misc_feature (241)..(241): n is a, c, g, or t
  modified_base (251)..(251): a, c, t, g, unknown or other
  misc_feature (251)..(251): n is a, c, g, or t
  modified_base (283)..(283): a, c, t, g, unknown or other
  misc_feature (283)..(283): n is a, c, g, or t
  modified_base (328)..(328): a, c, t, g, unknown or other
  misc_feature (328)..(328): n is a, c, g, or t
  modified_base (363)..(363): a, c, t, g, unknown or other
  misc_feature (363)..(363): n is a, c, g, or t
  modified_base (374)..(374): a, c, t, g, unknown or other
  misc_feature (374)..(374): n is a, c, g, or t
  modified_base (379)..(379): a, c, t, g, unknown or other
  misc_feature (379)..(379): n is a, c, g, or t
  modified_base (384)..(384): a, c, t, g, unknown or other
  misc_feature (384)..(384): n is a, c, g, or t
tcagactagcagtacacgaccggtgctcgatttagagtatacatattgggtttggggagtctcggtcaggacacagcatggacatggacgggtccccgctcagctccgtggggctcctgctactcgtcggctcggaggtcgccaggtatgtgacagtcgagcgtcgaacccngtcctccactccgtcctgtctcgccgaaccggtgggactacgagtcgtaccacatccgattcggacganaagtcgaatntacgactacttaagttaacgtgtactacgaanacgtaacgacgacggaccgacctagtcctactatactatcgactnactcgtcgtagtcacgtagtcggacagtcgacgtngtacgctagtntacgnggtanagtactacgttcactctaacgactagtactaacgtactacgtacgaacgaagttagtaattacgttacaacttaagttacttacaacgtaatactaagtaaattacgttaacgttacgtacccggaagttaaaccggacgttaaacgtaaacctaaaggtttaaaacgacgttacggtaacggtacggtactaccgtaacccggtacttaacgggtctttaaccggtcctttaacgacccgttaaccgttccaaagttcaacggtctaaaccg

SEQ ID NO: 140154 - DNA, 597 bp, Homo sapiens
  misc_feature: GYAE6OF01AZZON.46.67.G01.1.454.CMB.1.raw
  modified_base (161)..(161): a, c, t, g, unknown or other
  misc_feature (161)..(161): n is a, c, g, or t
  modified_base (173)..(173): a, c, t, g, unknown or other
  misc_feature (173)..(173): n is a, c, g, or t
  modified_base (194)..(194): a, c, t, g, unknown or other
  misc_feature (194)..(194): n is a, c, g, or t
  modified_base (293)..(293): a, c, t, g, unknown or other
  misc_feature (293)..(293): n is a, c, g, or t
  modified_base (563)..(563): a, c, t, g, unknown or other
  misc_feature (563)..(563): n is a, c, g, or t
tcagactagcagtacacgaccggtgctcgatttagagtatacatattgggtttggggagtctcggtcaggacacagcatggacatggagggtccccgctcagctcctggggctcctgctactctggctccgaggtgccagatgtgacatcgagctgacccngtctccagtccncctgtctagcaaccgtggganacagtcgtcaccagtcacttgccgggtacaagtcggaactatcgacacctaattaattggtatcaacatagaccaggacgccctaagctcctaatctangctagcatccagtttgactaaacggtcgggtacccagtacggtaggttcaggtggtactaggtcggatcgtgggacctaggtaactttcacgtctaccaccatacagtaatctagccaacgtgaactagtttcgactaaccgtttaattacctggtccaaactagtaaacgtttacctaattacgtttacggtaccgaaggggtaaccacgtaacctaaacgaaaattaacgaacgttacggagtcgtacgaccgacctagtcttcgttnttcacgttcccttacccgcttactcgttgtaacc

SEQ ID NO: 140155 - DNA, 909 bp, Homo sapiens
  misc_feature: GYAE6OF01BY6J3.46.67.G01.1.454.CMB.1.raw
  modified_base (164)..(164): a, c, t, g, unknown or other
  misc_feature (164)..(164): n is a, c, g, or t
  modified_base (193)..(193): a, c, t, g, unknown or other
  misc_feature (193)..(193): n is a, c, g, or t
  modified_base (196)..(196): a, c, t, g, unknown or other
  misc_feature (196)..(196): n is a, c, g, or t
tcagactagcagtacacgaccggtgctcgatttagagtatacatattgggtttgtcctcctgctggtggcagctcccagatgggtcctgtccctggtgcaactgcagggagtcgggccccacgacgtggtgacggcccttcggacgtaccccgtcgtcccctcnccgtgcgtctgtctcgtggtcgccctccntanagttagttcggttttctcgtggggcgtcggggtccgcacgccgtacccggagggggacgggcgtagaatactaggttaggaagtgtccgttctcgagttaggtggtacgtttaccttagttaccgacgttcccgtcctctacgaaggtacggtcgacgtccaacctaattacgttcctccgtacggaccctaccggtacctacaaccgtaacttccgtttacgttttacccgaggtaaagtacggtacgtacgtttcggtacgtccgtacccgtcccgtcgtacgggtaccggttacgggttacttttaacggttccgttaggtcgggtaacgtacgggtacggtaacgttacgtttactttaggttcggttttagggttttaagggtaggttttacggtttttaaccttacccgggaacccttaaacccgtaggtaaccccgggtccggggttacccggggtaccccgtaccccgggtacccgggggtaccgggtaaccgggtaccggtaacggttaccccgttccgggtaacccctaccccggtttcccgtttaccccggtaccctaaacccccggtacccggtaaacccggggtacccggtacccccgttccggggtttaccccccggttccccctttcccccggggacccccttaccccccggtaccccctttacccgaaacccggtacggtcccccgttaccccgggg

SEQ ID NO: 140156 - DNA, 936 bp, Homo sapiens
  misc_feature: GYAE6OF01BYIYL.46.67.G01.1.454.CMB.1.raw
  modified_base (212)..(212): a, c, t, g, unknown or other
  misc_feature (212)..(212): n is a, c, g, or t
  modified_base (216)..(216): a, c, t, g, unknown or other
  misc_feature (216)..(216): n is a, c, g, or t
  modified_base (221)..(221): a, c, t, g, unknown or other
  misc_feature (221)..(221): n is a, c, g, or t
  modified_base (236)..(236): a, c, t, g, unknown or other
  misc_feature (236)..(236): n is a, c, g, or t
  modified_base (250)..(250): a, c, t, g, unknown or other
  misc_feature (250)..(250): n is a, c, g, or t
tcagactagcagtacacgaccggtgctcgatttagagtatacatagttgggtttggggagtctcggtcaggacacagcatggacatgacgggtccccgctcagctccgtggggctcctgctactcgtggcctccggaggtcgccaggatggtcgacagtcgagtctcgaccatcctaccacttccctcctgtctcgaccgacggtggagacngtcncactntcacgtcggacgganaaggtacgtaactntacgactaactttaagtttaagtagtaacactaacgacgtaacggaccggacgggtacccgaaccctagaccgttaaccttatacctagtcggctacgtacctaacgttcgttacggttacggaactaacggggttcccgggtaaccctagggttaccggtacggtttacgtaggggaccgtacgggtaagtacgggttaactacggggtaggtaacctaaacggtttcctttaaccgggacccgtttaacgttacctaaaccgttaactttaacgaacgtttaacgttcggtaacggtaacgttaacgggttaacggtttaacggttttaaccttaaccgttaacgtttaaccgtttaacctttaacggtaaccgttaaaccttaaagttaaaccggtttaaactttaaccggttttaaacgggttttaccgggttaaccccggtaaaccggggttaaaccggtaaccgtaaaacccggtttaaaaacggtaaaacccggttaaaaaccggttaaacgggttaacccggtttacggtaaaccggttaaaccgttaacccgaaacccgtaacgttttaaccggttaccctttttaacgggttaccccttaaccggtttccccgtttaaacccccggtttacggttaaaccccttcggttaaaccccggttaaggtttaaaccccgg

SEQ ID NO: 140157 - DNA, 724 bp, Homo sapiens
  misc_feature: GYAE6OF01B3W36.46.67.G01.1.454.CMB.1.raw
  modified_base (399)..(399): a, c, t, g, unknown or other
  misc_feature (399)..(399): n is a, c, g, or t
tcagactagcagtacacgaccggtgctcgatttagagtatacatattggggtttgggggagtctcggtcaggacacagcatggacatgagggtccccgctcagctccgtggggctcctgctactctggctccgaggtgcagatgtgacatcgagctgacccagtctccactccctccctgtctcgcgaaccggtgggaacgacagtgtaccaccatactaccgttcggaccgggacaaacggtacggaaacctagttacgaacctaaccttaatttaaagttggtaactacaacgaactaacgaccgaacgggacccgtaccctaagcctacctaatctagtgctagacacttaccgtaggtttacgacgtaacggtcggtaccagtcggtaagttcgngtcggctaggtgtatcgaggactagtacttacgactctacaactagtacaagtactctacgtacgaacgtagtaacgtttacgttacgaacttaaactttacttaaccgtacgtaacgtaaataacgtttaaacttaaccgtaacgggttttacgtaacccgggaaccgtaaaagggttacccaaaccggttaaacttaaaacgtaaaaccgttaaaccgtaggttaaggtcggtacgtaaccgaacctaaccgttaacgttccgttaccgttactttaccccgaactttaccccggttcccaattaccgtacgtacggtaaccc

SEQ ID NO: 140158 - DNA, 738 bp, Homo sapiens
  misc_feature: GYAE6OF01B2FKH.46.67.G01.1.454.CMB.1.raw
  modified_base (178)..(178): a, c, t, g, unknown or other
  misc_feature (178)..(178): n is a, c, g, or t
  modified_base (218)..(218): a, c, t, g, unknown or other
  misc_feature (218)..(218): n is a, c, g, or t
  modified_base (296)..(296): a, c, t, g, unknown or other
  misc_feature (296)..(296): n is a, c, g, or t
  modified_base (308)..(308): a, c, t, g, unknown or other
  misc_feature (308)..(308): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactgggtgacggccttcggacgaccctgtccctcacctgcgctcgtctcgtggtcncctccatcagtagttggtttctcgtgggctcgggtccggnacgccgtccgaggggagggctaggaactacgagttaggaagttcgtctctacgtagtggtggtacggttcctattacncgtccgtctctnaacgtagcgtagtccacctatactctcgtcgactcgtccagacattctacgtttccagacgtatacgtagttcgtgtaccgaccggtccgtcgacggaaccggtcgggttacgttttaacgttccgtggtcgacggtaggacggtacggttcgttaagtttacgttagtttagttttagggtaggttttacggttttacttaccgtaacccgtaccgtacgtaggtaccgggtaccggggtccgtaccgggcccgggtacgggtaccgtagggtaaccgtacggttacggtaccgttaccttcccgttaccgttaccgtcccgtaacccgaacccgggtaccgtaccccgtcccggttaccggttcccccgtttccccgcccggtacccgttacccccgtacccgtaacccgtaccgtaccgtaccccgg

SEQ ID NO: 140159 - DNA, 787 bp, Homo sapiens
  misc_feature: GYAE6OF01BPZAQ.46.67.G01.1.454.CMB.1.raw
  modified_base (264)..(264): a, c, t, g, unknown or other
  misc_feature (264)..(264): n is a, c, g, or t
tcagactagcagtacacgaccggtgctcgatttagagtatacatattgggtttgggggacctcctgtgcaagaacatgaagcacctgtggtttgtcctcctgctggtggcagcctcccagatgggtcctgtccctggtgcaactgcaggagtccgggcccacgactgggtgacggccttcggacgacccttgtcccctcaccgtgcgcttgtcctcgtggtcgcctcatcagttagttcgtttcttcgtggggctggggtccgnacgccgtaccgaggggagggctaggaatactagttacggaagtgtcctctcgacgttaggtacgggacggtttccctaattaccgtacggttcccgttacgtcctaacgaaggacgttccgtacgtaccaacctattactcctcgtacgactaccgtcagacctaactacgttaccttttacccgagtaaacgtagttacggtactttcgtacggtaccggaccccgtaccggtcttagggaacccggttaccggggtttactttttaacgttacgttcgggtacggaacggacgggtaacggtacggtactttagtttacgttagttttaggtttttagggtaggtttttggttttaacttacccggtacgtaacccgttacggttacgggtacccgggtaccggggtccctacccgggtaaccccggggtacggggacccggttaaagggtacgttcccgggttacggtaccccgttacccgttcccgtttaccgttacccggtccccgtaaacccccggg

SEQ ID NO: 140160 - DNA, 929 bp, Homo sapiens
  misc_feature: GYAE6OF01D62MP.46.67.G01.1.454.CMB.1.raw
  modified_base (178)..(178): a, c, t, g, unknown or other
  misc_feature (178)..(178): n is a, c, g, or t
tcagactagcagtacacgaccggtgctcgatttagagtatacatattgggtttgtcctcctgctggtggcagctcccagatgggtcctgtccctggtgcaactgcgaggagtccgggcccagactggtgaggtcccttaggacgtacccctgtccctcacctgcgctgtctgtggtcncctccatcagttagttggtttccttcggtgggtctcgggtcccggatacggccctacccggaagggggaacgggtccttaggaacttacgtagtttaggggaagtttcggtacttcctagtaagttaggttggtacggtttacccttaagttaccgtacgttcccggttactccgtactaaagtacgtacggtagttccgaacctattacttccgtcgtacggtaacctaccgttaccgaacggtacctaaacgttccgttaacggttttttccccgtaacggtaacggttaacgtcgggttaaccggttttcgttaccgggttacggtaacccccgggtccggtaaccgttaacggtaacccgggtacggggtttaccccgtttttaagtttaaccgttcggtacgggttaccgggtaacgggtaacggttaccccgggtaatttaaggtttacggttacggttttaacggttttacgggtaaggttttaggtttttacgtttacccggtaccgtaaccggttaacggtacggtaaccgggaccgggttaccgtacccgggtaccccggtacgggtaccggtaacgggtacgttaacggtccggtcccgtacccgttccgttaccgttcccgtacccgtccgaaacccggtccggtaaccccgttccggttccccgtttcccccttaacccccgggtccgtacccctaacccccgttaacccgttaccccgtagtccccgtaaccccggg

SEQ ID NO: 140161 - DNA, 877 bp, Homo sapiens
  misc_feature: GYAE6OF01BV64L.46.67.G01.1.454.CMB.1.raw
  modified_base (227)..(227): a, c, t, g, unknown or other
  misc_feature (227)..(227): n is a, c, g, or t
  modified_base (269)..(269): a, c, t, g, unknown or other
  misc_feature (269)..(269): n is a, c, g, or t
  modified_base (400)..(400): a, c, t, g, unknown or other
  misc_feature (400)..(400): n is a, c, g, or t
tcagactagcagtacacgaccggtgctcgatttagagtatacatattgggtttgggggacctcctgtgcaagaacatgaagcacctgtggtttgtcctcctgctggtggcagcctcccagatgggtcctgtccctggtgcaactgcaggacgtccgggcccacgactgggtgacggtccttcgggacacccctcgtcccctcaccctggccgtctgtctcgtggtcnccctcatcagttgttcgtttctcggtgggtcgtcgggccgcncgccgtaccggaggggaacgggtctaggaattacaggttggagttcgtactctacgtaaggtgtacgggtacgtttacccgttaatttaaccgcggtttccccgactttaccacgaagtccgtacgtaacncctacgtaactcgttccgtacgtcgaacccaccggttaccgaacgtaccttaacgtacccgtttaaccgtttttcccgaaggaaaccgttgtttaggtacgtttccgcggttaaccggcccgaccgttcgtaaccggtaccgggttacgggtttctttaacgttcgtacgggttcgacgggtaacgggtaaccggtcgtttaacgtttaagtttgtttaagggttttttacgtttttagggttaacgggtttacggttttaccgttaacccggttaaccctacccgggttaaggtacccgggttaacgggggtaccccggggttccccgttaccccccggggtaacccgggggttaccgggggaaaccccggtttaacgggggtaaaccttccgggttaacccgggttttacccccgttacccgggttaacccgtttttaacccccgtacccgggttaaccccccgtaacccccggg

SEQ ID NO: 140162 - DNA, 713 bp, Homo sapiens
  misc_feature: GYAE6OF01EVTHW.46.67.G01.1.454.CMB.1.raw
  modified_base (193)..(193): a, c, t, g, unknown or other
  misc_feature (193)..(193): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtcgtcaccatcacgttcgccgggcaagtcggaactattgactacttaatttaatgtatcaacatagaccgaggacgaccctaagctcctaatctatgctgctactcctagtttacgacgtaagtcgggtcccagtcgtaggttcgacggtggacgtaggtggtatcgtagggactacggtatttacgtactcctaccacctatactaagtaactcgtcgacgtaacgtagtaagttacgtttacgtacttaacgtttaactttacgtacgtaactaacgtaaagttaactttaacttaacggttttaggtttaacccgggaacccgtaaacggggtacctaaaccggtaaaccttaaaacgttaaaacgtttaaaccgttaacggttacggttacgggtaaccgttacggtacccgtaaaccttaacgtttccgttaccgtttacccgtttaccgtaaacccgttttaccccgtttacccccgtaacccgttacttacccgttaacgttaaacccg

SEQ ID NO: 140163 - DNA, 686 bp, Homo sapiens
  misc_feature: GYAE6OF01C1VCG.46.67.G01.1.454.CMB.1.raw
  modified_base (192)..(192): a, c, t, g, unknown or other
  misc_feature (192)..(192): n is a, c, g, or t
  modified_base (400)..(400): a, c, t, g, unknown or other
  misc_feature (400)..(400): n is a, c, g, or t
  modified_base (412)..(412): a, c, t, g, unknown or other
  misc_feature (412)..(412): n is a, c, g, or t
tcagactagcagtacacgaccggtgctcgatttagagtatacatattggggtttggggagtctcggtcaggacacagcatggacatggagggtccccgctcagctcctggggctcctgctactctggctccgaggtgccagatgtgacatcgagctcgaccagtctcactcctcctgtctgcaacggtggancagtgtcaccatctacgttcggaccgggataacggtacggaactagtttacgaacctaacgtttaattttaaagttggtaactacaaacgtagtacggaaccgtaacggggacctacccgtaaagtccttaccttaatcgttaatcggtctacgctaattcccgttagtttcgaacgtaaggtcggtaccagtcgtaggtcagtcggntaggtcggtacncggtaggaatacgtactttaccgcttacgtacaccgtaatcgtaattacgtcgtacgtaacgtagtaagtaagtttactttacgacttaagttaacttacgttaacgaataaacgtaagttaatttacgtaagtttacgttaccggaaacgtaagggtacctaaaccggtaattaaacgtaaaactttaacggaactcgggttacacggtacaaccgttcctatcggtttctaccgttaactccgttacctacgcttaaccgtgtagttaaccg

SEQ ID NO: 140164 - DNA, 837 bp, Homo sapiens
  misc_feature: GYAE6OF01EQW89.46.67.G01.1.454.CMB.1.raw
  modified_base (138)..(138): a, c, t, g, unknown or other
  misc_feature (138)..(138): n is a, c, g, or t
  modified_base (208)..(208): a, c, t, g, unknown or other
  misc_feature (208)..(208): n is a, c, g, or t
tcagactagcagtacacgaccggtgctcgatttagagtatacatattgggtttggggagtctcggtcaggacacagcatggacatggacgggtccccgctcagctccgtggggctcctgctactctggctccgaggtnaccagactgtgacatcgagctcgaccagtcctccactccctccctgtctgacgaaccggtgggacgacgngtcgtaccacctatcacgttcggaccgggacaacggtacggaacattacggaaccttaaccgtttaaatttaaacgttggtaactaccaaactaagtacgaaccggtaacggggaacccgtaccccttaaacgaccgttaccttaaacttcgttacgtacgtactaccggactaaccttacgtaacggttttacggaacggtaaacgggttccggggtacccctaaggttacggttaacgggttcgaacgggttacggaacggttaagggtacggtaaccgttaccgggtaggggtaaccttaacggttaaccttttacgtacctaccttaacccgaacgtactaacgtaaacgttaacgtacccgttaacgacgttaaggttaaggtaaacgtttaacgtttaagtaactttaaactttaaccgttaacgttactaaaccggtaactaaggttaaactttaaccgttaagggtttaccgtaaccggtaacggaaaaccggtacgtaaaccgtaaacttaaaactaaacggttaacgtaaaccgtaggtacggtaccgacgtaaccaacgtattaccgtagttacccttaccaccgttccctaaccctacgttactaccgtgtaacccg

SEQ ID NO: 140165 - DNA, 726 bp, Homo sapiens
  misc_feature: GYAE6OF01D5SIH.46.67.G01.1.454.CMB.1.raw
  modified_base (474)..(474): a, c, t, g, unknown or other
  misc_feature (474)..(474): n is a, c, g, or t
tcagactagcagtacacgaccggtgctcgatttagagtatacatatttggggtttggggagtctcggtcaggacacagcatggacatggacgggtccccgctcagcctccgtggggctcctgctactctggctccggaggtcgcagatgtgacagcgagctacgacccagtcctccactccctccctgtctacgaccgaccggtgggaacacgaggttcgaccaacctacgtaccgacgttcgggaccggtacacggttaacggaactagttacgaacctaactttaaagtttaaagttcggtataacaaactagtaacggaacccggtaagggacccggtaccctaacggaccttaccgtaatcttagacgttccgtagacctactaaccgttagggttttaaccgaacggtaaggtccgggttaccagtaccgtagttacggaggttgacgttaggagtacgtgacgggtanaagtcttactacctactacacgtatagtacttaacgtcaagacgtaacgttagaagtttactaacgttacgttaaattacttagtaacctacgtaaaagtccgtaaatttacggtactttacgggtaacgaacgtaacgggacctaaggtaaacctaagtaaaacgttaccgagtacgttcgacaccgtactactgtcccttaactccgtaaacttcccgttaccctacccttaagactttagacccttacg

SEQ ID NO: 140166 - DNA, 741 bp, Homo sapiens
  misc_feature: GYAE6OF01BHYO0.46.67.G01.1.454.CMB.1.raw
  modified_base (235)..(235): a, c, t, g, unknown or other
  misc_feature (235)..(235): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctcgtccctgggtgacaactgcgagggacgtccgggcccacggacgtgggtgacggtcccttacgggacgacccttcgtcccctcaccgtcgcgctcgtctcgtggtcncctcatcgagttgttgtttctcggtggggtcgtcgggtccgcacgccgtaccggaggggaagggcgtaggtaactactaggttaggtagtcgttctactacgtagttaggtagggtacgtttaccttaacgttacgtacggttcctctcgtacgaagtacgtcgacgtcacgtatctcctacgtacgactaccgtacgacgtactatccgttacgtttaccagtaagtagttagtacgttcgtacgtacgacccgtcgtacgtacggaaccggttacggttactttacgtacgtcggtacggacgtaaggtcgtaacggttattagtttacgttaggttttaggtttacgggtaggttttaggtttacgttaccgaaccgttacggtacgtacgggtaccggggtccgggtaccgtacccgggtaccgggtagggaccggtacgggttactaccgggttccgtacccgtacccggttaccgtacccgttccgtcccgtaaccccgg

SEQ ID NO: 140167 - DNA, 694 bp, Homo sapiens
  misc_feature: GYAE6OF01A834Z.46.67.G01.1.454.CMB.1.raw
tcagactagcagtacacgaccggtgctcgatttagagtatacatattggggtttggggagtctcggtcaggacacagcatggacatgagggtccccgctcagctcctggggctcctgctactctggctccgaggtgccagatgtgacatcgagctgacccagtcctccatccctccctgtctgccaaccggtggagacagtgtcaccatccacttcggccgggacaacggtccggaactattacgacctaaccttaattttaaaagttggtatacgaactagtacgaccgagggaccgaccctaagctacctaatctatgctgctatccgtagtttgacgtaacggtcgggtacccagtacggtaggttcgaggtcggacgtaggtggtactcggtagggaactaggtactttaccacgttcctaccacctatacgtaagttaactcctagtaccgtaacggtagtaagttacgtttacgtaacttaactttactttaaccgtacgtaacctaacgtaagtttaaacttaacgttaacgtttacggtttaaccggaaccggtaacgggtactaaccgtaaccttaaacgtaaacgttaaacgtacgttggtacggtactacgtacccgtaactagttacgtcgtttccttaccttaccgttacccgttaccccgacttacttaccgtagttacc

SEQ ID NO: 140168 - DNA, 1032 bp, Homo sapiens
  misc_feature: GYAE6OF01AW8Y4.46.67.G01.1.454.CMB.1.raw
  modified_base (193)..(193): a, c, t, g, unknown or other
  misc_feature (193)..(193): n is a, c, g, or t
tcagactagcagtacacgaccggtgctcgatttagagtatacatattgggtttgtcctcctgctggtggcagctcccagatgggtcctgtccctggtgcaactgcaggagtcggcccacgactggtgagggtccctttcgggacgacccctggtcccctcgaccctgtccgcttcggtccttcttcggggtcncccctcccaattccgtaggttaggtttcggttttccttcggtcgggggccttagggggtcccggctacgccgtaccccggaagggggaaggggtcctaggaactactagtttagggaacgttcgtccttactacgtaagttacgggttgggtaaccggtttaccttaagttttaccgaacggttcccgttcgtactaccgaagttacggtccgtaacggtaccaaccgtacgttaacttcccgtacgttacggaccctaccggttacccgaacgttaccgttaaacgttcccgtttaaccggtttttccccgtaaggtaaaccggttacgttaacggttaacggtttcgtagggtaccgaaccccggtcccgtacgttaccggaacggttcgggtacggttttaacttacggttaggtcggtaaccggtaaggtacgtaccgggttattaacgtttaggttaccggtttaaggtttttgggtaacgggttttacgtttaccgtttaaccggtacccgttaaacccgttacggtaccggttttacccggggggaacggggttaccccgttacccggggaccccccggggttaacggggtccccggtaaacggggttaaccgtttacgggttaccccggggttaccccgtaaccggtacccccggttttaccccggtaccggtaaccccccgttacccgggtaaccccgggtaacccgggttaccccccgttacggttacccccgggttttacccccccggtaccccccggttacccgtaaccccccgggttaccccccttaacccgggacccggtaaccggtaacccgttaaccccccgg

SEQ ID NO: 140169 - DNA, 1128 bp, Homo sapiens
  misc_feature: GYAE6OF01AOTMQ.46.67.G01.1.454.CMB.1.raw
  modified_base (176)..(176): a, c, t, g, unknown or other
  misc_feature (176)..(176): n is a, c, g, or t
  modified_base (197)..(197): a, c, t, g, unknown or other
  misc_feature (197)..(197): n is a, c, g, or t
tcagactagcagtacacgaccggtgctcgatttagagtatacatattgggtttgtcctcctgctggtggcagctcccagatgggtcctgtccctggtgcaactgcaggagtccgggacccacgactggtgaggccttcggacgaccctgtccctcacctgcactgtctcgtggtcncctcatcagtgttgttctcgngggctgggtccgctgccgtccgaaggggaagggctggtaaatcgtagttaggaagtctctactacgtagtaggtcggttaacggttacccttaagttaacgtacgttccccggttcttacgtaccaaaaggtacggtccggtaacgtaccctaacctaaagttacttacccgtcggttacggaacctaccggttccaacggtacctaagttccgttaaccgtttttccgaagtaaacgttcggtaacgttacggttaccgttaggtaccgtacccggtaccccggttaccgtacgggtaacccgggtttaaaccggggttacgtttttaaaccggttacgttacgggggtacgtaaccggggtaacggtaacggggtaacccgttaacgttttaaccggttttaaagttttccgggttttaaaagggtttttttacgggggttaaagggtttttaccggggttttaaaccgtttttaaacccccgggtaaaacccgttaaccccccgggtttaaagggtaaccccgggtttaacccggggggtaacccccggggggtttaccccccggttaaaccccgggtacccccccggggggtttaacccggggggggaacccccgggttaaaaacggggggttaaaccccgtttaaacccggggtttacccgggggttaaacccccgtttccccccgggtttaacccgttaccccccgggtttttaaaccccgccccccggtttaaaaccccccggttaaaacccggggttaacccccccgggtaaacccccggtttaacgggttcccccccccccgggtttttaccccgtttaaaccccccccccggggtccccgggttaaacccccccttcccccccgttaaaccccgggttaaacccccgttaaaacccgggtacccccggtaaaccccccggg

SEQ ID NO: 140170 - DNA, 1055 bp, Homo sapiens
  misc_feature: GYAE6OF01DST38.46.67.G01.1.454.CMB.1.raw
  modified_base (182)..(182): a, c, t, g, unknown or other
  misc_feature (182)..(182): n is a, c, g, or t
tcagactagcagtacacgaccggtgctcgatttagagtatacatattgggtttgtcctcctgctggtggctagctccctagatgggtcctgtccctggtgcaactgcaggagtccgggcccacgactggtgaggtccttcgggagtaccctgttccctcacctgtcgtcttgtctctggtcncctcatcagttagttggtttctcggtggggctcgggtccgcagccgtccggaggggacgggctagggaactacgtagtggaacgttcgtcctcgtactagttaggtggtacggtttacccttagttacgtacggttcccgttacgttcctaacggtaacgtacggttccggtaacgttaccgaaacctacgtttaacgtccgtttaccggtacggggtaaccgtacccgttaccgtaacggtaccgttaacgtttacccggttttaaccggttttttaccccggaaggtaaacggttagttttacgggtaaccggtttttccgtacgggttacccgtaccccggtacggtaccgttacgggacccgggttacggggtttaaccgttttaacgtttaccggttacggttacggacggtaaccgggtaacggtaacccggttaagttttaactttaacggtttaccgttttaaggtttttaacgggtacgggttttaaccggttttacgtttaacccggtaaacccgttaaccccggtttaaaggtaccgggttaccggggtaaccccgggggtccttaacccggggaacccggggtacggggaaccccggttaaacggggttaaccgtttaacccgggtttaccgggttaaccccgtaccccggttttaccgtaccccgttttaacccggggaccccttaacccccggggtaaaacccgggttaccccgggttacccccgttaaccggggtttccccccgtttaaacccccccgggttttcccccccgtttaacgggtaacccccccccgttttaacccccggtttacccgttaaaccccccgggtaaaggttcccccgttaaccccccggggg

SEQ ID NO: 140171 - DNA, 726 bp, Homo sapiens
  misc_feature: GYAE6OF01D3QMT.46.67.G01.1.454.CMB.1.raw
  modified_base (178)..(178): a, c, t, g, unknown or other
  misc_feature (178)..(178): n is a, c, g, or t
  modified_base (218)..(218): a, c, t, g, unknown or other
  misc_feature (218)..(218): n is a, c, g, or t
  modified_base (274)..(274): a, c, t, g, unknown or other
  misc_feature (274)..(274): n is a, c, g, or t
tcagactagcagtacacgaccggtgctcgatttagagtatacatattgggtttgtcctcctgctggtggcagctcccagatgggtcctgtccctggtgacaactgcaggagtccgggcccacgactggtgaaggtcccttcggacgaccctgtccctcacctgcgctgtctctggtcncctacatcagtagttgtttctcgtgggcgtcgggtccganacgcctacccgaggggaacgggctaggaacttacgagttaggaacttgtctactanagtaggtggtacggttccttattacgacgtccgtactactacaaggtacgtacgacgtaccaacagtactctacgtacggaacctaccgtaccagtactaactacgtacgttttacccgagaacgtagtagtacgttctggtaccgaccgaccgtgtaacgaccggtacggttcgtttaacttacgtggtagtacgtaacggtaacggtacgtaacttaagtttaacttaggtttaggttttacggtaagtttcggtttacttaccgtaccgtaaccgtagtaccgtcgggacgggtcctaccggacccggtcgggaccgaagggtactacggtacgtaccgtaccgtaccgtacgttaccgcccttaaccgaccggtaaccgacccgttacgttccccgttacccgtccccgtaccgtcccaaccctaccccgtaacgacgtacgtacccg

SEQ ID NO: 140172 - DNA, 732 bp, Homo sapiens
  misc_feature: GYAE6OF01E0SHQ.46.67.G01.1.454.CMB.1.raw
  modified_base (166)..(166): a, c, t, g, unknown or other
  misc_feature (166)..(166): n is a, c, g, or t
  modified_base (217)..(217): a, c, t, g, unknown or other
  misc_feature (217)..(217): n is a, c, g, or t
  modified_base (445)..(445): a, c, t, g, unknown or other
  misc_feature (445)..(445): n is a, c, g, or t
  modified_base (725)..(725): a, c, t, g, unknown or other
  misc_feature (725)..(725): n is a, c, g, or t
tcagactagcagtacacgaccggtgctcgatttagagtatacatattgggtttggggagtctcggtcaggacacagcatggacatggacgggtcccccgtctacgagctccggtggggccttccgtgctactgtggcctaccggaggtcgaccagtatgagactancgacgtctacgaccctagtcctaccgactccctcctgtctcgacgtacggngactcgagttcctaccacatcgtacgcggacggtactaacggtcgaatacgtacgaacttaacgtttaatttagttcgaacaacgtaagaacgtaacggaccggaacggtaccgacctaagtcttaaccgtagttcagtcgagtacactaacgtcggttaagtcgaagtaacgggtccacgtaagtcgacgttagcggtagtagcgtacgacgtgtacggagtaactnttaccacgacttaccataagtacgttaactacgtacgtgtaacgtaagtatacgtttaacttactacgtttaacttaccgtagttaacctaacgtaacttaacgtaacgttacgttaacgtttacggtaaccggttaaggaacccgttagtaaaccgttaaaacctaacgggttaaaactaacgtacggttaacgttcgaaagtccgtaacttaaccgtagtttaccgtccgtttacgttacctccgtttaaccccgtcttaaccgttcgttaaccggtnttaaccg

SEQ ID NO: 140173 - DNA, 754 bp, Homo sapiens
  misc_feature: GYAE6OF01BLPEY.46.67.G01.1.454.CMB.1.raw
  modified_base (242)..(242): a, c, t, g, unknown or other
  misc_feature (242)..(242): n is a, c, g, or t
  modified_base (307)..(307): a, c, t, g, unknown or other
  misc_feature (307)..(307): n is a, c, g, or t
tcagactagcagtacacgaccggtgctcgatttagagtatacatattgggtttgggggacctcctgtgcaagaacatgaagcacctgtggtttgtcctcctgctggtggcagcctcccagatgggtcctcgtcccgtggtgcaactgcaggagtccgggacccacgacgtgggtgacggtccgttacgggacgtaccccttcgtcccctcgaccgtggccgtcttcgtccttcgtcgggtcnccctactactcgtaggttacggtttcggtttccgttacggtcgggggtccgttcggggtcccggngtaccggtcccgtacccgggaagggggaacgggtccgtaaggaacgtaacggtaggttaggtaacgtcgtacctctacgtagtaggtacggttacggttccttaagtacgtaccggtccgtcgtactacggtagtacggtacgacgtaccaacgtataccgtcgtacgtacggactaccgtcgacgtactacgttccgttaccgtttaccgaagtaagtgtacggttagttcgtcggacgtacccggcgtacgtacggtaccgggtacgtttacgttacgttacggtagtacggacggtaggtaacgtcgttattagttagttaggtttaacgtttggtacgtttacgttacgtacgaccgttacgagtcgggtcggtaccggtcccgtcggccgggtaggaacgtaggtactcggtacgtcctacgtccttctacgcccgtaaccg

SEQ ID NO: 140174 - DNA, 955 bp, Homo sapiens
  misc_feature: GYAE6OF01ACY7E.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctcgacccagtcctccactccctccctgtctcgaccgaaccggtgggagaccaggtcgtaccaccactccgtaaccgttcgggacccgggactaaacgggtaccgggaaacctagtttacgaaccgtaacccgtttaaagttttaaaacgttagggttaactaacccgaaacgtaaacgttaaccggaacccggaaaccgggggtaaccccggtaacccccttaaacggtaccccttaacccgttaaaacgttccgttaaacgtccggtaccgttacggaaccctaacgttaccccggtttaagggttttaccgggaaaaccggttaaaaccgggggttccccgggggttaccccctaaagggtttcccgggttaaacgggtttacccggtaagggttccgggtaacgttaaggtaccgggtacgtaccgggtaacggggtactaagggtttactttacccgtaccgtaccctaaccgtaaccgtaacttacgttaaacggtaccttaccggtacgtaaccggtaaacggttacgtaaagtttacttttacggtaaacctttaaaccgtttaacttaccgttaacgtaaccgtaaacgttaacggtttaaactttaacgggttaaccggttttcggttttaacccgggaaccggtaaacggtaaccctaacggttaaacctaaacggttaaaaccgttaacgtaacggttcgtaacggtacctaccggaactaccttagttaccttcgttacccgttacaacccgtttcccgtaccctacgttaccttcggtaaccgtaaccg

SEQ ID NO: 140175 - DNA, 1132 bp, Homo sapiens
  misc_feature: GYAE6OF01A4A1C.46.67.G01.1.454.CMB.1.raw
  modified_base (180)..(180): a, c, t, g, unknown or other
  misc_feature (180)..(180): n is a, c, g, or t
tcagactagcagtacacgaccggtgctcgatttagagtatacatattgggtttgtcctcctgctggtggcagctcccagatgggtcctgtccctggtgcaactgcaggacgtcgggcccacgacgtgggtgaggtccttcgggactaccccgtgtccctcacctgcgctgtctctggtcncctccatcagtagtcgtttctcgtgggtctgggtccgcacgccgtaccgaagggggaacgggtctaggaatacagttcgggaagttcgtcgtctacgagttacggtggtacggtttaccttaagtttaccgaccggttacccgttaccttccgtacgtaaacgtacggttacggtaacggtacccaacccgttaacttaaccttcccgttaaccggttccgggtaaaccccgtaaacccggttacccccgtaacgggacccctttaaaacgtttaccccccggttttaaccgggtttttttaccccccaaaggggtttaaaaacccggttagtttaacgggtttaacccgttttacccgggttgggttaaaccccgggtaacccccccgtcccgggtaccgttaaccgggtaacccccggggtttaaacccgggggggttttacgttttttttaaaacggttacccggtttagggtccggggtaaacccgtaagggggtaacgggtaaccccgtacgtttttaagtttacgttacgggtttttaaccggtttttaggggttacggttttaacggtttaacgtttacccggtaaccccgttaacccggttaaggtacccgggttaccccggggggtaacggtacccccgggttacccccgggttaacccccgggggaccgggtttaccgggtaaaccgggttaccggtttaaccccggttagggttaaccccccgtacccggggttttaccccgttacccgggtttaacccccgtttaaaccccgtaacccccgggggtaaacccccgttaaacccgggggttacccccgtaccgggttttaccccccggtttttaccccccccgggttacccccctaaccggggttacccccccctacccccggttaccccgttaacccccggggtaaccgttacccggtaaaccccccggg

SEQ ID NO: 140176 - DNA, 869 bp, Homo sapiens
  misc_feature: GYAE6OF01BXO9S.46.67.G01.1.454.CMB.1.raw
  modified_base (97)..(97): a, c, t, g, unknown or other
  misc_feature (97)..(97): n is a, c, g, or t
  modified_base (259)..(259): a, c, t, g, unknown or other
  misc_feature (259)..(259): n is a, c, g, or t
tcagactagcagtacacgaccggtgctcgatttagagtatacatattgggtttggggagtctcggtcaggacacagcatggacatgagggtccccgntcagctcctggggctcctgctctctggctccgaggtgccagactgtgacagtcgagcgtcgacccagttctcctactccctccctgtctgaccgaaccggtgggaagacacgttcgtccaccatccgaccgttcggacccgggactaaggtccggaaacgtnttacggacctaacctttaagtttaaacgtacggttaactacgtaaaccgtaaacgtaacgggaacccgtaaccgggggtaccccgtaaccccgtaacggaccttaccgtaacttacgtaagtcgtaccggtagtcctaacgtccgttaggttacgtaacgtaaacggggtccgggtacctacgtacggtacggttacgaggttaccggtacgacggttaggtacgttcgggaggtaacgtacgttaaccgtttcctagttacccctaacgacccttaagtaaccgtaagttaacctaccggtttaccggaaccgttaaacgggtagttaaacggtttaactttaacggtaaccctttaacgtttaacgtttaaccgttaccggtaaacctaaacgttaaacggtaaacttttaacgttaaccgttttcgggtttaaaccggaccggtaaacggtaaccgtaaacccgtaaagtaaaaccgttaaacttaaacccggtacggtaccggtaaggtacctaccggtacctaaaccggtcctttaaccggttcggttcctaacgttacccgtttacccgtacccggttaccttagtaacccgtttgtaaacccg

SEQ ID NO: 140177 - DNA, 779 bp, Homo sapiens
  misc_feature: GYAE6OF01BIZYH.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagcctcccagatgggtcctgtccctggtgcaactgcaggagtccgggacccacggtacgtgggtacgacggtccgttcgggacgaccctgtcccctactaccgtgcggtcttcgtctcgtggtctacctccagtcgtaggttacgttggtttctcggtcgggtccgtacggggtccgacgtacgacccgtaccggaagggggaacgggtcgtaggtaaactagtaggttaagggaacgttcggttacctcgtactaaggtacggttagggtaaccggtttaccttaacgttacgtaaccggttccgttctcgtaacgtaacgtacgtacgtacgtactactatacgtctacgtacgactacgtacagtactaatacgttaccgtttaccaggtaacgtagtagttacgttcgtacgtaccggccgtaccgtcgtacgaaccgggttacggttaactttaacggtctggtcgacgtaggaacgtacggttactaacgtttcggtagtttaggtttagggtaaggttttacggttactttaacggacccttacgtacgggtaacggtaccgggtacggggtaccctccgggtaccggtacggggaacggttacgggaacttaccggtacggtaccgtaccgttcgtaacccgttccctccggtaaaccccg

SEQ ID NO: 140178 - DNA, 707 bp, Homo sapiens
  misc_feature: GYAE6OF01BTO5Z.46.67.G01.1.454.CMB.1.raw
  modified_base (146)..(146): a, c, t, g, unknown or other
  misc_feature (146)..(146): n is a, c, g, or t
  modified_base (367)..(367): a, c, t, g, unknown or other
  misc_feature (367)..(367): n is a, c, g, or t
  modified_base (460)..(460): a, c, t, g, unknown or other
  misc_feature (460)..(460): n is a, c, g, or t
tcagactagcagtacacgaccggtgctcgatttagagtatacatattgggtttggggagtctcggtcaggacacagcatggacatgagggtccccgctcagcctccgtggggctcctgctactctggctccggaggtgccagatgngacatcggagctcgacccagtcctcctactccctccgtgtctcgaccgtaaccggtgggacgacgtagttcgtaccaaccctatccgtacgttcggaccgggtacaacggtcggaaacctattacgacttaaccttaagtttaagttggtaactacaaactagtaaccggaccggtacgggacccgtacctaagtcctaccttaagtctaactcgaccgtnactactaccgttagttacgacgtaaggtccggtaccctaatcgggtagtcgagtcggacgaggttacgactcggtaaggacttagttacttcncttacacgactatactacgtactctagaacctagggttaatattacgttagtaacctaatttcgttaaactgttaaaccaagttaataacgggtttaactaaggtttacgttcccggaaacgtacgaactaacgtaaacttaaacggtaaactacgtacggtatcgactaccgaacctacttacgacgtttcgtaccttaaccgtaccgttacccggtacccctattaatttcccgtaagttaaccg

SEQ ID NO: 140179 - DNA, 787 bp, Homo sapiens
  misc_feature: GYAE6OF01A7FD1.46.67.G01.1.454.CMB.1.raw
  modified_base (357)..(357): a, c, t, g, unknown or other
  misc_feature (357)..(357): n is a, c, g, or t
  modified_base (723)..(723): a, c, t, g, unknown or other
  misc_feature (723)..(723): n is a, c, g, or t
tcagactagcagtacacgaccggtgctcgatttagagtatacatattgggtttggggagtctcggtcaggacacagcatggacatgagggtccccgctcagctccgtggggctcctgctactctggctcgaggtgccagatgtgacatcgagctcgacccagtcctcctactccctccctgtcctgaccgacggtgggagacgtagtcgtaccaacctatacctacgttcgggacccgggacgaacggtaccggtaactacttacgtacctaacgtttaattttaaagttcgtaactacaaacagtaacgacggacggggacccgaccctaagtcctacctagttactacgtcgtcncgtactaccttaccgttaggtttacggacgttaacgggtccgggtacctaggtaccggtggttacgacggttggacgtagggtagtacggttggacgggtaacttacggttacttcctaaccgttctacccctattaaacttacggttaacttacgtacgttacgaacgtaacggttacgttaaagtttacgttaacgttaacctaaacgttttaactcgttaacgttacctaaagtaactttaacttaaggttaaccgtttcggttaacccggtaaagggtaaccggtaacctaaccgttaaacgttaaaacccgttaaacttaaacgtaacggtcggtaacggtacctcgaacctaaccggttnttaccggttacgtttacccgttacttacccgttcccgttacccgacttcccttagttacgttac

SEQ ID NO: 140180 - DNA, 789 bp, Homo sapiens
  misc_feature: GYAE6OF01BGYYC.46.67.G01.1.454.CMB.1.raw
  modified_base (284)..(284): a, c, t, g, unknown or other
  misc_feature (284)..(284): n is a, c, g, or t
tcagactagcagtacacgaccggtgctcgatttagagtatacatattgggtttgggggacctcctgtgcaagaacatgaagcacctgtggtttgtcctcctgctggtggcagcctcccagagtgggtcctgtcccgtggtgcaactgcgaggaggtccgggcccagacgtgggtgacggtcccgttggaacgtaccctcgtcccctcaccgtcgcgtctcgtctcgtggtcgtcctcatcgtacgttaggttcggtttcgttggtcggggtcgtcgggccggcncgtaccggtaccggagggggacgggtcgtaggtaactacgtaggttaggtaagttcgttctctgtagtggtacggtacgttacttagttacgtcggtccgttcgtcgtacgtaggtacgtacgtacgtaccaacgtactactccgtcgtacggacgtaccgtacgacgtactaacgttccgtttacggtttacctaaggtaacgttaacgttacgttacggttacgtacggtaccgggaccgtaccgtacggtaccggtaaccggtacgggtttactttaacggttcgtacggtacggacgtaaggacgggtacgttacttaacgttagttcggtttaggtttaggtaggtttacgtttaccgttaacctaacccgttcgtaacgggtaccggtaccgggtaccgggtacccggtcccgggtaccgggtcggggaacggtaacgggtacgtacggttaccgtacccggttaacccgttccgttaccgtaccgtccccgaaccggg

SEQ ID NO: 140181 - DNA, 649 bp, Homo sapiens
  misc_feature: GYAE6OF01EPBN4.46.67.G01.1.454.CMB.1.raw
  modified_base (191)..(191): a, c, t, g, unknown or other
  misc_feature (191)..(191): n is a, c, g, or t
  modified_base (227)..(227): a, c, t, g, unknown or other
  misc_feature (227)..(227): n is a, c, g, or t
  modified_base (396)..(396): a, c, t, g, unknown or other
  misc_feature (396)..(396): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgganacagtgtcaccatcacttggccggcaagtcggaacnttgacaccttatttaaattggtatcaacatagaccagggacgcctaagctacctatctatgctgactactcctagtttcgacgtaacggtcggggtcccagttcgtaggttcaggtggacgagtggatcgtagggacaggtattcactctacacatcgataactcgtanacgaacgtagtaacgttattttacgacttaactttacttaacgtacgtaactaaagtaagttaactttaaactaagtttacggttttaccggaaccgtaaacgggtacgtaaacgtaaccgttaaacgtaaaacgttaaaccgtaaccgttagggtacgtaccgtacgtaccgtaccttaagttaccgtacgtttacccgttacgttaactttaccccggttaccccgtaaccttactttaccgtaggtaacc

SEQ ID NO: 140182 - DNA, 752 bp, Homo sapiens
  misc_feature: GYAE6OF01AJ0UH.46.67.G01.1.454.CMB.1.raw
  modified_base (203)..(203): a, c, t, g, unknown or other
  misc_feature (203)..(203): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtcctccactccctccctgtctgaccaaccggtgggacgacngtgtccaccatccacgttcggcccgggacaacggtacggaactattacgacctaccttaattttaaagttggtatacaactatacggaccgaggggacccgccctaagcctacctaatctatcgctcgcactcctagtttagacgtaaacggttcggggtacccctagttcggtacgggttcgaggttcgggacgtaggttacgggtacgttccggtacggggaactacgttacgttttacccaccttctacccaccgtagttaccgtaagttactcgttacggaacccgttaacgggtacgtaaacgtttacgttttacgaaccgtttaaacttttaccgtttaacgttccgtaaaccgtaaaacgtaagttaaacttttaaccgtaaaggtttttccgggttttaaccccgggaaccgtaaacgggtacctaaccgtaaacttaaaccgtaaaacgttaaccgtaacgtggtacggtacctacgacctacgtacttacgttcttaccttactacccgttccctacccgtacctacgtcgtagtaccg

SEQ ID NO: 140183 - DNA, 759 bp, Homo sapiens
  misc_feature: GYAE6OF01DT178.46.67.G01.1.454.CMB.1.raw
  modified_base (698)..(698): a, c, t, g, unknown or other
  misc_feature (698)..(698): n is a, c, g, or t
  modified_base (703)..(703): a, c, t, g, unknown or other
  misc_feature (703)..(703): n is a, c, g, or t
  modified_base (718)..(718): a, c, t, g, unknown or other
  misc_feature (718)..(718): n is a, c, g, or t
  modified_base (748)..(748): a, c, t, g, unknown or other
  misc_feature (748)..(748): n is a, c, g, or t
tcagactagcagtacacgaccggtgctcgatttagagtatacatattgggtttgggggagtctcggtcaggacacagcatggacatgagggtccccgctcagctccgtggggctcctgctactctggctccggaggtgccagatgtgacatcgagcctcgacccagtcctccactccctcctgtcctagaccgaaccgggtgggacgtacgtaggtcgtaccacctactacctacgttcgggacccggggtactaacggtaccggaaactacgttacgaaccttaaaccgtttaagttttaaacggttcggtaactaaccaaacgtaacgtaacggaacccggtaacggggaccccgtaccctaagtccctaacctaacgtcgtaagtcgtacgtcgtacctacgttaccgtaggttacgacggtaacgggtccgggtaacctacgttacgggtacggtcgtaacgggttcggacgtagggtacggtacgtacggtacggtaaactacggttacctttaccgacccttccgtaaccgtacctaagtactaagttactccgtacgaaccgttaagtagtactttacgttacgaactttaacgttagttactaacgtaaacaataagtttaaactacgttagttacgggtaaccgaacggaacggtaactaacgtaaacctaaagtaaacctagtaacgnggtanaccgtgacctacgtnttacgtctacttacctacctccgtaacccntaccttgctag

SEQ ID NO: 140184 - DNA, 639 bp, Homo sapiens
  misc_feature: GYAE6OF01DLZNX.46.67.G01.1.454.CMB.1.raw
  modified_base (98)..(98): a, c, t, g, unknown or other
  misc_feature (98)..(98): n is a, c, g, or t
  modified_base (195)..(195): a, c, t, g, unknown or other
  misc_feature (195)..(195): n is a, c, g, or t
  modified_base (372)..(372): a, c, t, g, unknown or other
  misc_feature (372)..(372): n is a, c, g, or t
tcagactagcagtacacgaccggtgctcgatttagagtatacatattgggtttgggggagtctcggtcaggacacagcatggacatgagggtccccgntcagctcctggggctcctgctactctggctccgaggtgccagatgtgacatcgagctgaccctagtctccatccctcctgtctgaccaccggtgganacagtcgtcaccatcctacgttcggccgggacaaggttcgaactagttcaacctaccttaattttaagtggttatacaactagtacgaaccggaagggacccgtaccctaagtcctactaatctatcgactgctatccgtagttacgacgaaggttcggtaccagtcggagttacgnggtgacgtagtcggtagtcgaggtactagtcgttacactcctaccactactacgtaatacgtactcgaacgtacgtagtagtttagttacgaacttaactttacttagtacgtaacaacgttaagttaactaacgttattacggtttaccgaagtaaacggacgtaactaaacgttaaactaaacgttacgaacgttcgtaggcctagactacgtagttctcggtacttaccgtacctttccctacccctattactctgttaacccg

SEQ ID NO: 140185 - DNA, 773 bp, Homo sapiens
  misc_feature: GYAE6OF01DULBY.46.67.G01.1.454.CMB.1.raw
  modified_base (199)..(199): a, c, t, g, unknown or other
  misc_feature (199)..(199): n is a, c, g, or t
  modified_base (203)..(203): a, c, t, g, unknown or other
  misc_feature (203)..(203): n is a, c, g, or t
  modified_base (747)..(747): a, c, t, g, unknown or other
  misc_feature (747)..(747): n is a, c, g, or t
  modified_base (761)..(761): a, c, t, g, unknown or other
  misc_feature (761)..(761): n is a, c, g, or t
  modified_base (770)..(770): a, c, t, g, unknown or other
  misc_feature (770)..(770): n is a, c, g, or t
tcagactagcagtacacgaccggtgctcgatttagagtatacatattgggtttgggggagtctcggtcaggacacagcatggacatgagggtccccgctcagctcctggggctcctgctactctggctccggaggtgccagatgtgacatcgagctcgacccagtctccactccctccctgtctgcgaaccggtggganacgngtcgtaccacctatcgacgttcggcccggacaacggtcggaactattacgacctaaccttaatttaaagttgtaactacaacagtaacgaccggacgggacccgaccctaagcctactaatctatcgctgacctacgttaccgtaggtttacgacgtaacgggtccgggttaccctacggtacggttacggttacgacggtaggtaccgtaggttaggtaacgtcggtacgggaacgttacgttacctttaccgaccttaccctaaccgtacctaagttacctaaggtttaactcgtaaccggaacgtaaacgggttgttaaaacgttttacgttttaacttaaactttacgtttaccgttaggtaacctaaacgttaacgtttaatttaacggtttaacgtttccggggttaaccgtaaaccggtaacggaaacttaaaccgtaacgttaaaaccgtaaaagtttaaccgtacgtaggtaccggtacctacggaacccttaaccgtcgttacttacggttcccttaaccgtccgtttaccccnccgttactacgttntaaccgttntcg

SEQ ID NO: 140186 - DNA, 828 bp, Homo sapiens
  misc_feature: GYAE6OF01ATRIC.46.67.G01.1.454.CMB.1.raw
  modified_base (212)..(212): a, c, t, g, unknown or other
  misc_feature (212)..(212): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcggagctcgaccctagtcctcactccctcctgtctgcgaaccggtgggacacgagtcgtcaccntctacgttcggccgggacgtaagtcggaactacgttcgaactaacctttaatttaaacgttggtactacaacgtagtacggaccgacgggtaccgtacccgtaagtcctaccttaaatcttatcgtacgtgtacctacctacgttaggtttacgaaccggtaaacggggttccgggtaccctaggttaccggtagggtttacgtacgggtggtacgtagggttacgggttacgtcggtaggggttaacctaaggttctttacccaccgttaccgtacctaaccgtaccttacgtaaagtttaccgtacctaaggtaaccgtaagggtttaactaacggttttaacgtttacctaaccttttaaaaccgtttactttaaccggtaacgttaacctaaacgtaaagtttaaacgtttacgttaaacggtttttacgggttacccgggaaaaccgtaaagggtacccttaaacccggttaattaaaacgttaaaaccggttaacgtaggttcccggtacgaccgttaccggttaaccctaaccgtatttccggttaccgtttacctaccgttacccgtttcccgtacctttaccgtaaccttccggttaaagtccccgg

SEQ ID NO: 140187 - DNA, 875 bp, Homo sapiens
  misc_feature: GYAE6OF01AQRAT.46.67.G01.1.454.CMB.1.raw
  modified_base (226)..(226): a, c, t, g, unknown or other
  misc_feature (226)..(226): n is a, c, g, or t
tcagactagcagtacacgaccggtgctcgatttagagtatacatattgggtttgggggacctcctgtgcaagaacatgaagcacctgtggtttgtcctcctgctggtggcagcctcccagatgggtcctgtccctggtgcaactgcgagggagtccgggcccacgactgggtgaggtcccgttcggacgacccctgtcccctcacctggccgctgtctcgtggtcnccctcatcgagttgttggtttcttcgtggggtcgtcgggtccgcacgcctccggagggggacgggtctagggaactacgtagttaggaagttcgtcctctactagtacgggtgggtacggttccttagttacgacggttcccttacgtcgtaccgtaaggtcggttaccgacgttacccaacctattaccgtccgttccgtacggaacctacccggtaccaacggaaccttaaacttcccgttttaaccggttttccccgtaaggtaaacgtacgttttacgggttacgtttccggttacggttaccccgggtaaccccggtccccggtccggttacgggtaacccggttaccggggtttaccgttttttaacgttaccggttgggtaccgggtacggaacgggtaaccggtaccggttaactttaaggttttacgttaggtttttaagggttttaggggttacggttttacgggtttacctttaaccgtaacccgttaaccgttaacggtaccggtaccggggttacccggggtacccggttacccgggtaccccgggtcgggggaaccggtacgggttaaccgttacggttacccgggtcccgttaacccggttccctttaacccggttcccgaccccgtaacccgg

SEQ ID NO: 140188 - DNA, 778 bp, Homo sapiens
  misc_feature: GYAE6OF01EGJ83.46.67.G01.1.454.CMB.1.raw
  modified_base (211)..(211): a, c, t, g, unknown or other
  misc_feature (211)..(211): n is a, c, g, or t
  modified_base (223)..(223): a, c, t, g, unknown or other
  misc_feature (223)..(223): n is a, c, g, or t
  modified_base (247)..(247): a, c, t, g, unknown or other
  misc_feature (247)..(247): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctcatcctccctgtctgcaaccggtggagacagtgtcacatcatcgcggnaagtcgaatatnacactatttaaatgatcaacatanacgaggacgcccgtaagctacctaatctatgctgcatccgtagtttcgacgtaaaggtcgggtacccagtacgtacggtttagaggtacggcgtaacgggtaggtatacggttaggtaacgtaggtttaccgtttaccaacttcttaaccaacgtaacgttacgtaagtttaagtccgttacgacgaaaccggttaaggtaaaagtttagttttacgaacttaaaccttttagttaaacgtcgttaaaccgaaacgttaaaaggtaaactttttaaaccggtaacgtttttaacgggtttttacccggggaacccgttaaaaggggggaaccccttaacccggtaaaaccgtttaaaaccgtaaaaaccgtttaaaaaccgggtaaacgttgggtttaccggaacgttccgtaaacccggttaaacccttaggttttaacccggtttccggtttaaccgttaccccttttaaaccggtacccgttttccccccgaaacccggtttactttaccgtttaaccgggttaaacc

SEQ ID NO: 140189 - DNA, 733 bp, Homo sapiens
  misc_feature: GYAE6OF01DEEXF.46.67.G01.1.454.CMB.1.raw
  modified_base (196)..(196): a, c, t, g, unknown or other
  misc_feature (196)..(196): n is a, c, g, or t
  modified_base (526)..(526): a, c, t, g, unknown or other
  misc_feature (526)..(526): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgacaacgtgcaggagtccgggcccagtacgtggtgacggtccttggacgccctgtcccncactgcgctgtctgtggtcgcctcagtcagttgttcgtttctcggtggggctcggggtccgatgcccgtaccggagggggtacgggtctaggtaactacgtaggttaggagttcgtacttcgtagtaagttacggtagggtacgtttaccttaatacgtaccggttccgtacttacgaagtaaacggtgtaccgtagtaccactacttcgtcctcggtacggacctaccgtcagacctattcccgttacgtttccagtaagtacgttagtagttcgcggtcgacccgtccgtacgtaggtaaccgtacgggtttactttagtcggtacgngtacgaacgggtacgtcggttactggtttagttgtttaacggttttggaacgggttttcgtttaccgttaaccgacgttacccggtaagttaccgggtaccgggaccggggttcctacccgggtacccgggtccggtaaacggtggtaacccgttcggtaacggtcccgttacccgttcgtaacccgttccggacccctaccccggg

SEQ ID NO: 140190 - DNA, 682 bp, Homo sapiens
  misc_feature: GYAE6OF01ARTMK.46.67.G01.1.454.CMB.1.raw
  modified_base (207)..(207): a, c, t, g, unknown or other
  misc_feature (207)..(207): n is a, c, g, or t
  modified_base (407)..(407): a, c, t, g, unknown or other
  misc_feature (407)..(407): n is a, c, g, or t
tcagactagcagtacacgaccggtgctcgatttagagtatacatattgggtttggggagtctcggtcaggacacagcatggacatgagggtccccgctcagctcctggggctctgctactctggctccgaggtgccagtactgtcgacatcggacgctacgaccctagtcctccactcccgtccctgtctcgaccgaaccggtgganaccgtagtcggtaccacctataccgtaccgttcgggcccgggtaacaacggaccggaatacgtttcgaacctaccgtttaatttaagtggtactacaacgtatacggaccgacgggaccggaccctaagcctacctactctatcgctcgactactacgtcggtacaagtacggttacggtaccgtagtcgtacggtacgnggtaccggtcgacggtaggtacgtcggtaccggagtaccgttatttacccggtacctcctaactactacgtactagttactccgtagtaccgtacgtaaggtactacgtttacgtaacttactacttacgtatacgactaagactttactcgttacgttcgaaccgtaagtacccgtataacgtaacgttaatacgtaacgtgccgtaatccgaactacccgtattccggttacttactacccttacgttcccctaccgtatctagttcctaacg

SEQ ID NO: 140191 - DNA, 787 bp, Homo sapiens
  misc_feature: GYAE6OF01EFFEB.46.67.G01.1.454.CMB.1.raw
  modified_base (181)..(181): a, c, t, g, unknown or other
  misc_feature (181)..(181): n is a, c, g, or t
  modified_base (386)..(386): a, c, t, g, unknown or other
  misc_feature (386)..(386): n is a, c, g, or t
  modified_base (424)..(424): a, c, t, g, unknown or other
  misc_feature (424)..(424): n is a, c, g, or t
tcagactagcagtacacgaccggtgctcgatttagagtatacatattgggtttgtcctcctgctggtggcagctcccagatgggtcctgtccctggtgcaactgcgaggacgtccgggcccacgactgggtgaggccttcggacgacccctgtccctcaccgtgcgtctgtctcgtggtcncctacatcagtagttggtttctcgtgggtctggggtaccgctacgcctaccggaagggggtagggcctaaggaactacgtagttacggaagttcgtccttactacgtagtaggtggtacggtttccttaattacacgttccgttctactagaacgagttcgacgtaccaagtacttattcgtcgtacggaacctccgtaccgaanccgtaaacttccgttaaccttttaccgaagaaacggtntacgttacggttcgtacggttccggacccggccgtacggtacggtacggttacggggttctttaacgtacgttcggtacggcgtaagtaacggaccgtattaagttacgttagtttaggtttaggaacgtttgttaaccctcgtaacctacggttagcggtacgggtacggtcctaccgggtaaccggccgggtaacgacgggtaaccttcgtacgggtaaccttcccgttacgttcccgaacctcccgaacccggtaacccgggaaccgttaccccggttacgttccccgggttaccccccttaccggtacccggtacccttaaccccgttccggtaaacccgtaaccggtcctaaccccgg

SEQ ID NO: 140192 - DNA, 808 bp, Homo sapiens
  misc_feature: GYAE6OF01ED643.46.67.G01.1.454.CMB.1.raw
  modified_base (141)..(141): a, c, t, g, unknown or other
  misc_feature (141)..(141): n is a, c, g, or t
  modified_base (151)..(151): a, c, t, g, unknown or other
  misc_feature (151)..(151): n is a, c, g, or t
  modified_base (481)..(481): a, c, t, g, unknown or other
  misc_feature (481)..(481): n is a, c, g, or t
  modified_base (533)..(533): a, c, t, g, unknown or other
  misc_feature (533)..(533): n is a, c, g, or t
  modified_base (795)..(795): a, c, t, g, unknown or other
  misc_feature (795)..(795): n is a, c, g, or t
tcagactagcagtacacgaccggtgctcgatttagagtatacatattgggtttggggagtctcggtcaggacacagcatggacatggacgggtccccgctcagctccgtggggctcctgctactctggactccggaggtcnccagtattgngacactcgatcgtcgaccctacgtcctaccacttccctcccttgtccgtcgaccgtacggtgggactacgtgtcgtaccactactacctacgttacggccggtacgaaggtaccggaactacgtacgtactaacctttaagtttaacgttggaacctacggtaaatacggtaaccgaccggaccgggggtaaccctaccctaagtccccgtttaacttactaccgtttaggcctaaccgttacggtaccttaccgtaacggtttacggtacgaacggtttaaccggttcgggacctaggtttaccgggtaacgttgacgggtccgtaagnggttacggtacttcgggacaaagtttcttagttcaccgttacgctaacggtntaacctgtaaccgttcgacggtacgtaacgtacgtttaacgttagttaaccgttaagtaccgtttacttaacgtactaacgtaaacgttattaaccttaacgttacgtttacccggtaacggtaaccgtacggtaaccgtaacgtaaaccgttaaccgtaaagttacccggttaacggtcgtaactaccgtacgtaccgttaacggacccttttaggtccctttacgtaccttaacccgttccccgacctagttttaaccgngttacccgttacg

SEQ ID NO: 140193 - DNA, 703 bp, Homo sapiens
  misc_feature: GYAE6OF01EAJ76.46.67.G01.1.454.CMB.1.raw
  modified_base (212)..(212): a, c, t, g, unknown or other
  misc_feature (212)..(212): n is a, c, g, or t
  modified_base (672)..(672): a, c, t, g, unknown or other
  misc_feature (672)..(672): n is a, c, g, or t
tcagactagcagtacacgaccggtgctcgatttagagtatacatattgggtttggggagtctcggtcaggacacagcatggacatgacgggtccccgctcagctccgtggggctcctgctactcgtggctccggaggtgccagatgtgactagtcgagtcgtacgacctagttcctacctactcccttcctgtcgtcgaccgtacggtgganacgagtcgtaccacctactcgtaccgttcggccggtacaacggtaccgaacttagttaccgaaccttaacctttaaagttttaacgtagtacctaccgtaaacgtagtaccggaccggtaacgggacccgtacctaagccttaacttatactagtcgtcgtactcctacgtacgtaggttacgacggtacggtcgtacaggttcggacgtttagacggtacgagtacggtagtacggttacggacggttacgtacgttaccgttacctaccgttaccacgtactaaccgtagttaaccgttctacgtacgaacgttagtacgttagttacttacgtacttaacgttactacgtaactacgtaacggtacttagttaacgttacgttacggtacgtaccgaacgtactactaaacgtaataacggtacgtagtcgtacgtcgacgtactagttatccggtntacgtctacgtcccctgtactgtcgtcgtcg

SEQ ID NO: 140194 - DNA, 642 bp, Homo sapiens
  misc_feature: GYAE6OF01ERIGA.46.67.G01.1.454.CMB.1.raw
  modified_base (156)..(156): a, c, t, g, unknown or other
  misc_feature (156)..(156): n is a, c, g, or t
  modified_base (239)..(239): a, c, t, g, unknown or other
  misc_feature (239)..(239): n is a, c, g, or t
  modified_base (271)..(271): a, c, t, g, unknown or other
  misc_feature (271)..(271): n is a, c, g, or t
  modified_base (309)..(309): a, c, t, g, unknown or other
  misc_feature (309)..(309): n is a, c, g, or t
  modified_base (315)..(315): a, c, t, g, unknown or other
  misc_feature (315)..(315): n is a, c, g, or t
  modified_base (434)..(434): a, c, t, g, unknown or other
  misc_feature (434)..(434): n is a, c, g, or t
  modified_base (623)..(623): a, c, t, g, unknown or other
  misc_feature (623)..(623): n is a, c, g, or t
tcagactagcagtacacgaccggtgctcgatttagagtatacatattggggtttggggagtctcggtcaggacacagcatggacatggaggggtccccgctcagctccgtggggctcctgctactctggctccgaggtgccagatgtgacatcganctgacccagtctcatccctcctgtctgacaaccggtgggacgacagtgtacaccatctacgttggccgggacaaggtcgaacnttcgactaacttaagtttaagttgtatacaanatacgaccgacgggaccgacctaacgctactaatctancgacgngactactcgtagtttcgaacgtaacgttcggggtacctagttacggtagttcgtagtcggacgtaggtaggacgtcgtagggactagtcttacgctacgacactatacgtagtaacgtntacgacgtaacggttactaattcgttagtaacttatttaacgtctatacctaaagttataaactttatacgtttaggttaccgaacggtaacggaaccgtaacgtaaacgttaaacgaaacctttaaacggacggttgtacgtactaacgccttaacgactttcggtcttaacttcgtaaccttacccncctacctgttcgtataacg

SEQ ID NO: 140195 - DNA, 735 bp, Homo sapiens
  misc_feature: GYAE6OF01CWX6C.46.67.G01.1.454.CMB.1.raw
  modified_base (156)..(156): a, c, t, g, unknown or other
  misc_feature (156)..(156): n is a, c, g, or t
  modified_base (583)..(583): a, c, t, g, unknown or other
  misc_feature (583)..(583): n is a, c, g, or t
  modified_base (679)..(679): a, c, t, g, unknown or other
  misc_feature (679)..(679): n is a, c, g, or t
tcagactagcagtacacgaccggtgctcgatttagagtatacatattgggtttggggagtctcggtcaggacacagcatggacatgacgggtccccgctcagctccgtggggctcctgctactctggcctccggaggtgccagatgtgacatcganctcgacctagtctccatccctcctgtctcgacgaacggtgggaacactagtcgtacacctatctacgttcgggaccggactaaggtaccgaactagttacgaactaacttaattttaacgtaggtaactacaaactagtaacgaaccggaacggggtacccgaccctaagtcctaaccttaatcgtttaacgcgtacctacgtactaccggtacttacggtttagaccggtaaaggttccgggtactaagtcggtaggttaccaggtcggacgtaggtcggtaagtacggttagggaactaacgttctttaccggacttaccgtaactacgtaatactaagttacgtactacggaactaacggtagtaagtttactttaacaccgtttaattagttacctagtaaacaagttaaactactttaagtntttacgggttaacgaacgaacgtaccaaaccggtaacaaaacgtttaaactacgtaaccgtaggtaccgacgaccgtaactacgttactacggttnttaccccgttaatacccgttcccgttaaacctaccgtaaacttcgttaacggtaac

SEQ ID NO: 140196 - DNA, 689 bp, Homo sapiens
  misc_feature: GYAE6OF01CPQMA.46.67.G01.1.454.CMB.1.raw
  modified_base (198)..(198): a, c, t, g, unknown or other
  misc_feature (198)..(198): n is a, c, g, or t
  modified_base (345)..(345): a, c, t, g, unknown or other
  misc_feature (345)..(345): n is a, c, g, or t
  modified_base (451)..(451): a, c, t, g, unknown or other
  misc_feature (451)..(451): n is a, c, g, or t
tcagactagcagtacacgaccggtgctcgatttagagtatacatattgggtttggggagtctcggtcaggacacagcatggacatgagggtccccgctcagctccgtggggctcctgctactctggctcggaggtgccagatgtgacatcgagctcgaccagtctccatcctcctgtctggacaaccggtggacgacngtcgcacctatccgtacgttcggaccccgggataacggtaccggaactagtttacgaaccttaactttaagttttaaagttggtaactacaaaccagtaacgaccgaggggtacccgtaaccctagcctactaatctagtcgctacnctacgtacctaggttacgacgtaaacgggtccgggtacctaggtcggtaagttccgaagggtgacgtggtacggacgtcggtaagggacctaaggttactttaccnctttaccacaacgtatacggtaactaacgtcgtacgacgtaacgtacgtaagtttatttacgaacttacttaataccgtaatacgaaagtacttaaacttaataacgggttaccgttaacgaaccggttaacggacgtaaactacgtaaactaaacgtaccgaagttcggtatccctagaaccgacttagcttctaccttacgactttccgaaccctcgtaacttcgtacggttaacc

SEQ ID NO: 140197 - DNA, 770 bp, Homo sapiens
  misc_feature: GYAE6OF01DZ1Y9.46.67.G01.1.454.CMB.1.raw
  modified_base (192)..(192): a, c, t, g, unknown or other
  misc_feature (192)..(192): n is a, c, g, or t
  modified_base (195)..(195): a, c, t, g, unknown or other
  misc_feature (195)..(195): n is a, c, g, or t
  modified_base (215)..(215): a, c, t, g, unknown or other
  misc_feature (215)..(215): n is a, c, g, or t
  modified_base (223)..(223): a, c, t, g, unknown or other
  misc_feature (223)..(223): n is a, c, g, or t
  modified_base (245)..(245): a, c, t, g, unknown or other
  misc_feature (245)..(245): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctcctgtctgcaaccggtgganacngtgtcacatcactgccgganagtcgaantgacactattaatgtatcaacntacgccgaggaccgacctaagctactaatctagtcgctgactactaccgtagtttacgaccggtaaagggttccggggtaccctagttaccggtaaggtttaccgagggtacgggacgtaacgggttagggtactacgggtaacggggtaactaaacggttacctttaccgacctttaccgtaccgtaaccctaataccgtaacgttaacttccgtacggaaccgtaaggtacggtaaacgtttagtttaacgaacctttaaacgttttactttacgtacgttaaacctaaacgttaacggttaaactttaaccgttaaggttttacgggtttaacccggaaccgtaaagggtaacccgtaaccgttaaaccgttaaaaccgttaaaacgttaaacccggtacgttacgggtaaggtacccgttaacgtacccgtaaaccttcggtttaacccgttgggtttaaccctttacctaacccgttcccgtttaacccccacgtttaaaccttcggtaacgttaaaccg

SEQ ID NO: 140198 - DNA, 741 bp, Homo sapiens
  misc_feature: GYAE6OF01CLFX4.46.67.G01.1.454.CMB.1.raw
  modified_base (94)..(94): a, c, t, g, unknown or other
  misc_feature (94)..(94): n is a, c, g, or t
  modified_base (222)..(222): a, c, t, g, unknown or other
  misc_feature (222)..(222): n is a, c, g, or t
  modified_base (227)..(227): a, c, t, g, unknown or other
  misc_feature (227)..(227): n is a, c, g, or t
  modified_base (231)..(231): a, c, t, g, unknown or other
  misc_feature (231)..(231): n is a, c, g, or t
  modified_base (252)..(252): a, c, t, g, unknown or other
  misc_feature (252)..(252): n is a, c, g, or t
  modified_base (288)..(288): a, c, t, g, unknown or other
  misc_feature (288)..(288): n is a, c, g, or t
  modified_base (310)..(310): a, c, t, g, unknown or other
  misc_feature (310)..(310): n is a, c, g, or t
tcagactagcagtacacgaccggtgctcgatttagagtatacatattgggtttgggggacctcctgtgcaagaacatgaagcacctgtggtttntcctcctgctggtggcagctccagatgggtcctgtcctggtgcaacgtgcagggtacgtcgggcccacggactgggtcgaggcccttacggacgtacccctgtcccctcgacctgcgtcttgtctcgnggtcncctnatcaagtgttgtttccttcgngggtctagggtccgcagtcctaccggagggacgggntaggatacgagttggaatcgtntcgtatagtgtaggtacgttactataacgtcgttccgtctactacgtaagtacgtcgtagtacctaaccgtatactccgtacgtacggaaccgtaccggtacaacgtactaacttcgttaccgttttacccgagtaaagtactaggttacgttacgtacggacgtaacccggtccggtaactacggaacggtacggggtttaactttaattaccggtaggttgaacccggtagtaacgggtactaacgttaatttacgggttaagtttaggtttccgggtaagtttacggttacgttaacgaacccgttaccgagggtaaccgcgggtacccgggccgacccggtacccggggtacgggaaccgaaacgggttacgtaacccggttacgtaccgtaacgttacccgtacgtaccggtccctaaaccccggg

SEQ ID NO: 140199 - DNA, 790 bp, Homo sapiens
  misc_feature: GYAE6OF01CI7BD.46.67.G01.1.454.CMB.1.raw
  modified_base (97)..(97): a, c, t, g, unknown or other
  misc_feature (97)..(97): n is a, c, g, or t
tcagactagcagtacacgaccggtgctcgatttagagtatacatattgggtttggggagtctcggtcaggacacagcatggacatgagggtccccgntcagctccgtggggctcctgcctactctggctcggaggtgccagatgtgacatcgagcctcgaccctagtcctccactccctcctgtcctcgaccgtaaccggtgggacacgtagtcgtaccaaccgtactccgtaccgttcggcccgggaactaacgggtaccgtaatacttacgaaccttaacctttaagttttaaacgttaggtactaaccaaacgtaagtaaccggaccggaaccggggtaccccgtaccccttaacgtccttaacccgttactactaagtcgtcgtactcctacgttccgtacggtttacgaacggttaacgggttcccgtaccgtagttccggtagttacgtaggtacggtacgtagggttcgtacgttcggtacgggtaacgttacgttaactttacccgacgttaccctaacgacctaacgttacgtaacgttacctacgtacgaacgtaacgtagttaacgttacgtttactaaccgtttaaatttacgtaacgttacgtaaaccctaaagttaaccttaagtttaacgttaaccgtttacggttaccggaaacgttacggaaaccttacgtaaactaaaccgtaaagtacgtaccgtaggtaccacggtacaccgtacgtcgttacttctaccttacctaccgttaccccgtaccattccgtgttcgtaaccg

SEQ ID NO: 140200 - DNA, 664 bp, Homo sapiens
  misc_feature: GYAE6OF01AN4EK.46.67.G01.1.454.CMB.1.raw
  modified_base (213)..(213): a, c, t, g, unknown or other
  misc_feature (213)..(213): n is a, c, g, or t
  modified_base (276)..(276): a, c, t, g, unknown or other
  misc_feature (276)..(276): n is a, c, g, or t
  modified_base (293)..(293): a, c, t, g, unknown or other
  misc_feature (293)..(293): n is a, c, g, or t
  modified_base (343)..(343): a, c, t, g, unknown or other
  misc_feature (343)..(343): n is a, c, g, or t
  modified_base (349)..(349): a, c, t, g, unknown or other
  misc_feature (349)..(349): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggccttcggagaccctgtccctcacctgcgctgtctctggtcgcctccatcagtagttggtttctcgtggggctgggtccggnagcctccgaggggagggctggaatacagttggaatgtctctcatagtggaggttcctaattanagtcccgtctctcaagngtcgagtcaccatatctctggacaccgtccagcaatctacgttttccccngaagtntagtagttctgtacgtccgccgctacgtacgaccggttcgtttatacgttggtcggacggtagaggacggttctaatttagttagtttaggttttaggtgtttagtttcttaccgtacctacccgtagcggtaccggacggggccgttaccggaccccgggtagggaccgtaacgggtacttacgtcggtaccgtaccgtcctccgttaccgtaccctcccgtaaacccggaccggtacccctacggttcccggttcccccttacccccggtcggtccccttaccccgacccttacccgaacgtaccgtaccccg

SEQ ID NO: 140201 - DNA, 718 bp, Homo sapiens
  misc_feature: GYAE6OF01DB20L.46.67.G01.1.454.CMB.1.raw
  modified_base (205)..(205): a, c, t, g, unknown or other
  misc_feature (205)..(205): n is a, c, g, or t
  modified_base (208)..(208): a, c, t, g, unknown or other
  misc_feature (208)..(208): n is a, c, g, or t
  modified_base (546)..(546): a, c, t, g, unknown or other
  misc_feature (546)..(546): n is a, c, g, or t
  modified_base (670)..(670): a, c, t, g, unknown or other
  misc_feature (670)..(670): n is a, c, g, or t
  modified_base (704)..(704): a, c, t, g, unknown or other
  misc_feature (704)..(704): n is a, c, g, or t
tcagactagcagtacacgaccggtgctcgatttagagtatacatattgggtttggggagtctcggtcaggacacagcatggacatgagggtccccgctcagctccgtggggctcctgctactctggctccggaggtgccagatgtgacatcgagctagacccagtcctaccactccctcctgtactgaccgtaaccggtgggaanacngtcgtccacctatcgtacgttcggccgggactaacggtacggaaactagttacgaacctaactttaagttttaaagttcggtaactacaaacgtacgtaacggaccggaacgggaccggaccctaagccttacctaatcgtagtcgcttacgactacgttaccgtaggtttacgacgtaacgggtccgggtaccctaggtaccggtacggttacgaggtcggtacgtaggtacggtacgttcggtacggggaaactacgttaccgtttacccgactttccaacgtacctattacgtaacgtaagttcctaacggtaacgtaaggttaagtaacgtttntttaacgtaacttaactttagttacgtacgtacaaacgtagttaacttaccgtagtttcgtaacgaacgtacgaacgtactactaaactaaagtaccagtacgtacgacgtacactactagttnttacgtccttacgtaccgttcccttacccgattntaccgttgtaaccg

SEQ ID NO: 140202 - DNA, 654 bp, Homo sapiens
  misc_feature: GYAE6OF01BVD6V.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtcgcctcatcagttagtggtttctcgtggggctggggtccggcagccgtccgaggggaaggggctagggaatacgagttggaagtgtctctcagtagtggagttcctattacagtccgtctctacaagtagtcgagtcaccatactctcgtggacacgtccagacaactctacgtttcccagaagatgattcgtgtacgaccgtccgtcgtacgaaccgtacgggttacgtttattacgtggtcggacggtaagtacggtacggtactttaagttacgttagtttagtttttagggtaggtttaggttttactttaccggacctaacccgttaggtacgtccggggtaccgggggtccctacccgggtaccccggtggggacccgtaggggtaacttaccggtcggtacctacccggttcctacccgttcggtcccctaacccgg

SEQ ID NO: 140203 - DNA, 686 bp, Homo sapiens
  misc_feature: GYAE6OF01DD32J.46.67.G01.1.454.CMB.1.raw
  modified_base (197)..(197): a, c, t, g, unknown or other
  misc_feature (197)..(197): n is a, c, g, or t
  modified_base (229)..(229): a, c, t, g, unknown or other
  misc_feature (229)..(229): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgaccctagtctccatccctccctgtctagcaatcggtggganacagtcgtacacctatcgacgttggaccgganaagtccgaatagttcgaactaccttaagtttaagttaggtactacaaccgtaatacgaaccgtaacgggaccgtacccgtaacgtacctaccttaactacgttagtcgtacgtacgtactacgtaccgttaacggttttacggaccggttaaaacggggttccggggttaacccgtacggttaccgggtaacgggtttaccgaagggttcggaacgtaggtacggtacgtcggtagggactaggtaacttccgtaatcctacgactactcgtaatactctagactagtagtaacgtatttacgacttaacgttacttacgttacgactaacgtaataacgtttaacacgtttacgttcggaacgaacggtacacgtaactaacgtaagtaaactcgtagcgtctagaccttacacttcgttacgtacttacgtccttactacccgacttgtctaacg

SEQ ID NO: 140204 - DNA, 750 bp, Homo sapiens
  misc_feature: GYAE6OF01CL4HE.46.67.G01.1.454.CMB.1.raw
  modified_base (143)..(143): a, c, t, g, unknown or other
  misc_feature (143)..(143): n is a, c, g, or t
  modified_base (230)..(230): a, c, t, g, unknown or other
  misc_feature (230)..(230): n is a, c, g, or t
  modified_base (468)..(468): a, c, t, g, unknown or other
  misc_feature (468)..(468): n is a, c, g, or t
tcagactagcagtacacgaccggtgctcgatttagagtatacatattgggtttggggagtctcggtcaggacacagcatggacatgagggtccccgctcagctctggggctcctgctactctggctccgaggtgccagatgtnacatcgagctcgacccagtctccactcctcctgtctcgaccaaccggtgggacactgtcgtaccactactacacgttggcccggganaacggtcggaactagttacgactaaccttatttaaagttaggtatacaactagacgaccggacgggacccggtaccctaagccttaacctattactactacggccttagcctacgttaccgtagtttacggaacgtaacggttccggggtacctagtacggtacggttcgaggtcggacgtacggtggtaactcggtagggactacgttactttaccgaccttcgtaaccgaaccgtntaacgtaacgtactccgtacgtaaccgtaagtacgttaacgtttacgtttacgaaccgtttaactttacttacgtactaactaacgtaaggtttaaactttaaggttaaccggtttaggtttaccggaacggtaaccggtacctaacgtaacttaaaccgtaaaagttaacccggtagtacggttacgttaccgtacggtaaccctacgttaccgttaacgtttcttaaccgttccttaaaccccttcccgtttacccaccttaacttccgtaacgttaacg

SEQ ID NO: 140205 - DNA, 752 bp, Homo sapiens
  misc_feature: GYAE6OF01BES5Q.46.67.G01.1.454.CMB.1.raw
  modified_base (365)..(365): a, c, t, g, unknown or other
  misc_feature (365)..(365): n is a, c, g, or t
tcagactagcagtacacgaccggtgctcgatttagagtatacatattgggtttgggggacctcctgtgcaagaacatgaagcacctgtggtttgtcctcctgctggtggcagcctcccagatgggtcctcgtccctggtgacaactgcaggagtccgggcccacgacgtggtgacggtccgttcggacgtacccctgtcccctcacctgcgtctgtctcgtggtcgccctcatcgtagtagttggtttcttcggtggggtctggggtccgcacgccgtccggaggggagggtcgtaggaatactagttaggagtcgtctctacgtagtaggtaggtacggttacttaagtacgtacgtccgtctntacgagtagtcgtagtaccacgtattactctacgtacggacacctcagactaacttcttaccgttttcctagaagtatcgtagttcgtcgtacggcccgtccgcgtcgtaccggtacggtttacgtttctttacggtgtcggacgacggaggtaccttagttatttacggttagttttaggttttagggttaagtttttacgggttttactttacccggtaaccgttaccggttacggtaaccgggttaccgggggtaccggggtaccccgttaccccggggtacccggggttacgggggaaccccggttaaggggtaacccttccgggtaccggtcccgttaacccggttcggtttacccccttaccggtcccgttaaaccccggg

SEQ ID NO: 140206 - DNA, 765 bp, Homo sapiens
  misc_feature: GYAE6OF01CA3JO.46.67.G01.1.454.CMB.1.raw
  modified_base (349)..(349): a, c, t, g, unknown or other
  misc_feature (349)..(349): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacagtcgagctcgacccagtcctccacttccctccctgtctcgaccgaaccggtgggacgacgtaggtcgtaccaaccgtatacctacgttcgggacccgggactaaggtaccggaactagttcgaacctaaccttaagtttaaagtggtactaaccaagtagtaacgaccgacgggacccgacctaagccttactaatcgtanacgtcctgcctacgtcctaaggtttacgaacggtaacggttccgggtaccctaggttccggtaacggtttcgaggtcggacgtaggtgacgtcgggtacggtacgtaagttattaccctactacgtcccaaactacgtactaagtaactcgtacgaacgttacgtaaggttaattacgtttacgtaaccgttaactttaacttacgttacgtaacctaaaggtaactttaacgttaaactttaacgggtttaccggtttaacccgaacggttaaacccgggtaaccgtaaacgtaaaccgtttaaaacgtaaaagttaaccggttaacgtaggggtcctaacggttacacccgtacttacggtacttacgtacttaccgttaccttccgttaccccgattacgttgtacgttaacg

SEQ ID NO: 140207 - DNA, 874 bp, Homo sapiens
  misc_feature: GYAE6OF01DCPAV.46.67.G01.1.454.CMB.1.raw
  modified_base (98)..(98): a, c, t, g, unknown or other
  misc_feature (98)..(98): n is a, c, g, or t
tcagactagcagtacacgaccggtgctcgatttagagtatacatattgggtttgtcctcctgctggtggcagctcccagatgggtcctgtccctggtncaactgcaggagtccgggcccacgacgtgggtgacggtccttcgggacgacccctgtccccctacacctgccgtcgtgtccttcgtgggtacgtccctaccatacgtaaggtttaggttcgggtttttccttcgggtcgggggtacgttcgggggttcccgacgtaccggtcccgtacccggaaggggggaacggggtacctagggtaaacttacgtaacggttagggtaacgttcgttcctacgtacgtaagttagggtacggtacggtttaacccttaagttaaccgtccggttacccgttctacgtaacgtaaaggtacggtacgtacgtaccaacctaagtactccgttacgcggaacctaccgtcaagtactagtacttaccgttaccgagaagtagttaggttactttaccgacgtacccggacccgtccggtacgtacggtaaccggttacggggtttaactttaacgttaccggtgggtaacgtacgggaacggtaaccggtaaccggttctttaaggtttacgttaggtttttacggttttaggtaacggtttcgtttaagtaacccgtaacctaccggtagttaccgggtccggggtacccgggtaccgtacccggtacccgggtacgggtaccggtaaagggtaccgtacggttccggtaccgtaccgttcgtacccgttacgaccccgttacaacccggtacgtaccctcggttcccggttccctcccggaccgttacccacctcctaaccgaggtccgtcccg

SEQ ID NO: 140208 - DNA, 720 bp, Homo sapiens
  misc_feature: GYAE6OF01CEMK2.46.67.G01.1.454.CMB.1.raw
  modified_base (98)..(98): a, c, t, g, unknown or other
  misc_feature (98)..(98): n is a, c, g, or t
  modified_base (177)..(177): a, c, t, g, unknown or other
  misc_feature (177)..(177): n is a, c, g, or t
  modified_base (261)..(261): a, c, t, g, unknown or other
  misc_feature (261)..(261): n is a, c, g, or t
tcagactagcagtacacgaccggtgctcgatttagagtatacatattgggtttgtcctcctgctggtggcagctcccagatgggtcctgtccctggtncaactgcagggagtccgggcccacgactggtgaggccttcggagaccctgtcccctacacctgcgtctgtctctggtcncctcatcagtagtggtttctcgtggggctgggtccgcagcctccgagggaaggggctgggaatacagttaggaagtgtactctnaatagtggtaggttcctaattacgacgtccgtctctacgaagacgtcgacgtcaacctatactctcgaggacctacgtcagactaagtccgtacgttttcccagaaagacgttgtacgttctacggtcgtacccgaccggtcgtacggaaccgtaccggggttaccgttttaagttaccgtaggtacgacgggtaagtacggtaacggtacgtaactttaagtaggtttacgtttttagggtaggtttaggtttaagtttacccggtaacctaacccgttaaggtacggtaccgggtacggggtaccctaccggaacccgtacggggtaccgaagggtaactacgtcggtacctaccgttactccgtacgtaccctacccgacgtaaccggtaccctacgtaccggttccccttaccccggtcgaccccgtacccgtacccgtaacaggaccgtacccg

SEQ ID NO: 140209 - DNA, 746 bp, Homo sapiens
  misc_feature: GYAE6OF01EN0YC.46.67.G01.1.454.CMB.1.raw
  modified_base (458)..(458): a, c, t, g, unknown or other
  misc_feature (458)..(458): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgacgtggtgaggtcccttcgggacgacccctgtcccctcaccgtgccgctgtcctcgtggtcgcctaccatcgagttacgttcggttttctcggtggggcttgggtccgcagcctccggaggggaacgggctggtaactactagttaggaagttcgttactctacgagttaggtgggttacggttacccttagttaccgaggttcccgttactcgttaccgaaggtcgtcggtagtccacctatactctcgtcggacctaccgtcaagtctaactccttaccgttttcagtaaagtnttaggtacgtttcgtcgtaccgaccgtccgtcgtacggaccgttaccgggttacgttttacgtagttcggacggtacgaaggtacggtacggtactttaagttacgttggtttagtttttagggagttttacggttttaactttaccgaaccgttaccgtaggtacggttccggggacccggggtcctaacccgggtccccgggtaggggaaccggtacgggtaaccgttacggttacccggtaccgttaacccgttcccgttacccgttccggccccgttaaccccg

SEQ ID NO: 140210 - DNA, 943 bp, Homo sapiens
  misc_feature: GYAE6OF01C2WVS.46.67.G01.1.454.CMB.1.raw
  modified_base (138)..(138): a, c, t, g, unknown or other
  misc_feature (138)..(138): n is a, c, g, or t
  modified_base (184)..(184): a, c, t, g, unknown or other
  misc_feature (184)..(184): n is a, c, g, or t
  modified_base (211)..(211): a, c, t, g, unknown or other
  misc_feature (211)..(211): n is a, c, g, or t
tcagactagcagtacacgaccggtgctcgatttagagtatacatattgggtttggggagtctcggtcaggacacagcatggacatggacgggtccccgctcagcctccgtggggctcctgctactctggctcgaggtncagatgtgacagtcgagctcacccgagtcctccgactccctccgtntcgtcgacgtaccggtgggacgaacgngtacgtaccacctatccgtaccgtcgggacccgggactaaacggtaccgaaacctattaccgtaaccttaaaccgtttaaattttaaacggttacggtactaaccttaaacgaacggttaaccgggacccggaacgggggtaaccccggtaacccgttaaacgtaccgttaacccttaattacccgtagttccgcttacgactacgttaaccgtacggttaagacgttacgggtaccgggtacctaggtacggtaggttacgacgggttcgacggttaggtaacgtcgtagggtaaccgagtaaggttcttaacccgtacgttccaacccggttaaatacctttaagaacggttaaccgtacggtaccggttaaacggtaacggtttaaacgttaacgtttaacgttaaccgttaaccttttaaaacggttacctttaacggtaaccgttaaacgaaacgtttaaggttaaaccttaaaccgggtttagttaacccgggtttaaaccggtaaacggttaaacccgggtaacccgtaaaagttaaacccggtaaaactttaaaaccgggttaacgtaaccgttaacggggtaccgttaaccggtaaccgtaaccccgttaaaccggtacccgttttacggtttaacccctacccggttttaacccgttaacccccgtttacccccgttaccccggttaaccttaacccggttaacgttcccccgggttaaacg

SEQ ID NO: 140211 - DNA, 935 bp, Homo sapiens
  misc_feature: GYAE6OF01DLFWA.46.67.G01.1.454.CMB.1.raw
  modified_base (210)..(210): a, c, t, g, unknown or other
  misc_feature (210)..(210): n is a, c, g, or t
  modified_base (427)..(427): a, c, t, g, unknown or other
  misc_feature (427)..(427): n is a, c, g, or t
tcagactagcagtacacgaccggtgctcgatttagagtatacatagttgggtttggggagtctcggtcaggacacagcatggacatggacggtccccgctcagctccgtgggctcctgctactctgctcgagtgccagtatggtacgactagtacggacgcgtacgtacccgtatcctaccactcccgttcctatctagaccgaacgggnggaagacacgtcgacctactactacgtcgtcggaccggactacggtacgaacttacgttacgtaaccgtaacgttttaatttaaaacgtcgtaaactaccaattacgaaaccggtacgaaccgggtaccgacctacgaccttacgtaacttcgtacttacgacgtacgtacgtacgtagttacgttaaccgaacggtaacgggtccggtttaacccngggttaaccggttaggttacgacggttacggggtacctagggttaagggtacccgtagggtttaaccgggaactacccggtttaaacttttccccgggaacttaacccggggtaaccctttaaaccgggaccttaaagggtttaaaccgttacgggtacccttaagggtaacccgtaaggttaacgttaaacggtttacgtttaaaccgtaacttttaaaaccttacggttaaaacgttacggttaaacctaaacgtttaacccggtaaaatttaaacgtttaaccggttttaaccgggttaaccgttaaaaccgggaaaccgtaaacccgttaacgtaaaacccgtttaaaacccggttaaacggttaaaacccgggttaattaaacccggtccggtaaaaccggtacgttaaaccccgtaacgttaaccgtttacggttacttaacccgtaacgtttacccgtccccggttaacccgtaacttaacccgttagtaacgttaaaccg

SEQ ID NO: 140212 - DNA, 764 bp, Homo sapiens
  misc_feature: GYAE6OF01ARXK3.46.67.G01.1.454.CMB.1.raw
  modified_base (219)..(219): a, c, t, g, unknown or other
  misc_feature (219)..(219): n is a, c, g, or t
  modified_base (306)..(306): a, c, t, g, unknown or other
  misc_feature (306)..(306): n is a, c, g, or t
  modified_base (378)..(378): a, c, t, g, unknown or other
  misc_feature (378)..(378): n is a, c, g, or t
tcagactagcagtacacgaccggtgctcgatttagagtatacatattgggtttgggggacctcctgtgcaagaacatgaagcacctgtggtttgtcctcctgctggtggcagcctccagatgggtcctgtccctggtgcaactgcaggagtcggcccacgactggtgaggtcccttcgggacgaccctcgtccctacacctgcgcttgtctcgtggtcncctccatcaggtagttgtttctcgtgggcgtcggccgcacgccgtaccggagggaggcgtgaatactagttggagtgtctcgtacgngttaggtggtacgttacctagtaccgtacgttccgtactccgtacgaaggtacgtacgtacgtcctaacctnttactcctacgacggaccgtaccgtacgaacgtactaacttccgttacgtttacccgtaggaatacgttgtacgttcgtacgtacgacccgtaccgcttacggaccggtacggttccgtttagttacgttgggtggacggtaacggtacggtacgtacgtttagtttacgttagtttacggttttaggtaggttttacggtttaccgttttaacgaccccgtttaacgtaacggtaccgggtaccggggtacccgggtacccgtttaccccgggtacccggggttacggggtacccggtaaagggtaacccgtttaaccgtaccggttacccgttacccccggtttacccgttacccggttacccgggtacccgtaaacccccggg

SEQ ID NO: 140213 - DNA, 820 bp, Homo sapiens
  misc_feature: GYAE6OF01A1IDN.46.67.G01.1.454.CMB.1.raw
  modified_base (164)..(164): a, c, t, g, unknown or other
  misc_feature (164)..(164): n is a, c, g, or t
tcagactagcagtacacgaccggtgctcgatttagagtatacatattgggtttggggagtctcggtcaggacacagcatggacatgagggtccccgctcagctccgtggggctcctgctactcgtggctcggaggtcgccagatgtgacatcgagctcgacccngtcctcctactcccttccctaggtcctcgaccgaaccgggtgggacgactaggtcgtaccaacctatccgacgttcgggacccgggtacaacgggtaccggaacttagttaccgaaccgttaacctttaagttttaaagtggttaacttacaactagtaacgaccggacgggaccgtaccgtaacgtccgttacctaatccgtacgtcgtctcgactacttcgttaggtttacgacggtaacggttcccgggtacctagtaccgtaggttacgaggtcggacggtaggtcgtacgtcggtacgggactagttccttacgaccttacgtaccgtaactacgtacgttaagtacgttacgtacggaacgttacgggttaattaacggtttactttaccggtaaacctttaacttaacggtttacctaacgttaacgtaaacgtttaacgtaaacgttttaataccggttttaacggggtaccctaaccggggtaaacggaacccttaacgttaaaccgttaaacgttaaaccggttaaacgtccgttagggtaaccgtacgttaacccgaccgtaacctttagttcccgtttaaactcccgttaaccttaacccggtttaccaccccggtttaacccgttcgtacttagggtaacccc

SEQ ID NO: 140214 - DNA, 864 bp, Homo sapiens
  misc_feature: GYAE6OF01DK13J.46.67.G01.1.454.CMB.1.raw
  modified_base (302)..(302): a, c, t, g, unknown or other
  misc_feature (302)..(302): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtcccgtggtgacaacgtgcaggtacgtccgggcccacgtacgtgggtcgacggtcccgttaggacgtacccctggtaccccctcaccttggccgtcttcggtctacgtgggtccacccttcattcgtaggttaggttcggttttcgtcggtggggaccgttcggggtacccgngtacgtccgaccggtaagggggtacgggtctaaggaactagtacgttagggaattcgtcctagtactaggttacggtgggttaccgttacttaaagttccgtacggttcccgttactacgtacgaaaacggttcgacgtaaacgttccaaccttattaacgtcctacggacggaaaccctcggtaaccaggtaacctaacgtttcttaccggttttaccgaaggtaaacgtgttacggttccgttacgttccgggacccgtacccggcccgttaacggtaaccgttaccgggttaaccggtttacgtttttaaaccgtcgggacgttacggaaccgtagggttaaccccgttagggttacctttaaggtttaacttcgggttttaacggttttagggacgtttttaccgttaacgttacccggacttaccccgggtaagtcccggttaccgggggaaccgggttccctacccggggttaacccgggaggtacgttaaacgggtccgttaacggggccttaaaccccgtcctttacccgttaccggactcccccggtaacccg

SEQ ID NO: 140215 - DNA, 919 bp, Homo sapiens
  misc_feature: GYAE6OF01AJGJQ.46.67.G01.1.454.CMB.1.raw
  modified_base (324)..(324): a, c, t, g, unknown or other
  misc_feature (324)..(324): n is a, c, g, or t
  modified_base (405)..(405): a, c, t, g, unknown or other
  misc_feature (405)..(405): n is a, c, g, or t
tcagactagcagtacacgaccggtgctcgatttagagtatacatattgggtttgggggacctcctgtgcaagaacatgaagcacctgtggttgtcctcctgctggtggcagcctcccagagtcgggtcctgtcccgtggtcgaccaacgtgcagggacgtccggcccgacgtacgtggtcggacggtcccgttcggacgacccttcgtcccctacgaccgtcgtccgtacgttcgtccgttcggtggccgtcccctccgtaacgttcgtaacggtttacggttcggttttccgttccgggtcggggtcggttcggggtcccggngtaccggtcccgtacccggggaagggggtaacggggcgtaaggtaacgttacgtacggttagggtaacgttcggtttaccnccgttacgtaaggttagggttacgggttaaccggtttcctaaccgttaccggtacccgtttccggtccttaccggtaacgaacggttacggtcccggtaccgtaccgtaacctaggttaacctcggtaccgtacggtaaccgtacccgtacgacgttaacgtaacgttttacccgtttcgtttacgtaagtaactacggtagtacgttcgttccggtacgaccccggtaccgtcggtaggtaacccgggttacgttacggtttaacgtaggtcggtaccggttacgaaggtccggtaacgtaacgttagtttaacgggttagttttacgggtttaagggtacgggtttttaaccgtcggttaaaccgtacccgtaaccggttaacgggtaccgtacccgggggtcccgggtacccgtacccggtaaccggggtaccgggacggtaaaccggtacgttccggtacccggttacccgtacccgttcccgttacccgttccgtccccgggtaacccg

SEQ ID NO: 140216 - DNA, 761 bp, Homo sapiens
  misc_feature: GYAE6OF01E3ASM.46.67.G01.1.454.CMB.1.raw
  modified_base (173)..(173): a, c, t, g, unknown or other
  misc_feature (173)..(173): n is a, c, g, or t
  modified_base (214)..(214): a, c, t, g, unknown or other
  misc_feature (214)..(214): n is a, c, g, or t
  modified_base (256)..(256): a, c, t, g, unknown or other
  misc_feature (256)..(256): n is a, c, g, or t
  modified_base (287)..(287): a, c, t, g, unknown or other
  misc_feature (287)..(287): n is a, c, g, or t
tcagactagcagtacacgaccggtgctcgatttagagtatacatattgggtttgtcctcctgctggtggcagctcccagatgggtccctgtccctggtgcaactgcaggagtccgggcccacgactggtgaggccttcggagaccctgtccctcacctgcgctgtctctggtncctccatcagtagttggtttctcgtggggcctggggtccgnacgcctacccgagggggaagggctaggaatactataggagtntcctctcagttggtggtaggttcctattacnggtcctctctacgaagcgtcgagtccaccgtatactccgtacgtacggaccaccggtccacgtacctaattaccgttacgttttaccccgagtaaacgtagtacggtacgttactcggttacgacccgtccgtacgtacggaacgttaccgggtttacgttttaattccgtagttacggaccgaacggtaacggaccggttattaagtttagttaggttttatttttacgggtaggtttacggttttacttaccgtaacccttacccgtagtaacgtccgggaccgggggtccctacccggaccggttaccgggggacccgtaagggtaccgttaaccgtcggtaccctaccgttcccttacgttacccgcccttaacccggaccggaaccggtaccccgtacggttaccccggttccctccccccggtacgtacccccgtacccttacccgtacccgtaaacgccgtaccccg

SEQ ID NO: 140217 - DNA, 833 bp, Homo sapiens
  misc_feature: GYAE6OF01DKMGI.46.67.G01.1.454.CMB.1.raw
  modified_base (80)..(80): a, c, t, g, unknown or other
  misc_feature (80)..(80): n is a, c, g, or t
  modified_base (171)..(171): a, c, t, g, unknown or other
  misc_feature (171)..(171): n is a, c, g, or t
  modified_base (580)..(580): a, c, t, g, unknown or other
  misc_feature (580)..(580): n is a, c, g, or t
  modified_base (696)..(696): a, c, t, g, unknown or other
  misc_feature (696)..(696): n is a, c, g, or t
  modified_base (724)..(724): a, c, t, g, unknown or other
  misc_feature (724)..(724): n is a, c, g, or t
  modified_base (798)..(798): a, c, t, g, unknown or other
  misc_feature (798)..(798): n is a, c, g, or t
tcagactagcagtacacgaccggtgctcgatttagagtatacatagttgggtttgtcctcctgctggtggcagctccagntgggtcctgtccctggtgcaactgcgaggtcgtccggggcccctagacgtgggtagacggtccttacgggaacgtccccttggtccccctntaaccgtgccggtcttcgttcgtcgtggtcctcccgtaaccagttcgacggttgtttcggtttcttcggtgggggccttcggggtacccgaactacggtccttaccgggaagggggaaccgggtctaaggtaactacgtaggttacgggacttgccttacaagtagttacggttcggtacgtttacttaattacgtacggtcctttctaacgcgtaacgtaaccggtcgtacgttccgaactacgttaacgttccggtacgtaccggtaccgtacccgtaacgacggtaacttaaacggtttccttaaaccggtttttcccgaaggtaaaccgttagttacggttagtttaccggtacccggtaaccggtccccgtcggtccggtaccgacccggtttaaccgggtttnttttagtaccgtggttacgcgggtaaggtaacggtcgtaactttagttacgtttaggttacgtttaggtacggtttcgtttactccgtactaccgtgtacggccgggttcggaccncggtaacccggtggaacccggagttacnccggttacgtctacgttccgtactccttccggaacgtaccggtaaccgtccttaccggtccgttaacccgtccnccgggttcccacctaccgacggttacgccgtaacg

SEQ ID NO: 140218 - DNA, 727 bp, Homo sapiens
  misc_feature: GYAE6OF01D763Q.46.67.G01.1.454.CMB.1.raw
  modified_base (181)..(181): a, c, t, g, unknown or other
  misc_feature (181)..(181): n is a, c, g, or t
  modified_base (686)..(686): a, c, t, g, unknown or other
  misc_feature (686)..(686): n is a, c, g, or t
tcagactagcagtacacgaccggtgctcgatttagagtatacatattgggtttggggagtctcggtcaggacacagcatggacatgagggtccccgctcagctccgtggggctcctgctactctggctccggaggtgccagatgtgacatcgagctcgacccagtcctccactccctcctntctgaccgtaaccgggtgggagtacgagtcgtaccacctatccgtacgttcggaccgggactaacggtaccggaaactacgttacgaaccttaactttaagttttaaagttaggtactacaactaacgtaacggaacccggacgggtacccgtacccgtaacgtaccgttaacctaattacgtacgtcgtcctacgacctacgttaccgttaggtttacgaacggtaaacgggttccggggtaccctacggttacggtacgggtttacgagggtcggtacgtaggtacggtacgtcggtaggtacgtagtttaccttacgaccttcctaccactatactaagtactcgtacacgtaatagtaattacttacgtacttaacttattacgtactaacgtaataagtaacgtttattaacgtttacgttaacggaacgtacggaacctaacgttaactaaacgttaaactaacgtagtcggtagtcgtaacgaactcgtataccgttnttaccttactccgtttccctaccacttccgtagtacgtacg

SEQ ID NO: 140219 - DNA, 755 bp, Homo sapiens
  misc_feature: GYAE6OF01CF7P3.46.67.G01.1.454.CMB.1.raw
  modified_base (236)..(236): a, c, t, g, unknown or other
  misc_feature (236)..(236): n is a, c, g, or t
  modified_base (250)..(250): a, c, t, g, unknown or other
  misc_feature (250)..(250): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccagactggtgaggccctttcgggagaccctgtccctcacctgcgctgtctctggtcgcctcatcagttagtgtttctgnggggctgggtccgnacgcctccgaggggagggctaggaactagagttaggaagttgtctctactagtaggtagggtacgtttacctattaaccgacggttcccgtacttacctacgaagtaacgtcggtaacgttaccaaccgtaattacttcgtacgtacgggacctaccgtaccagtaactaacttaccgttacgttttaccccgtaggtaaacgtagttacggttagtttccgtcggttaccggtacccggtcccggtacgtacggtaaccggtaccggggtttacttttaacgttacgtggttcggtacgacggtaacggtacgtacgttaagtttacgtgtttacggttttggacggtttaggtttactttaccggaacctaaccgttggtaaccgtcggggaccggggttcctaccgggtccccgggttagggggacccgtaagggtaccgttaccggttacggtacccgttaacccggtccgttttaccgacccggtccccgtaaaccccgg

SEQ ID NO: 140220 - DNA, 761 bp, Homo sapiens
  misc_feature: GYAE6OF01A28DC.46.67.G01.1.454.CMB.1.raw
  modified_base (194)..(194): a, c, t, g, unknown or other
  misc_feature (194)..(194): n is a, c, g, or t
  modified_base (208)..(208): a, c, t, g, unknown or other
  misc_feature (208)..(208): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgaccaccgtggganacagtcgtccaccntcacttcggccgggacaacgtacgaactattacgacctacttaagttaaagttggtactacaactagtacgaccgacgggaccgaccctaagcctacctatctatgctgtactactccgtagttcgacgtaacggtcggtacctagtcgtagttacgaggtgacgtagtggacttcggtaggaactagtacctttacaccttacctaccgtaacctacttacggtaacttacgtccgtaccggtaaccgtaacggttaacggttaagttttaacgttttacgttaaacctttaaaccgttttaacggttaccttacggtaaacctaaacgttaaacgttaaacgtttaactaaccgggttttacgtttaacccgggaaccgtaacggtaacctaaaccggtaaacctttaaacgtaaaccggttaaaccgtacggtttcgggacctttacggtaacccgtaccgtaaccctttagttcccgtttaaccgttaccttaaccttccccgttaaccccgttcccgaaccctttacgttcccggttaattaacccgg

SEQ ID NO: 140221 - DNA, 884 bp, Homo sapiens
  misc_feature: GYAE6OF01AQYFP.46.67.G01.1.454.CMB.1.raw
  modified_base (303)..(303): a, c, t, g, unknown or other
  misc_feature (303)..(303): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggacgaccctgtccctcacctgcgctgtctctggtcgcctccatcagtagttgtttcttcgtggggctgggtccggcacgtccgtcccgaggggacgggctaggaatacagttaggaagttcgtctcgtcaagtaggtggtacgttccttagtactacgtaccgtcncctacgaagacgtcgacgtacacctatactctcgtacggacctcgaccacgtctaactcgttaaccgtttcctagaacgttactacggtacgttcgtacggtcgacccggtccgtaccgtacggtaaccgggtacccgggttacgtttttaacgttacgtaggtcggacgggtaagtacggtaccggtattaagtttaacggttagttttacgttttaggggttaagtttacgggtttaacttacccggtaacccttaacccgggtacggttaccgggtaccgggggttacccgggggtaccccgttaccccggggtaaccccggggtacgggggaccccgggtaaacgggttaaccgtttaacccgggttcccgggttacccccgtaccccggttttaccggttacccccgtttaccggtaccccccgtaacccgttaaccccggggtaaaccccggtcccccgtttaaaccggttcccccgggtttaccccccccgtttcccccggtccccgggttaaccccccttacccccgggttaaccccctaaaccgggtaaccggtacccggtaaccccccggg

SEQ ID NO: 140222 - DNA, 689 bp, Homo sapiens
  misc_feature: GYAE6OF01BC9HQ.46.67.G01.1.454.CMB.1.raw
  modified_base (164)..(164): a, c, t, g, unknown or other
  misc_feature (164)..(164): n is a, c, g, or t
  modified_base (300)..(300): a, c, t, g, unknown or other
  misc_feature (300)..(300): n is a, c, g, or t
tcagactagcagtacacgaccggtgctcgatttagagtatacatattgggtttggggagtctcggtcaggacacagcatggacatgagggtcccgctcagctcctggggctcctgctactctggctccgaggtgccagatgtgacatcgagctgacccagtccnccatcctccctgtctgcaaccgtgggacacagtgcaccatcacttgccgggacaaggtcggactattcgactaccttatttaaacgtgtactacgaacatacgaaccgaggggacccgaccctaagcctacctaanctatcggacttgcatccgtagtttcgacgtaacggtcgggtcccagtacggtaggttacacggttggacgtagtcggtatcgtagggacaggttacttacgactactcaccgtatacgtaagttaacgtctaggactaaacggtcgtaaagttacttttacggaccttaacttacgtttaccgttaggtaacctaaacgtagttaaacttaacgtaagtttacggttttaccggaacggaaacgggtacaaaccgtaaaccgttaaactaaaacggtttaacgtaacgtaggtaccgggtacgttacgaccgttacccgaagttcgttaaccggttaccttacctaccggttacccttccccggtaactaacgttccgttacggtaaac

SEQ ID NO: 140223 - DNA, 883 bp, Homo sapiens
  misc_feature: GYAE6OF01DYMGT.46.67.G01.1.454.CMB.1.raw
  modified_base (109)..(109): a, c, t, g, unknown or other
  misc_feature (109)..(109): n is a, c, g, or t
  modified_base (177)..(177): a, c, t, g, unknown or other
  misc_feature (177)..(177): n is a, c, g, or t
tcagactagcagtacacgaccggtgctcgatttagagtatacatattgggtttgtcctcctgctggtggcagctcccagatgggtcctgtccctggtgcaactgcaggngtccgggcccacgactggtgaggtccttcggacgacccctgtcccctcacctgcgctgtctctggtcncctcatcagtgttgtttctcgtgggctgggtccgcacgcctaccggaaggggacgggctaggaatacgtagttacggaagttcgtctcgtctaagttacggttaggtacggtttacctaagttaccgtacgttcccgttctacgtacgtaaaggtacgttccgacgtacccaaccgtattacttccgtacggtcggaaccctacgtccgaacgtacctaactttccgttaaccgttttacccgaagtaagtacgttaggtacgtttctacggtccggaccccggtcgtacgtacggtaacccggttaccgggtttacttttaacgttaccgtgggttacggaaccgggtaacggtaacggtaccgttacgttttaagttttaggtttagggttttaagttttaggggtaggtttttacgggttttaaccgttacccggttaaacccgtacccggttaggtaacccgggttaccggggtacccggggtacccttaccccgggtaccccgggtaggggtaacccggtaacggggttaaccgttaccggttccggtaccccgttacccgttccgttaacccgttacccgaccccgttaaccccggaaaccggtaccccgggtacccttccggttcccccgttacccccgttcccccgtacgtaacccccctaccccgttaccccgaacgtaaccggtcccgtccccggg

SEQ ID NO: 140224 - DNA, 819 bp, Homo sapiens
  misc_feature: GYAE6OF01DV4OM.46.67.G01.1.454.CMB.1.raw
  modified_base (249)..(249): a, c, t, g, unknown or other
  misc_feature (249)..(249): n is a, c, g, or t
  modified_base (528)..(528): a, c, t, g, unknown or other
  misc_feature (528)..(528): n is a, c, g, or t
  modified_base (804)..(804): a, c, t, g, unknown or other
  misc_feature (804)..(804): n is a, c, g, or t
  modified_base (812)..(812): a, c, t, g, unknown or other
  misc_feature (812)..(812): n is a, c, g, or t
tcagactagcagtacacgaccggtgctcgatttagagtatacatagttgggtttggggagtctcggtcaggacacagcatggacatggacgggtccccgctcagcctccgtggggctcctgcctactcgtggcctccggaggtcgccagattggacgactacgtacgacgctaccgaaccctcgtacctccgtacttcccctcgtacgtcgacgaccgaccgggtgggacgacgtagtcctacaacccngtaccgtacgttcgggaccggacgtaacggtaccggtaaatacggttacgtaacccgtttaactttttaaaagttttaaaaggtttccggtttaacaaccggtaaacgttaacggtaaacccgggaaccggtaacccggggtaaaccccggtacccgttaacttaccggtaaccctttaaagtcggttaaacttcggaacgactacgtaccgttaccgttacgtacggtaacgtacgggttacccgtccgtagttaccggagtttacggaggtaccggngtaagtcgtacgacgttagggaactgtaccgtttaccacgtttacccgacacgttaacgtaccgtttaaacgttacacgttaaccggaacgttacggtaagttaaacgtttcgttaaccttaactttaacggttaactacgttaacgtaacctaaacgaattaacgttacgttcgttaacggtcgtaacgaacccggtaagtaaccgtaaattaaacgtaatacgagtcagtcctaggacctcctacgtcttctaccgttactcgtccctcgtacncgttacgngttaccg

SEQ ID NO: 140225 - DNA, 833 bp, Homo sapiens
  misc_feature: GYAE6OF01D2H2A.46.67.G01.1.454.CMB.1.raw
  modified_base (239)..(239): a, c, t, g, unknown or other
  misc_feature (239)..(239): n is a, c, g, or t
  modified_base (363)..(363): a, c, t, g, unknown or other
  misc_feature (363)..(363): n is a, c, g, or t
tcagactagcagtacacgaccggtgctcgatttagagtatacatattgggtttgggggacctcctgtgcaagaacatgaagcacctgtggtttgtcctcctgctggtggtagctcccagagtgggtcctcgtcccgtggtcgcaactgcgaggaggtccgggcccacggactggtgacggtcccgttcgggacgaccccttggtacccctcacccgtggccgcttgtcctcgtgggtcncccttaccgatcgaaggtttacggtttggttttccgtcggtcgggggtccggttcggggtccgggcacggtccctaccgggaagggggtacggggcgtaggtaaatacgtaggttaggaggttntacctctacgtagtacggttggtaacgtttacctagttactcggtccgtctcgacgtaagtcgtacgaacgtccacgtattacgtccgtacgtaacggaccgtaccgtaccgagtaactaacgttcgtttaccgtttaccgaacgtaaaggtattaccgggtagtttacgttcggtacggacccccggtcgtccgtaaccgggtaacggtaacgggtttccgtttaagttacgtaggtacggtacgggtaggtaaccggtccgtttaatttagtttaagtttcgggttttaagttttggggtaagttttcggtttacctttaccggacccgttaacggaggttacgacccgggggtcgggaccccggtacgggtccccgggtaaggggaccgtaaacgggttacgtacccgggtagaccccgtttaccggttacccttacccggacctcccccgaaccggtaaccccggg

SEQ ID NO: 140226 - DNA, 937 bp, Homo sapiens
  misc_feature: GYAE6OF01CGJ6Q.46.67.G01.1.454.CMB.1.raw
  modified_base (205)..(205): a, c, t, g, unknown or other
  misc_feature (205)..(205): n is a, c, g, or t
tcagactagcagtacacgaccggtgctcgatttagagtatacatattggggtttggggagtctcggtcaggacacagcatggacatggagggtccccgctcagctcctggggctcctgctactctggctccgaggtgccagatgtgacatcgagtctagacccagtctaccacttcctccctgtctacgccgaaccggtgggaanacaggtcgtaccaccatccaccggttcggcccggggactaaacgggtaccggaaactacgtttacgaaccctaaacctttaagtttttaaaaagttgggttaacttaaccgaaaccgtaagtaacgaacccggtacggggaacccggtaccccgtaaaggtacccttacctaacgttccttagtagccgttggacctacgttacccgtaggtttacggacgtaaacgggttccgggtaccctaggttacggtaggttacgtaaggtggaccgtagggtggtaacgttcggtacgggtaccgtaggtttacctttaaccgaccgttacctaaccctaaacccgttaacgttaccggttaaacggttaaccgtttacgtaaccgggtaaccggttaaaaccggttagggttaaaacggttttaaccgttttaacgtaaaccgtttaaaccgttttaactttaaaccgttttaccgtaaaccgtaaacgtaaaggttttaaaacccttttaacgttaaaggtttcccgggttttaccggaaaccgggtaaccggggtaacctaaaccggttaaactaaaaacgttaaaaccggtttaaaacggttacccgtagggtttaccgacccgttaacggtaacccgttaaaccgttaagtttacccgttcggtttaccccttacgtttaacccgttccccgttaaccctacggtttaaccctagttaaccccgtttaacg

SEQ ID NO: 140227 - DNA, 761 bp, Homo sapiens
  misc_feature: GYAE6OF01CI5PZ.46.67.G01.1.454.CMB.1.raw
  modified_base (124)..(124): a, c, t, g, unknown or other
  misc_feature (124)..(124): n is a, c, g, or t
  modified_base (140)..(140): a, c, t, g, unknown or other
  misc_feature (140)..(140): n is a, c, g, or t
  modified_base (143)..(143): a, c, t, g, unknown or other
  misc_feature (143)..(143): n is a, c, g, or t
  modified_base (146)..(146): a, c, t, g, unknown or other
  misc_feature (146)..(146): n is a, c, g, or t
  modified_base (414)..(414): a, c, t, g, unknown or other
  misc_feature (414)..(414): n is a, c, g, or t
  modified_base (471)..(471): a, c, t, g, unknown or other
  misc_feature (471)..(471): n is a, c, g, or t
  modified_base (496)..(496): a, c, t, g, unknown or other
  misc_feature (496)..(496): n is a, c, g, or t
  modified_base (755)..(755): a, c, t, g, unknown or other
  misc_feature (755)..(755): n is a, c, g, or t
tcagactagcagtacacgaccggtgctcgatttagagtatacatattggggtttggggagtctcggtcaggacacagcatggacatgacgggtccccgactcagctccgtgggctcctgctacnctggctcgagtgcagntgnacntcgagctcgaccctgtcctacctactccgtacccgtgtcgtaacgcccgtaaacgggtggacgacgtaacggtcgtaccaaccgtactcgtaccggttcggaccgggtaccgtaacggttacggaaccttaggtttaccgaacctaaacgttttaagttttaaaccggtagtttaacaacctaaacggacgttaaccggaaccggtaaccgggggtaccctaaccgttaacgtaccttacgttaatacctaagtccgtaacgtcgtanaccgttaccgtatttacggacgtaacggtccggtactacggtgtacgtacgaggtcncgttaggcgtaagtccgagtacctntacgttcgactctacgaccttagaacgtactacgtgtacgtacgtagtactagtttacgttacgaactttcgttacttaacggtactaactaaattaacggtaatttacgtacgtttacgtaaccggtacaaacggtacctaaacggtaaacttaacgttaaaacgttacgaacgtttacgctaacggtaccgacctagtacgttaaacccttggttaaccctagttaccttaccctcggttaacctgtaaaccggttntaaccg

SEQ ID NO: 140228 - DNA, 750 bp, Homo sapiens
  misc_feature: GYAE6OF01A6E60.46.67.G01.1.454.CMB.1.raw
  modified_base (110)..(110): a, c, t, g, unknown or other
  misc_feature (110)..(110): n is a, c, g, or t
  modified_base (177)..(177): a, c, t, g, unknown or other
  misc_feature (177)..(177): n is a, c, g, or t
  modified_base (232)..(232): a, c, t, g, unknown or other
  misc_feature (232)..(232): n is a, c, g, or t
  modified_base (370)..(370): a, c, t, g, unknown or other
  misc_feature (370)..(370): n is a, c, g, or t
  modified_base (433)..(433): a, c, t, g, unknown or other
  misc_feature (433)..(433): n is a, c, g, or t
  modified_base (471)..(471): a, c, t, g, unknown or other
  misc_feature (471)..(471): n is a, c, g, or t
  modified_base (481)..(481): a, c, t, g, unknown or other
  misc_feature (481)..(481): n is a, c, g, or t
tcagactagcagtacacgaccggtgctcgatttagagtatacatattgggtttgtcctcctgctggtggcagctcccagatgggtcctgtccctggtgacaactgcaggngtcgggcccacgacgtggtgacggccttcggacgccctgtccctcacctgcgtctgtctcgtggtcncctacacgtctaggttagttggtttccttcggtcggggtcgttcggggcccgganacgtccgtacccggaaggggaacggggtctaggaatacgtagttgggaacgttctccgttatacgagttacggtggtacgttactaagtcgtcgttccgtcctacgttacgaaggcgtcggactaccacgtatacctntccgtaggacctacggtaccagacttaaccttcgtacgtttccaggaactgtaggtacgttcnggtaccgaccgtcggtatacgggtaccgtacgggtttnttaaggttcnggtacgacggagtacgtgtacgttattgttacgtttgttcgggtagttagtttacgttccaacgtaccgtaaggtccgtacgggtaccggttcccgaccggtaccgggtccgggtaccggaacggttaacgtccggttacggtcccgtaccgttcccgttaacgtccctaccgtaccgggtaacccgccggttacccgtcccggtttaccgtcccccgttcccccgacggtacccctacccttacccggaacccaccgttcgaacccgg

SEQ ID NO: 140229 - DNA, 842 bp, Homo sapiens
  misc_feature: GYAE6OF01CJLD3.46.67.G01.1.454.CMB.1.raw
  modified_base (120)..(120): a, c, t, g, unknown or other
  misc_feature (120)..(120): n is a, c, g, or t
  modified_base (211)..(211): a, c, t, g, unknown or other
  misc_feature (211)..(211): n is a, c, g, or t
  modified_base (239)..(239): a, c, t, g, unknown or other
  misc_feature (239)..(239): n is a, c, g, or t
  modified_base (599)..(599): a, c, t, g, unknown or other
  misc_feature (599)..(599): n is a, c, g, or t
tcagactagcagtacacgaccggtgctcgatttagagtatacatattgggtttgggggacctcctgtgcaagaacatgaagcactggtggtttgtcctcctgctggtggcagcctccagntcgggtcctgtccgtggtgacaactgcgagggcggtccgggcccacgacgtgggagacggtcccgttagggaccgcccgttcgcccctacncccgtgtcctcgtcgtcgtgtcgggtcnccctaccgtattacgtgttacggtttggtttccgtcgggtggggtcgttccggggccggacgtaccgccggtaccggagggggacgggtacgtacggtaataacggtaggttaggtaagttcggtctccgtaggtaagttacgggttagggtacctttaccttacgtaccgtaccggttcctaccgttactaacggaacgtcgggttacacggttaccaacgtaacttcctaccggttacgtaacggtacccgtacccgttaccaagtaaccttaaaccgtttaccggtttaccctttacccgggtaaaggtacgttacggttaacgttcgtttaccgggtaccgtacggggttaccccnccggtaccgtacgggttacccgttaaacggggtttctttaacggttccgtggtaccggaggttaacggacgggtcgttaactttagttaggtttgttaggttttacgggttagttttaggttacgttaccgtacgttacgtagtaccggtacgggtaccgggtaccgtacccggcggtaccggggacgtagggtacctcgggtactccggttaccgttaccgtccgtccgaccgtaaccccgg

SEQ ID NO: 140230 - DNA, 583 bp, Homo sapiens
  misc_feature: GYAE6OF01A2SCQ.46.67.G01.1.454.CMB.1.raw
  modified_base (334)..(334): a, c, t, g, unknown or other
  misc_feature (334)..(334): n is a, c, g, or t
  modified_base (340)..(340): a, c, t, g, unknown or other
  misc_feature (340)..(340): n is a, c, g, or t
  modified_base (399)..(399): a, c, t, g, unknown or other
  misc_feature (399)..(399): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctgtgggctgggtccgcagcctcccgaggggaagggctggaatacattggaagtgtctctcatagtggaggttcctattacagtccgtctctcaagagtcgagtcaccatactctctggacacgtccagcaatcagttttcccngaactntgagttctcgtgacccgccgctgacacgggtctttattactgtgcgagagacgtctatntgtattttggagttgttattaccgactaccctagacgtcggacggggtcctcggtaccccgtgggccgagggtaactcgtcggtacctaccgtccgtacctcgtccctaccgaccgaacggccctacgtcccggtcccgttcccccgtcggtccctaccccgtcctaccgaacgtcgtacccgg

SEQ ID NO: 140231 - DNA, 795 bp, Homo sapiens
  misc_feature: GYAE6OF01EBSWV.46.67.G01.1.454.CMB.1.raw
  modified_base (151)..(151): a, c, t, g, unknown or other
  misc_feature (151)..(151): n is a, c, g, or t
  modified_base (172)..(172): a, c, t, g, unknown or other
  misc_feature (172)..(172): n is a, c, g, or t
  modified_base (210)..(210): a, c, t, g, unknown or other
  misc_feature (210)..(210): n is a, c, g, or t
  modified_base (576)..(576): a, c, t, g, unknown or other
  misc_feature (576)..(576): n is a, c, g, or t
  modified_base (591)..(591): a, c, t, g, unknown or other
  misc_feature (591)..(591): n is a, c, g, or t
tcagactagcagtacacgaccggtgctcgatttagagtatacatattgggtttgtcctcctgctggtggcagctccagatgggtcctgtccctggtgcaactgcaggagtccgggcccagactggtgaggccttcggagaccctgtccctnacctgcgctgtctcgtggtcncctcatcgagtgttgtttctcgtgggctcgggtaccgnacgtccgtaccggaaggggaagggtcctaggtaaactacgagtttagggaaacgttcgttccttacgtactaaggttacgggttcggtaacgggttttacccttaaacgtttaaccgtaaccggttcccccggtttaccttaccgttacgtaaaacggacggttaccggtaaccggtttaacccgaaaccccttaagttaacctttccgttaccggtaccgggtaaccgtacccggttaccaacggtaccctaaacgtttaccgtttaaccgtttttaccccgaggtaaacgtacgttacggtacgtttccgtgggtacgtacccgccgtcgtacggacgtacggttacgtttactacgtgtacgngtacgacgtacggtnttaattgttcgttagtttggtagttagttacgtttacgactacccgtagaccgtcggtacgggtcctacgaccggtgggactaacgggtactacgtcggtcctaccggttcctacgttccgcccgtaaccgacccgggtaccgacctacgttccccggtacctccccgtacggccctacccctatacccgaagtccgtacccgg

SEQ ID NO: 140232 - DNA, 793 bp, Homo sapiens
  misc_feature: GYAE6OF01DI4XP.46.67.G01.1.454.CMB.1.raw
  modified_base (96)..(96): a, c, t, g, unknown or other
  misc_feature (96)..(96): n is a, c, g, or t
  modified_base (251)..(251): a, c, t, g, unknown or other
  misc_feature (251)..(251): n is a, c, g, or t
  modified_base (296)..(296): a, c, t, g, unknown or other
  misc_feature (296)..(296): n is a, c, g, or t
  modified_base (330)..(330): a, c, t, g, unknown or other
  misc_feature (330)..(330): n is a, c, g, or t
  modified_base (409)..(409): a, c, t, g, unknown or other
  misc_feature (409)..(409): n is a, c, g, or t
tcagactagcagtacacgaccggtgctcgatttagagtatacatattgggtttgtcctcctgctggtggcagctccagatgggtcctgtcctggtncaacgtgcgaggtacgtccgggaccctacggacgtgggtgacgggtcccgttacgggacgtaccccttgtcccctacaccgtgccgctcgtctcgtcgggtcaccctctagtcgtaaggtttgttcggtttccttggcgggtcgtcgggtccgancgccgacggaggggagtctaaggatacgaggttagagttctactntataggtggtggtacgttctagtactcgtccttntactagaagtcgacgtactaccaactatacgttctacggacacctacgccatacctaactttcgttacgttcgtaaagngtatggttactcgtcggtccgacgccgtacgtggtacggtttacgtggttttaaactcggtagttacggacgaggtaaccgagtttacgttaaagtttggttagtttaacgttagggttacggtttacggttttacgtaacggttaccgtaaccgttaggaaccgggttccgggtaaccgggttcccgtaccccgggttaacccggggacgggtaaccggtaacggggtaactttaccgggtacgtacccgttacccggtaccctttacgccccgttaaaccgaccccggttaacccggacccggtaccccgttaccggttcccggtacccccgtttcccgccccgtcccccgtaactaccccgttagaacccggtactcccgg

SEQ ID NO: 140233 - DNA, 691 bp, Homo sapiens
  misc_feature: GYAE6OF01AXO3H.46.67.G01.1.454.CMB.1.raw
  modified_base (98)..(98): a, c, t, g, unknown or other
  misc_feature (98)..(98): n is a, c, g, or t
  modified_base (127)..(127): a, c, t, g, unknown or other
  misc_feature (127)..(127): n is a, c, g, or t
  modified_base (140)..(140): a, c, t, g, unknown or other
  misc_feature (140)..(140): n is a, c, g, or t
  modified_base (153)..(153): a, c, t, g, unknown or other
  misc_feature (153)..(153): n is a, c, g, or t
  modified_base (182)..(182): a, c, t, g, unknown or other
  misc_feature (182)..(182): n is a, c, g, or t
  modified_base (199)..(199): a, c, t, g, unknown or other
  misc_feature (199)..(199): n is a, c, g, or t
tcagactagcagtacacgaccggtgctcgatttagagtatacatattggggtttgggggagtctcggtcaggacacagcatggacatgagggtccccncgtcagctcctggggctccgtgctactcnggcctccgaggtncccagatgtgacntcgagctacgacctatctccatcctcctnctgcgacggtggacacntgccacatcgacgttcgccgggtacaaggtcgaatgtcaacgttaccttaattacgttggtactacaacttaagaccggacggacgggtaccggaacctaacgtacttacctaagttcctaatcgtcgttacactaccgttacgtcggttagacggttaaccggttcgggtaccctagggttaccgtacgttacgaaggtttcggagtccggtaggtacgtggtaaccggagttactactttaccacgtaccctaacgacttacgtacggtaataccgtaactccgtaacgttacggtaagttaacgtttacgttaaccgtaacttaactttagttaaccgtactaccgtaacgtacgttaaataacgttaccggtttacgttaccggtaacgtacggaactaacgtaactaaactaaaccgtaacgtagttcggtaacgtacgtacgactaccgtgtactcgtacgtctcgtaccttcaattctgtactcg

SEQ ID NO: 140234 - DNA, 992 bp, Homo sapiens
  misc_feature: GYAE6OF01BV3OK.46.67.G01.1.454.CMB.1.raw
  modified_base (174)..(174): a, c, t, g, unknown or other
  misc_feature (174)..(174): n is a, c, g, or t
  modified_base (206)..(206): a, c, t, g, unknown or other
  misc_feature (206)..(206): n is a, c, g, or t
tcagactagcagtacacgaccggtgctcgatttagagtatacatattggggtttggggagtctcggtcaggacacagcatggacatggagggtccccgctcagctccgtggggctcctgctactcgtggctccgaggtcgcagatgtgacatcgtagttcgacctagtcctccnctccctccctgtctcgacgaccggtggacacnggtctaccaccatccgtacgttcggacccgggataacggtcggaaactagttacgaaccttacctttaaagttttaaacgtcggttaataccaaacgtattaacggaacccggacggggtaacccggaccccttaagaccccgttaaccctaaacgtttcgtaagttcggtaccgttacgtaccgttaactttccccggtaaaggttttacggaaaccggtttaaaaccggggtcccggggttaacccctaacggtttacggtacggttttaccggagggtttccgggacgttagggttacgggaaccgtttccgggaacgggtaactttaacggttaccttttccgaaccctttcccgttaaccaaccctaacgggttaattaaccgttaaacgtttccggtaacgtaacccgtaaaggggttacgttaaacgggttttacctttacgggtaaactttaaaccgttttaacgtttactaaccgtaaaccgttaacgtaaagttaaaccgttttaaacgttaagtttttacccggggtttaacggaacccgggttaaacggtaaccccttaaaccgggtaaaacgttaaaccggttaaaaaccgttaacccgggttacgttaaccggggttacgaaaccggttaccccaaaccggttaaaccgtttccgtttaccggttaaccgttttaaccgtttttaccccggaaaacctttttccccccggttaaaccccgtttaaccccttaacggtacccgtttaaagggtttaacccccttaaccggggg

SEQ ID NO: 140235 - DNA, 730 bp, Homo sapiens
  misc_feature: GYAE6OF01DTGP2.46.67.G01.1.454.CMB.1.raw
  modified_base (195)..(195): a, c, t, g, unknown or other
  misc_feature (195)..(195): n is a, c, g, or t
  modified_base (376)..(376): a, c, t, g, unknown or other
  misc_feature (376)..(376): n is a, c, g, or t
  modified_base (413)..(413): a, c, t, g, unknown or other
  misc_feature (413)..(413): n is a, c, g, or t
tcagactagcagtacacgaccggtgctcgatttagagtatacatattggggtttggggagtctcggtcaggacacagcatggacatgagggtccccgctcagctcctggggctcctgctactctggctcgaggtgccagatgtgacatcgagctcgacccagtctccatcctccgtgtctgccaaccggtggganacgagtcgtccaccatccacgttggccgggactaacgtcggaactattcgaacctaacctttagttttaaacgttggtactacaaacgtagtacgaaccgacgggaccgacctaagtcctactaactctagtgctgctacgtcgtacgttgacgtaaggtcgggtcctagtcgtaggttcnggtgcgtagtcggtatcggtacgggatacgtatttcnccgtatccactactacgtaattaactacgttacgaacgtaacggtaagtaacgtttagtttacgtaacgttaaaccttttacgttaacgttaccgtaacctaaagttaaacgttaaacgttttaacgttaaagttttaccgggtttaaccgggaaccgggttaaacgggaacccttaaacgggtaaccttaaaacgttaaacgttaaaccgtacgtacggttacgaccgttacgaaccgttaccttagttaccgtttcgttaccttaccgtaaccgtttccccgttaacccgtaccgtaacttcgttaacgtaaccg

SEQ ID NO: 140236 - DNA, 771 bp, Homo sapiens
  misc_feature: GYAE6OF01DR9BS.46.67.G01.1.454.CMB.1.raw
  modified_base (124)..(124): a, c, t, g, unknown or other
  misc_feature (124)..(124): n is a, c, g, or t
  modified_base (190)..(190): a, c, t, g, unknown or other
  misc_feature (190)..(190): n is a, c, g, or t
  modified_base (208)..(208): a, c, t, g, unknown or other
  misc_feature (208)..(208): n is a, c, g, or t
  modified_base (548)..(548): a, c, t, g, unknown or other
  misc_feature (548)..(548): n is a, c, g, or t
  modified_base (590)..(590): a, c, t, g, unknown or other
  misc_feature (590)..(590): n is a, c, g, or t
  modified_base (758)..(758): a, c, t, g, unknown or other
  misc_feature (758)..(758): n is a, c, g, or t
tcagactagcagtacacgaccggtgctcgatttagagtatacatattgggtttggggagtctcggtcaggacacagcatggacatgagggtccccgctcagctccgtggggctcctgctactcnggctcggagtgccagatgtgacatcgagtccgtcgaccctagtcctaccactccctccgtaggtcncgaccgaaccggtggganaccgtgttactaccaaccgtatccgtacgttccgggacccgggacgtaacgggtaccgaactacgtttacgaaccttaacgtttaaagtttaaagtttcggtaactacgaaactaagtaccggaaccggacgggacccgtaacccttagtaccgtaacttaatacgttagtcacgtagacctacgtaccttaggttacgaacgttaacggtccgggtacgtagtacggtacgtggtacgtggacgtagtagacgttgaccggtagtaccgttacttcgacccttacgtaccgaaaccttcgtaaacgtacgttaccgtcgtaagtaccggttaaacgttntaacgtttatacgtaacttaacgtttagttacctacggtaanaaacgttataaccgttaggttacttacggggttaaacccacgggtaaaccggtaccctaagttaaaccgtaaaacgtaaacgtttaacgaccggttagttacgaccggtaaccaccgtaaacttcgttaacttacttccgttacctacccgtcccgtactaccgttanccggttactaacg

SEQ ID NO: 140237 - DNA, 779 bp, Homo sapiens
  misc_feature: GYAE6OF01BRK5S.46.67.G01.1.454.CMB.1.raw
  modified_base (757)..(757): a, c, t, g, unknown or other
  misc_feature (757)..(757): n is a, c, g, or t
  modified_base (766)..(766): a, c, t, g, unknown or other
  misc_feature (766)..(766): n is a, c, g, or t
tcagactagcagtacacgaccggtgctcgatttagagtatacatattgggtttggggagtctcggtcaggacacagcagtggacatggacgggtcccccgctcagcctccgtggggcctccgtgctactcgtcggctaccggaggtcgaccagattgtacgacagtccgacgtccgtaccggaccctacgttccctaccctaccttccccttcccttacgtcgtacgaccggtaaccgggtggacacgtagtcgaccacctatacgtaccggtcggaccggagtaacgtacggtaactaggtaacctaaccttaacgtttaacgtttaaaggtagttaacctaacgaaacgtaacgtaccggaaccggaccggggtaacccctaccgtaacgtacccttaaccgtaattacggtaactccgtaccgtagttaaccctagtttaccggttaacggtacggtaaaccgggtacgggttaccccgaccggttacggttacgggtacggttagacgggtagacgttacgggtagtacggtcggtagtaccgtatttacgtccaatcctaagtactagtactaacgtcgaacgtcaacggtacgttatagttactacgttaactagttactacgtaactaagtaataatttactaacgttcgttacgacccggaatacgaaacgtaactaaattaacgtaacgtagtgcgtacgtactaccgtcgttataccgttatcccgttacacccttacgttaccccncgtttaacnctaagttccgacg

SEQ ID NO: 140238 - DNA, 763 bp, Homo sapiens
  misc_feature: GYAE6OF01AWP8X.46.67.G01.1.454.CMB.1.raw
  modified_base (174)..(174): a, c, t, g, unknown or other
  misc_feature (174)..(174): n is a, c, g, or t
  modified_base (310)..(310): a, c, t, g, unknown or other
  misc_feature (310)..(310): n is a, c, g, or t
tcagactagcagtacacgaccggtgctcgatttagagtatacatattgggtttgtcctcctgctggtggcagctcccagatgggtcctgtccctggtgcaactgcaggagtccggcccacgactggtcgaggccttcggacgaccctgtccctcacctgcgctgtctctggtcncctcatcgagttggttgtttccgtcggtcgggctcggggtccgcacgccttaccggaggggaagggtcaaggtaatacgtaggtttacggaaggttctactcgtagaaggtacgtggtacgttccttagtaaccgngttcccgtctacgttagaagcgtgacgtcacctagtctccgttcaggacctcgtacagtacacttcgtacgtttccagaagtcgtagtcgttcgtgaaccggtcccgcgtactcggtaaccggttacggtaacgtttttaccgaacggtggttaccgaacggtacggtaacggtaccggttatttaacgttaggtttaggtttaaggttttacgggtacgtttaacggtttaccttaaccgggtaacctacgttaccggtacggtccggggtaaccggtccgtacccggtccggaccgggtacggacgtaacgttcggtaccgtacgtcccggttccgtaccgtaccggacccgttaacccgaacgggtccccgtaaccgttaccggttcccggtaccccttccccgggaactcccccctaaccgtcccttaacggaacccgtctaacccggg

SEQ ID NO: 140239 - DNA, 748 bp, Homo sapiens
  misc_feature: GYAE6OF01CMI50.46.67.G01.1.454.CMB.1.raw
  modified_base (97)..(97): a, c, t, g, unknown or other
  misc_feature (97)..(97): n is a, c, g, or t
  modified_base (194)..(194): a, c, t, g, unknown or other
  misc_feature (194)..(194): n is a, c, g, or t
  modified_base (728)..(728): a, c, t, g, unknown or other
  misc_feature (728)..(728): n is a, c, g, or t
tcagactagcagtacacgaccggtgctcgatttagagtatacatattgggtttggggagtctcggtcaggacacagcatggacatgagggtccccgntcagctcctggggctcctgctactctggctccgaggtgccagatgtgacatcgagctgacccagtctccatcctcctagtctgaccaaccgtggganacagtgtacacatcaacttcgccgggacaaggtccggaactattcgactaaccttaattttaaacgtggtaactacaaacagtaacgaaccgaacggggtaccgacccttaaggtaccttaaccttaaaacgttaccgttaagtacggtaccgttcgtaccgtaacgttcccgtaagtttttcggaacctaaaaggggttccggggtaaccccttacgtacggtacggttacgacggtaggacctaggtacggtacttacgtacgggtactaagtactttacgacttaccgtacaacctatacgaagttaacgtacttagaacgtaacgtaggtaaattcgttttaagaaccttaactttagttaccttaggtaacctaaacgtaacggtaatttaacggtaaacgtttcggtttacgaacctaaagggacctaacggtaacttaaacgtaaacgttaacgtaacgttaggtaaccggtctagtacccgaactagttaccttacgttacgttactaaaccgtccgtttaacccncttaactacgttcgtaaacg

SEQ ID NO: 140240 - DNA, 909 bp, Homo sapiens
  misc_feature: GYAE6OF01CZGG7.46.67.G01.1.454.CMB.1.raw
  modified_base (148)..(148): a, c, t, g, unknown or other
  misc_feature (148)..(148): n is a, c, g, or t
tcagactagcagtacacgaccggtgctcgatttagagtatacatatttgggtttggggagtctcggtcaggacacagcatggacatgacgggtccccgctcagctcctggggctcctgctactctggctccgagtgccagatgtgacntcgagctcgaccacgtctccactccctccctcgtctcgaccgtaaccggtggacgacacgtcgtccactactcctacgttccggccgggactaacggtaccgaactacgttacaccgttaacctttaagttttaacgttaggttaactaaccctaaaactaacgtaaccggtaacccggaaaccggggtaccccggtaaccccgttaaacgtacccttaacccttaaacgttccgttaacgtccgaccttaccggtacctaccgttacccggttaagttttccggaaacggtaaaccggggtttccgggtaccccttggttaaccgggttcgggttaacagggttcgtacgtaggttacggtaggttaccgtagggaacctagttactttaccgaccttacgaaccctaccgtacgttaaccgtttaacgtttaactaccggttacccggtaaccgttaaaccggttaaagttaacgtttaaccgtttaaccgtttaaacgtttaaaccgttttaacgttaacgttaaccgttaaaaccgtaaacgttaaccgtttaaaattaaaccgtttaacggtttacccggtttaacccggtaaccgggtaacgaaacccggtaaacggttaaacccttaaaacgttaaaacgtttaaccggttaaacgttagtaccgtaaccgtaacctaccgttaaccgtacgtttcccgttaacttaccttaccgttccgttaacccgccgtttacctacgtccgttacgtacg

SEQ ID NO: 140241 - DNA, 945 bp, Homo sapiens
  misc_feature: GYAE6OF01EKWRY.46.67.G01.1.454.CMB.1.raw
tcagactagcagtacacgaccggtgctcgatttagagtatacatattgggtttggggagtctcggtcaggacacagcatggacatggagggtccccgctcagcctccgtggggctcctgctactctggctccggaggtgccagatgtgacatcgagctacgaccctagtcctccactccctccgtagtctacgaccgaaccggtgggactacgtagtcgtaccaacctagttccgtaacgttccgggaccgggtaaccaaacgggtaccggaaacttacgttacgtaaaccttaaaccgttttaaatttaaacggttggtaactaacgaaacgtaacgtaaccggaaccgggtaaccggggtacccgtaacccgtaacgtcccctttaactaaaccttccgttaacgtcgtaccgttacgtaccttaccgttaccggttaacggtttaccggaaccggttaaacgggttaccgggttaccccgaaggtttacccggtagggtttaccgaacggtcggtacgtaacggtggtaccgttccgggtacggtaacgtacgttaccgtttaccgtaccgtaccctaccgtaaactacggtaaccgtaacgttaaccgtaccggttaacggtaaaccggttaacggttaagggttaaaccttttaacggttaacgttaaacccgtttaaacgtttaccttacggttaaaccgtaaactaaacgttaacgttaaacgttttaaccgtaagttttaccccgggttaaccggaacggtaaaccggtaaccgttaaaccggttaaactttaaaacccggtaaacgttaacggttaacgtacggtaccgttacgtaccggttaaccctaacggttaactttccggttaacctacgtttaaaccccgcgttttaacccccgtaaccggttacctttaaccgtgttaaacgttacccg

SEQ ID NO: 140242 - DNA, 811 bp, Homo sapiens
  misc_feature: GYAE6OF01C497J.46.67.G01.1.454.CMB.1.raw
  modified_base (429)..(429): a, c, t, g, unknown or other
  misc_feature (429)..(429): n is a, c, g, or t
  modified_base (523)..(523): a, c, t, g, unknown or other
  misc_feature (523)..(523): n is a, c, g, or t
  modified_base (618)..(618): a, c, t, g, unknown or other
  misc_feature (618)..(618): n is a, c, g, or t
  modified_base (652)..(652): a, c, t, g, unknown or other
  misc_feature (652)..(652): n is a, c, g, or t
tcagactagcagtacacgaccggtgctcgatttagagtatacatattgggtttgggggacctcctgtgcaagaacatgaagccacctggtggtttcgtcctccgtgcgtggtggcaagcctaccagagtcgggtcctcggtcccgtgggtcaccaacgtggacgagggacggtccgggacccaagtcgtgggtacggacggtccgttacgggactacccgtcgtcccacacgtggctcgtcgtcctagtcggtcacctacgtactacgtaggttgtttcggtttcgtacggtcgggtcgtcggggtaccgtcgacgtccggtacgggaaggggtcggtactaggaattacggtaggttaccgggaatcgtcgttaccagttaaggtcgggtaggtactttaacctcgttaaactccggtcctacgttanaaacgggtagtaccttaggacctacaaccgtattaccgcgtacgacgaacctacgacctaggaccttaggttacttaaacccgtttgaaaggtntacggtttgtaagtcctaggacgaccgtcagttaggaccgttggttacgttagacgaggtacgaacggtaggtccggaaatttgtagtttaacgnggttttacgtacggttaagttacccgggtttaanaccccgggacctttacggggacgtaacgggtttaccgggacccccgggtttagaacccccgttccgggggttaaggaaccccggaaaggtttacccctacgggttaaccctaaccggtccccgttttaacacccggtttacccggacctaacccccggg

SEQ ID NO: 140243 - DNA, 605 bp, Homo sapiens
  misc_feature: GYAE6OF01DKER4.46.67.G01.1.454.CMB.1.raw
  modified_base (306)..(306): a, c, t, g, unknown or other
  misc_feature (306)..(306): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctcctgtctgcaaccggtgggagacagtgtccaccatcacttggccgggacaacggtccggaacattgactaaccttattttaaatgtaactcaaacataacgaccgagggaccgaccctaagctacctaatctangctgctatccgtagttcgacgaaaggtcgggtcccagtcgaggttcgagtggactaggtgactcgtagggataggtactttacgactctacacctatactaagtaactcgtagaactaacggttagtaagttactttagaacttaacttttacgttctagtaccaaactagttaaacttactaagtttcgtttaacggaccgtaaggtaccacgtaactaaattaaacgtaacgaagttcgtaggctacgcaactattcgttcttacttccactttcccgtaccctctattcgtgtaac

SEQ ID NO: 140244 - DNA, 735 bp, Homo sapiens
  misc_feature: GYAE6OF01D8TBN.46.67.G01.1.454.CMB.1.raw
tcagactagcagtacacgaccggtgctcgatttagagtatacatattggggtttgggggagtctcggtcaggacacagcatggacatgaggggtccccgctcagctcctgggggctcctgctactctggctccggaggtgccagatgtgacatcgagctgacccagtcctcactcctcctgtctgacaaccggtggagactagtgtaccacactcacgttcggccgggacaaggtaccggaactattgaacctaacttaatttaaagtggtatacaacaatacgaacgaggaccggacctaagtctacctaatctatgctgacactactagttcgacgtaaaacgggtcgggtacctaacgtacggttacggtacgagggtcggacgtaggtaggtactcggtaggggactaacgttacttacgtacctactaccgtaactatacgtaatactcgtacgtaacgtaacgttagtaaacggttaacttttaagttaactttaaacttaagttaactaaacgtaaccgtaaagttaaacgtttaactaaggtttacgggtttaaccggtaaaccggtaaaggggaaccctaaacggtaaacctaaaacgtttaaaacttaaaccggtaacgttacggtaaccggtacgtaacgtaacccgtaaacctacgttacgttactttaccgttacctaacccgttcccgttaaccctactaacgttactgtaaccgttaacg

SEQ ID NO: 140245 - DNA, 633 bp, Homo sapiens
  misc_feature: GYAE6OF01DPIQB.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtccggggccccagactggtgacggcccttcggagacccctgtcccctcacctgcgctgtctctggtcgcctccatcgagttaggttggttttcttcgtggggctggggtccggcacgcctcccgaggggaaggggctaggaatacgagttggaagtgttctctcgagtaggtggtaggttaccttattacagttcccgtctctacaagagtcgagtccaaccattatctcgtcggaaccgacctccagactaatctacgttttcccagaagtatgtacttcgtggtcgacccgcgtactggtacgtacgggttacttttattacgtggagcgagagcgtattatatgtttagtttggtagttgtttacttacgacctacctagtacgtcgggacgggtctccggacccggtgggaaccgtagggtactacggtcggtacctcgttccgtccttacgccctaccgaccgtacggccctcggtcccgtccctcccgaccgtccctaccctccaacgcgcgtaccg

SEQ ID NO: 140246 - DNA, 868 bp, Homo sapiens
  misc_feature: GYAE6OF01B9ZS1.46.67.G01.1.454.CMB.1.raw
tcagactagcagtacacgaccggtgctcgatttagagtatacatattgggtttgggggaccctcctgtgcaagaacatgaagcacctgtggtttgtcctcctgcgtggtggcagcctcccagagttcgggtcctcgtcccgtgggtcgaccaactggcgagggacggtccgggccccaacggaccgttgggtcggacggtcccgttacgggaaccgtaccccttcggtccccctacgaccgtcggccgtcttcgtccgtcgtggtccgcctcctagtcgtaaggttcggtttcggttttccgtccgggtgggggtccgttcggggtccccggacgtaccggtccgtacccgggaagggggtacgggtacgtaacggtaacgtacgtaggttacggtaacgtcgttcctctacgtagtaggtaggttacgtttacgttactacgtacgtccgtcgtactagtaagtcgtacgtacgtacctaccgtattctccgtacgtacggtaccctacgaccgtagtaacctacttccgttacgtttaccgaggtaacgtgttcgttagttcgtacgtcccggaccgtccgtacgtacggtaaccggttacggtttaacgttttacgtacgtgggtaccggacggtaaggtacggtacgtactttaagttacggttaggtttttacgggtttaggtacggtttgggtttaaccttaccggtaaccgttaacccggtaggttacccgggtaaccgggtccgggtacccgtaccccgggttacccgggtcgggtaaccggtaacggggttacttaacccggggttccgtaaacccggtcccggtttacccgtaccttccccggtcccccgtaacccgg

SEQ ID NO: 140247 - DNA, 903 bp, Homo sapiens
  misc_feature: GYAE6OF01A2FAG.46.67.G01.1.454.CMB.1.raw
  modified_base (706)..(706): a, c, t, g, unknown or other
  misc_feature (706)..(706): n is a, c, g, or t
tcagactagcagtacacgaccggtgctcgatttagagtatacatattgggtttgggggacctcctgtgcaagaacatgaagcacctgtggtttgtcctcctgctggtcggcagcctcccagagtgggtcctgtcccgtggtgcaacgtgcgagggacggtccgggacccacggacgtgggtcggacggtcccgttcggaccgacccttcgtcccctcgtaccgtggccgtccgttcgttccgttcgtcggttccgtacccttaccaagttcggtaaggtttcggtttcggttttccttcgggtcgggggtccgttcgggggtccgacgtcggacccgtaccggggaaggggtacgggtcgttaagggaacttacggttaggttaacggacgttcgttaccttacgtagttaaggttagggtcggggttaaccgttttaccgttaagttaaccggtaccggttccccgttacgttacggtaaccgtaagggtccggttaaccggacgttaacccgaacttaacgttaccttccgtacggtacgggtaaaccctcccggaacgtaaccgtaacctactttacccggtttaaccgtttacggaacggtattacggtttagttaccctttggtaacccggtccgacccggtcgtacgtacggtaccggttacggtttactttagtcggtggtaacgacggtagtacggtnttacgttaagtttaggttggttttaacggtttgggttacgtttacggttactaacccgaaccgttacgaccggttaacgggtcccgggggaccgttacccgggtaccccggtcgggggaccggtaagggtacgggttaccgttcccggttcggtaacccctacccggttctacccgttacccgtaccccgtaaccgg

SEQ ID NO: 140248 - DNA, 739 bp, Homo sapiens
  misc_feature: GYAE6OF01CTNJX.46.67.G01.1.454.CMB.1.raw
  modified_base (127)..(127): a, c, t, g, unknown or other
  misc_feature (127)..(127): n is a, c, g, or t
  modified_base (150)..(150): a, c, t, g, unknown or other
  misc_feature (150)..(150): n is a, c, g, or t
  modified_base (169)..(169): a, c, t, g, unknown or other
  misc_feature (169)..(169): n is a, c, g, or t
  modified_base (487)..(487): a, c, t, g, unknown or other
  misc_feature (487)..(487): n is a, c, g, or t
  modified_base (494)..(494): a, c, t, g, unknown or other
  misc_feature (494)..(494): n is a, c, g, or t
  modified_base (541)..(541): a, c, t, g, unknown or other
  misc_feature (541)..(541): n is a, c, g, or t
tcagactagcagtacacgaccggtgctcgatttagagtatacatattggggtttgggggagtctcggtcagggacacagcatggacatgagggtccccgctcagctccgtggggctcctgctctcgnggctcggaggtgccagtatggtnacagtcgagctcgacccgnttcctccactcctcctgtctgaccgaccggtgggacacgcgtcgtaccacactctacgtcgggacggacaacggtacgtaactacgtactacctaactttaagtttaacgtagtactaaccgaaacgtacgtaacggtaaccgggaccgggtaccccgaacctacgtaccttaacttacgtactgtcgacctagtaccgtacttacggttaacggttacggaaaccggtacgggggttccggtaccttaacggtcgggtacggtaggcggttcgcgtagggtcgtaaggtcggtaacggtacgttacgttaacttccnctaaccncgtaactgtaagtactactagttaccgacttaaggtggttaacgttnttaacgtaactacgtttactacggttactaacgaattacgtaacgttacgttaacgttcgggtaaccgaacggttacggaactaacgttaaacctaaaaggttaaccgttagaccggtgtacggacctacggtaactacgttctacgtttccctaactacccttaccgtccctaactacgtacttgggttacaccggg

SEQ ID NO: 140249 - DNA, 984 bp, Homo sapiens
  misc_feature: GYAE6OF01BVBGG.46.67.G01.1.454.CMB.1.raw
  modified_base (202)..(202): a, c, t, g, unknown or other
  misc_feature (202)..(202): n is a, c, g, or t
  modified_base (935)..(935): a, c, t, g, unknown or other
  misc_feature (935)..(935): n is a, c, g, or t
  modified_base (942)..(943): a, c, t, g, unknown or other
  misc_feature (942)..(943): n is a, c, g, or t
  modified_base (946)..(946): a, c, t, g, unknown or other
  misc_feature (946)..(946): n is a, c, g, or t
  modified_base (951)..(952): a, c, t, g, unknown or other
  misc_feature (951)..(952): n is a, c, g, or t
  modified_base (954)..(954): a, c, t, g, unknown or other
  misc_feature (954)..(954): n is a, c, g, or t
  modified_base (956)..(956): a, c, t, g, unknown or other
  misc_feature (956)..(956): n is a, c, g, or t
  modified_base (958)..(958): a, c, t, g, unknown or other
  misc_feature (958)..(958): n is a, c, g, or t
  modified_base (964)..(964): a, c, t, g, unknown or other
  misc_feature (964)..(964): n is a, c, g, or t
  modified_base (968)..(968): a, c, t, g, unknown or other
  misc_feature (968)..(968): n is a, c, g, or t
  modified_base (972)..(973): a, c, t, g, unknown or other
  misc_feature (972)..(973): n is a, c, g, or t
  modified_base (975)..(975): a, c, t, g, unknown or other
  misc_feature (975)..(975): n is a, c, g, or t
  modified_base (977)..(977): a, c, t, g, unknown or other
  misc_feature (977)..(977): n is a, c, g, or t
  modified_base (979)..(982): a, c, t, g, unknown or other
  misc_feature (979)..(982): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactgggtgaggccctttacggagacccctggtccctcacctgcgctgtctcgtggtcgcctcatcagtagtgtttctcgngggctgggtaccgcacgcctccgaggggagggctaggaatacagttaggaagtcgtctctacagttaggtggtaacggttccttaattaccgtacgttccgtctactacgaagtacgtcgaacgtccgaaccagttacttctaccgtacggaacctaccgtaccgagctaaacgttccgtttaacggttttccccgtaaggtaaacgtacgtttacggtaacggttttcgttacggtacggtaacccggtcccggtaccggttaccggtaacccgggtttaccggggggtttaaccctttttttaacgtttaaccgggtttacgggtttacgggtaacccgggtaaacggggttaacggggtaaaccccgggtttaacccggtttttaaaggtttttttaacccgggttttaaaacgggtttttttttaaacggggtttttttttaaacggggggggttttttaaaagggggtttttttttaaaaccccggggggtttttttttttaaaacccggggttttttaaaccccccggggtttttaaaaaacccccccgttttaaaaacccccccgggggttttttttaaaaaacggggggtttaaaacccccgggggggtttttttaaaaccccccccggggggggggggttttaaaaccccccggggggggggggttttaacccccccgggggtttttttaaaaaacccccccccccccggggggggtttttcgngcagtcnncgncgtcnncncncncgcgcnctcnctcnncncncnnnncg

SEQ ID NO: 140250 - DNA, 871 bp, Homo sapiens
  misc_feature: GYAE6OF01ADGSQ.46.67.G01.1.454.CMB.1.raw
  modified_base (303)..(303): a, c, t, g, unknown or other
  misc_feature (303)..(303): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtaccggcagctcccgaaggggaggggctggaatacagttggaagtgtcctctcagtaggtggtacggttcctaattacacggtccgttctactacaagnggtccgagtcaccgatatcctacgtgactacgtccagcaatctacgttttccagaacgtatcgtagttctgtacggaccgtccgtccgtaggaaccgtacggggttacgttttaacttaccgtgggttcggaaccgggtaggtaacggtacccggtaactttaagtttagttacgggtttaagtttttaaggggacggttttaggttttaacgtttacccggtaaacccgtacccggtttaaaggtaccggttaccgggggtaaacccgggggtttcccggtaccccggtaacccccgggggttacggggggtaaccccgtaaacgggggttaaacctttaacccgggtttcggggttaaccccgtaaccccgggtttccgtttaaccccggtttaccgggtacccccgttaaccccggaaaaccccggggtaaacccgggtcccccggtttaaacgtttaccccccgggggtttcccccctttaacccccccgggttggtaacccccccccgttaacccccggtttacccccggtaaccctaaaccgggtcccggtaaccccccggg

SEQ ID NO: 140251 - DNA, 792 bp, Homo sapiens
  misc_feature: GYAE6OF01AQMQT.46.67.G01.1.454.CMB.1.raw
  modified_base (202)..(202): a, c, t, g, unknown or other
  misc_feature (202)..(202): n is a, c, g, or t
tcagactagcagtacacgaccggtgctcgatttagagtatacatattgggtttggggagtctcggtcaggacacagcatggacatgagggtccccgctcagctccgtggggctcctgctactctggctccggaggtgccagatgtgacagtcgagctcgaccctagtcctccactccctccctgtctgaccgacggtgggancgagtcgtcactatcgacttcggccgggtacaaggtccgaactattcgtaactaacctttaagttaaagttcggtataacaactagtacgaaccggtacgggaccgtaccctagtctaacctatctagtcgtctagtcctactcgtagttacgaacggttaacgggtccgggtacctagtaccggtaggttaccgaggtcggtacgaggttggaacttcgggtagaaccgttagttacttacccgtactacgtccgtaaacgtacttaacgtacgttaacgtacgacggtaacgttaacggtaacggttagtttacgttacttaaacgtttaccgttttaacttacggtaacgttaacgtaaacgttaacgttaaacgtttaacgtttaaccgggtttcggttaccgggtaaaccgggtaaacccggtaaccgtaaacccgttaaactaaaacgttaaacgttaaaccggtaacgttaacgggtccgtaacgtcccggtaacccgtaaccgtttaccgttacggtttaccttacccgttaaaccgttccgttaccctaccccgttaccgttacttaaccgtaagttaccg

SEQ ID NO: 140252 - DNA, 819 bp, Homo sapiens
  misc_feature: GYAE6OF01EEOXU.46.67.G01.1.454.CMB.1.raw
  modified_base (195)..(195): a, c, t, g, unknown or other
  misc_feature (195)..(195): n is a, c, g, or t
tcagactagcagtacacgaccggtgctcgatttagagtatacatattgggtttgtcctcctgctggtggcagctccagatgggtcctgtccctggtgcaactgcgaggacgtccgggcccgacgacgtgggtgacgggtcctttcgggacgtaccccgtcgtcccctcaccgtgcgtcttcgtcctcgtcggtcnccctctatcgtaagttgtttcggtttccttggtcgggtcgttcggggtccgacgcgcccgtacccggggaggggacgggtcgtaggtaaatacgtacggttaggtaacgttcgtccttctacgtaaggttaggttcggttacggtttaccgttaacgttaccgtaccgttcccgttctacctaacgaacggtacggttacggacttaccgaactagtttacctaccgttcgacggtaacctcccggtaaccaacgacttaacgttaccgtttacttttacccgtagtaagtacgttagttacgtacgttcgtaccgccgtccgtacgtcgaccggttacggtttacgtttacgttagttcggtcgacgtaggacgtacgtacgttatttacgttagtttagtttacggttaggttttcgtttagttacccgtacgacgttaggtaccggttccgggtaacgggtcccggttacccgaccgggtcgggaccggtaggtacgttacgtaccgtccgtaccgttccgttaccgtcctaccgtacccgacggtaccccgtacgttccggttccccgttccccgttacccgtcctaccccgtaccctcccgtaacgtcgtaccgtccgg

SEQ ID NO: 140253 - DNA, 946 bp, Homo sapiens
  misc_feature: GYAE6OF01C946H.46.67.G01.1.454.CMB.1.raw
  modified_base (234)..(234): a, c, t, g, unknown or other
  misc_feature (234)..(234): n is a, c, g, or t
  modified_base (284)..(284): a, c, t, g, unknown or other
  misc_feature (284)..(284): n is a, c, g, or t
tcagactagcagtacacgaccggtgctcgatttagagtatacatattgggtttgggggacctcctgtgcaagaacatgaagcacctgtggtttgtcctcctgctggtggcagcctcccagtatgggtcctgtccctggtgcaactgcgagggacgtccgggacccagactggtgacggtccttcggacaccccttgtcccctacacccgtggccgtcttcgtctccgtggtccncctacatacaggttagttcgtttctcggtggggtccgttggggtacccgnacgccgtaccggaaggggaaggtccgtaaggtaataccgtaggtttaggaacgttcgtccttcgtacaaggttaggttaacggggtaaccggttttaccttaacgtttaaccgtaccggtttccccgttaccgttaccgttaaaccgaaagtaccgggtagtaccggtaaccaaccctattaactcccgttcggtacggtaacctccgttaccgaacgacttaacgttccgttaccgttttaccgagtaagtgtaggttaccgtttctacggtcccggtaccgccgtaacgtaccggtaccggttacgggtttacctttaacgttcgggtacggtcggtaacgttaacgggaccggttaacccgtagttttaaaccggtttggtttaaacggttttttacggtttttaaacggggtttacggtttttaacgggttttaccttttaaccccggtaacccgttaaccgggtttaaccgggttaaacccggttaccccggggggtcccggggtttaccctaccccccggggtaaccccggggtaggggttaacccggttaaacggggtttaaccctacccgggtttaccggggttaaaccccccttaccggggttttacccttaaacccccgggttccgttaaccccccggtaaacccccccggg

SEQ ID NO: 140254 - DNA, 768 bp, Homo sapiens
  misc_feature: GYAE6OF01DZTQX.46.67.G01.1.454.CMB.1.raw
  modified_base (135)..(135): a, c, t, g, unknown or other
  misc_feature (135)..(135): n is a, c, g, or t
  modified_base (383)..(383): a, c, t, g, unknown or other
  misc_feature (383)..(383): n is a, c, g, or t
tcagactagcagtacacgaccggtgctcgatttagagtatacatattgggtttggggagtctcggtcaggacacagcatggacatgagggtccccgctcagcctccgtggggctcctgctactcgtggctccggnggtgccagtatgtcgactagtcgagctcgtacctagtcctcctacttcccttcctcgtctcggaccgtaaccggtggacgactggtacgtaccacctataccgtacgttccggaccggacgtaacggtaccgaatacgttacgtaaccttaactttaaagtttaacgttacggtactaacgaaactagacccggaacggtacggacccggtaccaagtcctaacgtacttcgtacgtctacgtcctanaccttcgttacgttacgaacgggtacggttcgtacctaggtcggtagttcgagggttccaggtcgtagtcgtacgtaggacgtactttacgtacgtcccacgtaccgtaatacggtaataccgttacgtactaccgtacgtaacgtttaagtaacttcgttaacttaactttaacgttaacgttagttaacgtaactaacgttaaacgtaacgtttaagttaccggtttacggtaacgaacgggtacccgaaacgtaacgtaaaccgttaaagttaaaccgaaccgtcgttaaggtcctaggtaaccctacgttaccgtaatttccgtacttaccggttactaccgttacccaccgttaatccccggttataccgggtttaaccc

SEQ ID NO: 140255 - DNA, 794 bp, Homo sapiens
  misc_feature: GYAE6OF01C5U8I.46.67.G01.1.454.CMB.1.raw
  modified_base (98)..(98): a, c, t, g, unknown or other
  misc_feature (98)..(98): n is a, c, g, or t
  modified_base (514)..(514): a, c, t, g, unknown or other
  misc_feature (514)..(514): n is a, c, g, or t
  modified_base (534)..(534): a, c, t, g, unknown or other
  misc_feature (534)..(534): n is a, c, g, or t
  modified_base (547)..(547): a, c, t, g, unknown or other
  misc_feature (547)..(547): n is a, c, g, or t
tcagactagcagtacacgaccggtgctcgatttagagtatacatattgggtttgtcctcctgctggtgacagctcccagatgggtcctgtccctggtncaactgcaggagtcggcccagactggtgaggccttcgggacacccttcgtcccttcaccgtgccgtctcgtctcgtggtcgccctccatctaggttagttggtttctcgtcggggcttcggggtccgcgacgtccgtacccggagggggtaacgggtcgtaacggtaatacgtaagtttagggaagttcggttacctacgtctagttaggttacgggtacgtttaccctattaacgacggttcccgttactacctacgaagtacggtacgtacgtaaccacccttaaggtaaccttccgtttaccggttacgggaacctacccggtttaacgaacggtaaccttacgttaccgttaaccgttttccggagtaaactgttacgttaacgttcgtacggtaccggacccgtccgttanacggtaaccggtcgggtttntttaacgtgtagngacgagtacgagtcttaagtcttggtttagtttggaagtttcgtttaacgtacctaacctaccggtagtcccgtcggggaaccggtttccacccgggtaaccccgttggggaaccgtaggttactaccggtgttcccaccggtttactaccgtaacgtccccgtacgaacccgtagtaccccttaggttccccgtcccgtacccgtccgtaccccgttacttaccccgaactccggtacgtaacccg

SEQ ID NO: 140256 - DNA, 837 bp, Homo sapiens
  misc_feature: GYAE6OF01DEVZX.46.67.G01.1.454.CMB.1.raw
  modified_base (144)..(144): a, c, t, g, unknown or other
  misc_feature (144)..(144): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtnacatcgagctgacccagtcctccatcccgtcctgtcctgccgaaccggtggggacactaggtcgtaccaaccgtatccgtaccgttcgggacccggggtactaaacggtaccgggaacctagtttcggaaacctaacctttaaagtttttaaaagtggttaaacttaccgaaaactacggttaaaccgaaccccgggaacgggggtaaccccgtaccccgttaaaggcccttaaccgttaaacgttccttaagttcggaccttggacctaacgttccgtaaggtttcgacggtaaacgggtcgggtacccagtcggacggttcgaggtcggtacgtaggttaggtaacttcgggtagggtaacttacggttaacctttaccgacctttcccgacgtaacctagtacgaagttactacgacggtacgtaagtacgttaagttctttacgaacttaacttacgttacgtaataccgtaaagtaacgtttaaattaacccgttagtttaccggggttaaccgaaccggtaaacgggtaaccctaacgttaaaactaaacgttaaaacgttacggtaaccggttcggacgtacccgtagtaaccccgttaacgttacgtttaacctttcggttaaccccttaaggtccccctttacccggttaccccgattaaacccgttggttaccgtttaacccg

SEQ ID NO: 140257 - DNA, 949 bp, Homo sapiens
  misc_feature: GYAE6OF01A8ROF.46.67.G01.1.454.CMB.1.raw
tcagactagcagtacacgaccggtgctcgatttagagtatacatattgggtttgtcctcctgctggtggcagctcccagatgggtcctgtccctggtgcaactgcagggagtccgggcccacgacgtgggtcgaggcccttcgggacgaccccttgtcccctacaccgtgccgtctagtccttcgtaggtctccctacattccgaggttaggttcggttttcttcggtcgggggtccttcgggggtcccgactaccggtcccgtacccgggaagggggtaacggggtccttagggaaacttacgtaggttacgggaattcggtccgttactcgtaagtttacgggtcgggtaccgtttaccttaattaccgacggttcccgtactaccgtacgaaagggtcgttacgacgttacccaaccgtattacgtcccgttacggacggtaacccacgttacccaaggtaacctaacgtttccccggttttaaccgttttcccggaaaggtaccgttaggttacggtaacgttttcgggccgtacccggtaccccggtacttacgggtaccggaaacggtttcccggggtttattttaacgttaccggtggtaacggtaccgaggtacgggtacggttaccttaagttaggttaccgtttaggtttcggaaagttttcggttaagtacccgtaacggtacctaagggtaccgtacccgggggtacggtccccgtccggtacccgggtaaccggggtaccgtaacgggtttactacccggggttaccttaccccggtaccgtttaccccgtcccgttaaccggtacccccgtaaccggtaaaccgggtaccccgttacccggttacccggtttcccccgtaacccccggtttccccgaacccgttaaccccccggtacccttacccggaacccgtttaccgcccggttacccccgg

SEQ ID NO: 140258 - DNA, 755 bp, Homo sapiens
  misc_feature: GYAE6OF01AUGVW.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccggtgggagacagtcgtccacctatccgtacgttcggccgggacaaggttccggaaactagtttacgaacctaaccttaagttttaaaagttggtaatccaaacattaacggaaccacggggaccggccccgtaaagcttacctaattctatcggctgacacttcccgtagttttcgacgaaacggttcggggtccccagttcggtacggtttacgaggtggactagggttcgagtccgtagggtactagtacgtttaccacgtccttaccgaacctagttacctaaagttactaccgtacgtaaccgtaacggttaacgtaaagtttacgttttacggaaacctttaacgttttaacttacgttacggtaacctaaacgtaacggtttaaattaaccgtttaagtttaccggtttttaaccgggaaccggtaaacggtaaccgtaacggtaaaccttaaacgtaaaaccgtttaaacgaccttagggtacggtaccgttagacccgtaactacttcggttacgttccttacttaccgttacccttcccgaccttacgttcgttgtaacccg

SEQ ID NO: 140259 - DNA, 811 bp, Homo sapiens
  misc_feature: GYAE6OF01CIY6M.46.67.G01.1.454.CMB.1.raw
  modified_base (223)..(223): a, c, t, g, unknown or other
  misc_feature (223)..(223): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtcctggtgcaactgcgagggagtccgggccacgacgtgggtgaggtccttcggaacgtccctcgtccctacaccgtgcgtctgtctcgtggtcncctcatcgtaggttagttcggtttctcggtggggtacttggggccgctacggccgtaccggaagggggacgggtctagggtaactaagtagttacgggaagttcggtacctcgtacgtaaaggttacgggtacgggttaacgtttaccttaaacgttaaccgtacggttcccggttactaccttaacgggaaaggtcggtaccggtaaaccttaccgaaacccgttaagttaccttaccgtaccggtaacgggtaaaccctacggtaaccacggtaacctaagtttacccggtttaaccgtttttcccgaagggtaaacgtacgtttaggttacgtttaccggtacggttaccggaccccgtaccgtacggtacggtaacgggtaacgggttacttttaagtaccgtggtaacgacggtaaggtaccggtacgtttactaagtttacgttagtttacggttttggggaacctttaggttttaaccgtaaccgactaccggtagttacgggaccggggtacggcctaccggtaccgggtaggacggtaacggtactcgacgttccgaccttcgacttccgcctaaccgg

SEQ ID NO: 140260 - DNA, 791 bp, Homo sapiens
  misc_feature: GYAE6OF01CG7PA.46.67.G01.1.454.CMB.1.raw
  modified_base (206)..(206): a, c, t, g, unknown or other
  misc_feature (206)..(206): n is a, c, g, or t
  modified_base (234)..(234): a, c, t, g, unknown or other
  misc_feature (234)..(234): n is a, c, g, or t
tcagactagcagtacacgaccggtgctcgatttagagtatacatattggggtttggggagtctcggtcaggacacagcatggacatggagggtccccgctcagctccgtggggctcctgctactctggctcggaggtgccagatgtgacatcgagctcgaaccctgtcctccactccctccctgtctcgacgaaccgggtgggaanacagtctacaccatcacgtcggccgganaggtaccgtaatattacgaacctactttaaagttttaaagttgtaactaacaacgtagtaacgaacgggacgggacccgaccctagtacttaccctaaatcgtatgtactcgactactaccttagttcggaacgtaagggtccggacctagtacggtaggttagtcggaggacgtagggtatacggtaccgggttagggaaactcggttaacctttaccaaccgtttaccctaacctaaccctagttaaccgtaacgtttaaccgtacgttacggtaaccgggtaacgtttaaggttaaacgggttttaactttaccggttaaaacttttaacctttagggttaaccttacgttaaaactaaacgtaaacgtttaaacttaacgtttaaacgtttacgggtttaaacccgaacggtaaacggaacccgttaaactaaaacttaaaaccgtaaaaggtttaccgaagttacggtaccggtacgtaccgtaaccgtacacgtttaccggttcttacctttactaacctttaccggtaccccagtacctttgtcctaacg

SEQ ID NO: 140261 - DNA, 898 bp, Homo sapiens
  misc_feature: GYAE6OF01AY3VD.46.67.G01.1.454.CMB.1.raw
tcagactagcagtacacgaccggtgctcgatttagagtatacatattgggtttgggggacctcctgtgacaagaacatgaagcacctgtggtttgtcctcctgctggtggcagcctcccagagtgggtcctcgtccctggtcgcaactgcgagggcgtcgggcccacgacgtgggtcgacggtccgttacggacgtacccctcgtcccctcaccctggccgtcttcgttccgtcggtggtccgccctacctactacgtaggttacggtttcggttttccgttcgggtggggtaccgttcggggtccgcgacgtccgaccgggagggggtacgggctaacggaacttagaggttaggtacgtcgttcctacgtacgtaaggttacggtacggggtacctttcctaaaacgttcggtacgttcccgtactttaccgaagtagggtacccgtacggtaccttaccgtaactagttaccgttcctacggtaacgtaccgtacccggtacgtaacgtaaccgttacgttacccgttttaccggtttacccgaaggtaacgtttacggttacgggttaacgttttcggaccggtaccccgggtacccgtccgggtttacgaaacggttaacccggggtacgggttttacttttacgacggttgaaccgggcgtaacgggtgtaacgtcttttaagtttggttcggttttttaggtacggggtttaaactttccggtttaacccgtaccggacccgttacggtcgggtaccgggttcccggggacggtcccggttaccccccggggaacggttggggaacctaaacggtttaacctccgggggttaccttaaccccgtaaccggtttccccttaccccgggtaacccaccccggtaaccccgggg

SEQ ID NO: 140262 - DNA, 835 bp, Homo sapiens
  misc_feature: GYAE6OF01CS4LL.46.67.G01.1.454.CMB.1.raw
  modified_base (215)..(215): a, c, t, g, unknown or other
  misc_feature (215)..(215): n is a, c, g, or t
  modified_base (359)..(359): a, c, t, g, unknown or other
  misc_feature (359)..(359): n is a, c, g, or t
  modified_base (489)..(489): a, c, t, g, unknown or other
  misc_feature (489)..(489): n is a, c, g, or t
tcagactagcagtacacgaccggtgctcgatttagagtatacatattgggtttggggagtctcggtcaggacacagcatggacatgacgggtcccgctcagctccgtggggtctcctgctactctggctcgagtcgccagtatggtgactagtcgacgctacgaaccctgtcctcctactccctccgtcgttcgtacgaccgaaaccggtggganacgtacgtataccccactactccgtaccgttcgggacccgggactaacggtacggtaaactacgttacgaaccttaaccttttaattaaagttgtaactacgaaactacgtaacggaccgtaacgggaacccgtacccgtaacnccttaactagtactcgtcgtcgtacgactacgtccgttagttaagggaaccgtaggtcccggtcgtgtaccgggtagtaccggaggtccgaagttgggtacgttcggtgtacggtatacgtcgtttaccncgtttacaaccttacgtacctaagtaccttaacgtcgtaacggtaccgttaacgggtaacgtttaacggtttacgttaacgttaaacgtttaaccgtttaagttaaccgtttaaccgtaacgttaaaaccttaacggttaaacgtttaccgtttaacggttttaaccgggtacccggtaaacgggtaacccgaaacccttaaacggttaaacccttaaaaacgggtttaaaccgttaaccgttacggttaacgggtacctaccggttaccggaaccttaaaggttcccgttctttacgtaccctttactcccgtcccgtttaacccctttaccgttactacttacg

SEQ ID NO: 140263 - DNA, 863 bp, Homo sapiens
  misc_feature: GYAE6OF01ETANH.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtccgggcccacgacgtgggtgaggccttcggacgacccttgtcccctcacctgcgcgtgtctcgtggtcgcctccatcgaagttagttggttttcttcggtggggcgttcggggtccgcacgtcctccggaaggggaacggggccttaggaacttacgagttagggaacgtcgttcttctactagttaggtaggtacggttacctagttaactacgttccgtcttcctacaaaggtacgtcgtacgtacctaacctaagtactcgttaccgtaggaccgtaaccgtccgtaacgactaaacttcgttaccgtttttacccgagtaacgtagttacgtacgtttcgtacggtaccggacccggtacccgtcggtaccggtaaccgggttaccgggtttaacgttttaacttaccgttagggtacgtacggggtaacgtaacgggtacgttacgtttaaagttttaggttaacggttttaaggtttttagggttacggttttaacggttttaacgtttacccggaacccttaacccgttaaggtccggttaccgggtacccggggttccgtaaccccgggtacccgggtacggggtaccggaacgggttaacgtaccgttcggttacccgtaccgttcccttaccggttacccgtacccgttacccgaaccggtaaccggtccctacggtttcccggtaccccttcccccgtacggtaccccaccccttaccgtaaccgaacgcccgtaacccgg

SEQ ID NO: 140264 - DNA, 892 bp, Homo sapiens
  misc_feature: GYAE6OF01D9X6Z.46.67.G01.1.454.CMB.1.raw
  modified_base (175)..(175): a, c, t, g, unknown or other
  misc_feature (175)..(175): n is a, c, g, or t
  modified_base (210)..(210): a, c, t, g, unknown or other
  misc_feature (210)..(210): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggcccttcgggagacccctgtccctcacctgcgctgtctctggtcncctcatcagtgtgtttctcgtgggctgggtccgcncgcctccgaggggacgggctaggaatacagttggagtcgtactctcgagtaggtggtacggttcctaattacgacgttccgtctctacgtagtacgtaccgacgttaccactatacgtccttccgtacgggaaccaccgttaccagtactaacgttaccgtttaccgttttacccgaggtaatacgttggtacgtttcgtacggtaccggacccgtcccggtacggtaccggtaaccgggttaccggggtttaccgtttttaacggttaccggttacgggttcgggtaacgggaacggtaacgggttaccgggtttaactttaaaggttttggtttaagggttttaacggtttttagggggttaacggtttttaacgggttttaaccgttttacccgaaacccgttaaccccggtttagggtacccgggttaccggggtaacccgggggtttcccgacccccggggttacccgggttacggggtaacccggttaaaggggtaacccgtttaccggtaccgggttccccgttacccggttcccgttaaccgtcccggttaccccaaacccggtacccggacccgggttacccctaccgggttttcccccgttacccccgttacccccgacggttcccccccgtaacccgtcccccttaacccggaggtccccgtaaccccggg

SEQ ID NO: 140265 - DNA, 649 bp, Homo sapiens
  misc_feature: GYAE6OF01CE78Y.46.67.G01.1.454.CMB.1.raw
  modified_base (208)..(208): a, c, t, g, unknown or other
  misc_feature (208)..(208): n is a, c, g, or t
  modified_base (234)..(234): a, c, t, g, unknown or other
  misc_feature (234)..(234): n is a, c, g, or t
  modified_base (379)..(379): a, c, t, g, unknown or other
  misc_feature (379)..(379): n is a, c, g, or t
tcagactagcagtacacgaccggtgctcgatttagagtatacatattgggtttggggagtctcggtcaggacacagcatggacatgacgggtccccgctcagctccgtggggctcctgctactctggctcggaggtgccagatcgtgacagtcgagtctacgacccagtcctccgactcctcctgtctggacgaccggtgggacacgngtctaccaacatcagttcggccgganaaggtacgaaactattacgaactaacttaagttttaaacgtgtatacaacatacgaccgagggaccgtacctaacgcctactaactctatcgactgctactcgtagttgacgtaacggtcggtaccagtcgagttcgagtcggtntacggtgtacgtcggtaggacgtagtacttttacaccgttacctacgaacctagtacgtaagttactacgtacgacgtaagttaacgaagtttacttaactacgtaactttacttaacgtctaaccaacgaacttaactacgtacgttacggttacggaacgaacgaaccgtacgaaacttaaacgaaacgttaacgacgtaggcgtacgtacgtacaccgttatacgtacttaccttctacccgttctacccgcttaactcgttagtac

SEQ ID NO: 140266 - DNA, 786 bp, Homo sapiens
  misc_feature: GYAE6OF01BYO34.46.67.G01.1.454.CMB.1.raw
  modified_base (132)..(132): a, c, t, g, unknown or other
  misc_feature (132)..(132): n is a, c, g, or t
  modified_base (160)..(160): a, c, t, g, unknown or other
  misc_feature (160)..(160): n is a, c, g, or t
tcagactagcagtacacgaccggtgctcgatttagagtatacatattgggtttggggagtctcggtcaggacacagcatggacatgaggtccccgctcagctccgtggggctcctgctactctggctcgagngccagatgtgacatcgagctcgaacccngtcctcctatccctcccgtgtcgtagcctaaccgggtgggacgactagttcggaccaacctatcctacggttcggacccgggaagaaacggtaccggaaactagtttacggaacctaacctttaagttttaaagtttcggtaacttaacaaacgtaactaacgaaccggaccgggaaccggtaccctaagtacctacctaattacgtatcggcttcgactaccgtaccgtaggtttaccgaaggtaacggttccgggttacccgagtttaccggaggttaccggtaggtacggacggtaaggtcgttaaggtacggtaacggggtaactacgggtttacttaaccgtaccctactaaccgaacctagttacgtaacgtacgttcagtaaccgttaacggtagttaaagttacgttaacgtaaccttaacgtttaaccttaagttacgtaaactaaacgttaattaaacggtttaccgttaagtttacgggtttaacgaaaccgggtaacgggttaactaacggaaacttaaactaaacgtaacgtaaccgttacgtacgacgttagacctacgttaacgcttacgttccttaccgtaactccccgtacacttcgtagtgttaaccg

SEQ ID NO: 140267 - DNA, 788 bp, Homo sapiens
  misc_feature: GYAE6OF01ETQJ7.46.67.G01.1.454.CMB.1.raw
  modified_base (149)..(149): a, c, t, g, unknown or other
  misc_feature (149)..(149): n is a, c, g, or t
  modified_base (216)..(216): a, c, t, g, unknown or other
  misc_feature (216)..(216): n is a, c, g, or t
  modified_base (258)..(258): a, c, t, g, unknown or other
  misc_feature (258)..(258): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggngtcgggcccagactggtgaggccttacggacgaccctgtccctcacctgccgctcgtctcgtggtcnccctcatcagttagttcgtttctcgtggggactggggtccgnacgcctcccggaaggggacgggtcctaggaactacgtagttaggtaagtcgtaccttcgtacaggttaggtcgggtacggttaccttaacgttacgacggtttcccgttctaccgtacgaaacgacgttcgtaacgttccaaccgtatacgttcctacgtacgggaacctaccgtacccagtacctaacgttccgttaaccgttttccgaagaacgtagttacgggttacgtttccgtaggtacccggacccgtccggtacgtacggaccggtaccgggttacttttaacgtaccgtgtacggcgggtaagtacgaccggttacttagttaacggtttgttttaaggttttacgggtacgtttacggtttaccgttacccgtaacccgtacggttacgaaccgggttccggggaccggggttcccctaacccggggtccccgggttaggggggacccaaagggttacccttacgggtacccgtacccgtaccggtttaaccccttccgtaacccgtccccgtaaccccgg

SEQ ID NO: 140268 - DNA, 763 bp, Homo sapiens
  misc_feature: GYAE6OF01E117F.46.67.G01.1.454.CMB.1.raw
  modified_base (198)..(198): a, c, t, g, unknown or other
  misc_feature (198)..(198): n is a, c, g, or t
tcagactagcagtacacgaccggtgctcgatttagagtatacatattgggtttgggggtaggtctcggtcgaggacacagcatggacatgagggtcccgctcagctcctggggctcctgctactctggctccgaggtgccagatgtgacatcgagctgacccagtctccatcctccctgtctgcaaccgtgggagacngtgtcaccatcacgttgccgggctaaggtcggaacattgacaaccttatttaaattggtatcaacatagaacctaggggaccgaccctaaggcttaccctaattctaatgtcgtcgtactaactccgtagtttgacgtaaaggttcgggtccctatacggtaaggtttccaaggtcggacgtacggttaggacttaccggtggggaacctagtacgttttacgaaaccgtcctaaccgtaacctaacttaccgtaaagttaacgtccgttacgtaaccgtaaacgggttaggttaaaccggtttaaatttttacggaacccgtttaaaccgttttaacgtttaacgttacggttaaacctaaaccgtaaagttaaacgttaacttaacgtttacgggttttaccggaaccggttaaacgggactaaaccgtaaactaaacttaaaacgttaaacgtaacgtcggttacggtacgttacaacccgtaaccgtaattcccgttgtttaacccttacgtaaccgtttaccccttacccgaaccccgtttactttacgtagggttaacc

SEQ ID NO: 140269 - DNA, 801 bp, Homo sapiens
  misc_feature: GYAE6OF01BEUW8.46.67.G01.1.454.CMB.1.raw
  modified_base (490)..(490): a, c, t, g, unknown or other
  misc_feature (490)..(490): n is a, c, g, or t
  modified_base (499)..(499): a, c, t, g, unknown or other
  misc_feature (499)..(499): n is a, c, g, or t
tcagactagcagtacacgaccggtgctcgatttagagtatacatattgggtttggggagtctcggtcaggacacagcatggacatggagggtccccgctcagctccgtggggctccgtgctactctggcctccggaggtgccagatgtgaccatcgagctcgacccagtcctccagtccctcctgtcctacgaccgtaaccggtgggaacacgtagttcggtaccaaccgattaccgacgtttcgggacccgggggtactaaaacgggtaccggaaacttacggttaccgtaaacccttaaccgttttaagtttttaaaacgttggtttaaccaccttaaacgaacggttaacggaaccggaaccgggggtaacccgtcccttaaaacggtccttaaccttaaacttcgtagtccgtcctacgtcctaactccggtttaagttcgaacggtaaacggttcgggaccctaacgggttcggtaacgttacgnggtaccggngtaggtacggtacgttacggtcggaacttacgttacttacgaccgttccacctaccgtaagtcgtaagtaacgtcgtacgtaaccgttaacgtagttaacgttagtttaccgaacttaacgtttagttaacgtccggttaaacaaccgttaagtaacgtttacggtaacgtttcggttaacggaacgtaacgtaccccgtaagtaaccttaaacgtaaacgtaactacggtagtctacggtacaccgtctacttactacgttccctaacgtcgtttaccccacgtcgtaacttggtacctac

SEQ ID NO: 140270 - DNA, 881 bp, Homo sapiens
  misc_feature: GYAE6OF01C8R4I.46.67.G01.1.454.CMB.1.raw
  modified_base (83)..(83): a, c, t, g, unknown or other
  misc_feature (83)..(83): n is a, c, g, or t
  modified_base (140)..(140): a, c, t, g, unknown or other
  misc_feature (140)..(140): n is a, c, g, or t
  modified_base (152)..(152): a, c, t, g, unknown or other
  misc_feature (152)..(152): n is a, c, g, or t
  modified_base (229)..(229): a, c, t, g, unknown or other
  misc_feature (229)..(229): n is a, c, g, or t
  modified_base (510)..(510): a, c, t, g, unknown or other
  misc_feature (510)..(510): n is a, c, g, or t
  modified_base (527)..(527): a, c, t, g, unknown or other
  misc_feature (527)..(527): n is a, c, g, or t
  modified_base (537)..(537): a, c, t, g, unknown or other
  misc_feature (537)..(537): n is a, c, g, or t
  modified_base (870)..(870): a, c, t, g, unknown or other
  misc_feature (870)..(870): n is a, c, g, or t
tcagactagcagtacacgaccggtgctcgatttagagtatacatattgggtttggggagtctcggtcaggacacagcatgganatggacgggtccccgctcagcctccgtggggctcctgctactcgtgctcggaggtcncagatgtcgacngtcgacgtccgtaccgaccctacgtccctacctacttccccttcccgtgtaccgtacggaccgtaaccggtaggganaccgtagttcacccactactacgtacgttaccggggaccgggtaacaacgggtacgtaaactacgtttaccgtaacccgttaaacttttaaagttttaacgttacggtaaacctaaacaaacgtaaccggtaaccgggaacccggggaaaccgggtacccccgtaaccgtaagtaccccttaaccttaacgtcgttaacgtcgtacgtaccctacgtacctttacggttaggaacggtaaccggttaacggggccggtaacctagtacggtacgtcggtancggggattacggtaacncggttaacgnggttaacttaacgtttctaccttacgaactcgtaactagttaaccgtaagttacgtaccgtaagtaccgtaaggttagttaacgttttacgacttaactttaaacgttactttaaccgtaacgtaattacttaaacgtacttaacgggttttataccgggttaacggaaccggtaaccgtaaacgttaacccgtaaaccgttaaaacgttaaatacccgggtttaagtccgggtaaaccggtccgttaactaaccccgtttatcccgttacgttttccttaccgtaaccgttttaccccctacccgggttaacttacccgtaacggtttaacnccgttttaagg

SEQ ID NO: 140271 - DNA, 741 bp, Homo sapiens
  misc_feature: GYAE6OF01EWUG5.46.67.G01.1.454.CMB.1.raw
  modified_base (209)..(209): a, c, t, g, unknown or other
  misc_feature (209)..(209): n is a, c, g, or t
  modified_base (584)..(584): a, c, t, g, unknown or other
  misc_feature (584)..(584): n is a, c, g, or t
  modified_base (724)..(724): a, c, t, g, unknown or other
  misc_feature (724)..(724): n is a, c, g, or t
tcagactagcagtacacgaccggtgctcgatttagagtatacatattggggtttggggagtctcggtcaggacacagcatggacatggacgggtccccgctcagcctccgtggggcctcctgctactctggcctccggaggtcgccagatgtagacatcgagctacgacccagtcctccatccctccctgtctgaccgaccggtggganactaggtcgtaccactagtcctacgttcggaccgggtactaacggtaccggtaactattacggaaccttaactttaagtttaaagttcggtactaccaagtaacgtaccgacggacgggaccctaccctaagtcctacgtatctagtcgctagtactaccgtacggttagtacgaacggtaacgggtccggtacctaggttaccggacggtttacgagggtcggtacgtagggtacgtacgttaccggaggtaatccgtttaacgtttccgaccctccttaacgaccgttaacttaccggtaagttactaccgtagtaaccgtaacggtacgtttagttaacgtttacgtaacgtttaacttacgttaccgtaanaaccttaacgttaacgttaaacttacggttacggtttccgtaacggaccgtaaggtacctaacgtaactaaactaaggtacgtacgtgtactacgacgaccctattacttacgtccttacgtacctccggtaccccttanaccgtcttagtcgtacg

SEQ ID NO: 140272 - DNA, 665 bp, Homo sapiens
  misc_feature: GYAE6OF01DSHMO.46.67.G01.1.454.CMB.1.raw
  modified_base (218)..(218): a, c, t, g, unknown or other
  misc_feature (218)..(218): n is a, c, g, or t
  modified_base (255)..(256): a, c, t, g, unknown or other
  misc_feature (255)..(256): n is a, c, g, or t
  modified_base (409)..(409): a, c, t, g, unknown or other
  misc_feature (409)..(409): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggccacgactggtgaggtcccttcggagaccctgtcccctcacctgcgtctcgtctcgtggtcncctccatcagtgtgtttctcgtgggtcgtgggtccgnngccgtccgagggtaacggggctaggaatacgtagttggaagtgtcgtctctatagggttaggtacggttcctaagttaccgtacgtcccgtacttctacctaagtacgtacgtacgtacctaacctatactctcgtcggaactaccgtccaanctaaatctacgttttcccagtaacgtagtacgtgttcgtacgtaccggaccgtccgtacgtagaccggtacggttcgtttaacttcggtgtcgtagacggtagacgtacgttattagttagttagtttggtaggttacgttacttccgacgtaccgtagtacgtccgggtacgggtacgtcccggtacccggtcggggacgtacgggtaacgtcgtaccggtcctacccggtcttcccgtacgtccgtaaccccgg

SEQ ID NO: 140273 - DNA, 856 bp, Homo sapiens
  misc_feature: GYAE6OF01CZWAH.46.67.G01.1.454.CMB.1.raw
  modified_base (212)..(212): a, c, t, g, unknown or other
  misc_feature (212)..(212): n is a, c, g, or t
  modified_base (397)..(397): a, c, t, g, unknown or other
  misc_feature (397)..(397): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggccttcggagaccctgtccctcacctgcgctgtctctggtcgcctccatcagtagttggtttctcgtggggctgggtccgnacgccgtccgaagggggaagggctagggaatacgtagttaggaagttcgtcctctactagttaggtggtacggttcctaagttacgtacgtcccgttctactacgaaggacggtcgagtccacctagttactctcgtacggaactaccgtcacgtactaacttccgttacttttcccgagaagtnttcggtagtttcgtacggtccgaccggtccgtacgtggaacccgtacgggtttacttttacttacgttggacggtacggaaggtacggaccggttactttagttagttacggttttaggtttttacgggtaaggttttacggttttaacgttacccgtaaaccccgttaccgggttaaggtacccggtaacccggggggtcccggggttaccctaccccgggggtaccccgggttagggggaacccggtaacggggttaaaccgttaccggtttaccgggttaccccgttaccggttaccccgtttaccggttaaccccggtaccccgttacccggaaacccgggtaaaccgggtcccccgttaacccggtttccccgggtttcccccgtttaacccccggccggttacccccttaccccggttaccccgtaacggaaacccggtcccggtaaaccccg

SEQ ID NO: 140274 - DNA, 697 bp, Homo sapiens
  misc_feature: GYAE6OF01DAUO1.46.67.G01.1.454.CMB.1.raw
  modified_base (194)..(194): a, c, t, g, unknown or other
  misc_feature (194)..(194): n is a, c, g, or t
tcagactagcagtacacgaccggtgctcgatttagagtatacatattgggtttggggagtctcggtcaggacacagcatggacatggagggtccccgctcagctcctggggctcctgctactctggctcgaggtgccagatgtgacatcgagctgaccctagtctccatccctcctgtctgcaaccggtggganacagtgtaccaccatcacttcggcccggggactaaggtccggaactattacggaacctaaccttaatttttaaagttgggttaacttaccaaacgtaagtaacggaacccggaacggggaacccggtaccccttaagccttacctaatcttaagtcggctcgacctactacccgtaggtttcgacgtaaaggttccggggtaccctagtccggacggtttcgaggtacggcgtaggtggtaactcggtagggactagttacttcactactccaactagtaccgtagtaacttcctagtaaccgtaagtagtaattacgtttacgaacttaacgtttaattactacggtacaactaagttaaacttactaagtttcgtttaaccggacgaaggtacctaacgtaattaaactaaagttacgacgttcggtacgtacgtacgtaccgaccttattacctcggttaccttacacgtttccctacccgtaccttcgtctaggttacc

SEQ ID NO: 140275 - DNA, 727 bp, Homo sapiens
  misc_feature: GYAE6OF01AOUEW.46.67.G01.1.454.CMB.1.raw
  modified_base (163)..(163): a, c, t, g, unknown or other
  misc_feature (163)..(163): n is a, c, g, or t
  modified_base (200)..(200): a, c, t, g, unknown or other
  misc_feature (200)..(200): n is a, c, g, or t
  modified_base (351)..(351): a, c, t, g, unknown or other
  misc_feature (351)..(351): n is a, c, g, or t
tcagactagcagtacacgaccggtgctcgatttagagtatacatattgggtttggggagtctcggtcaggacacagcatggacatgagggtccccgctcagctcctggggctcctgctactctggcctccgaggtcgccagatgtgacatcgagctcgacccngtcctccactccctccctgtctgaccaccggtggganacagtcgaccaccacgtctacgttcggccgggacaacggtacggaactagttacgaactaaccgtttaagtttaagttcggtaactacaacgtacgtacggaacccgtacggggacccgtacccctaagtcctacctaatcgtagtcgtcncgactacttcgttagttacgaacggtaacgggttccgggtacctagtcgtacggttacgtaggtcggacgtaggtcggtagtaccggttagggactaacggttacttccgacgtaccgtaccgtactacttacgacgttaactccgtaacgtacgtaaccgttagtaacgttttacttacgtaacttaacgttacgttacgtacgaaccgtaagtaactaacttacgttacggtttacgttaccgacggtaacggacctaaccggttaactaaacgtaaacgtacgtacgtaggttaccgacgtacgaccgtactaccgttacgtcgtttacctaccctacgtttcccctacccgtataccgttcgtaacgttacg

SEQ ID NO: 140276 - DNA, 725 bp, Homo sapiens
  misc_feature: GYAE6OF01EQEP1.46.67.G01.1.454.CMB.1.raw
  modified_base (229)..(229): a, c, t, g, unknown or other
  misc_feature (229)..(229): n is a, c, g, or t
tcagactagcagtacacgaccggtgctcgatttagagtatacatattggggtttgggggagtcctcgggtcaggacacagcatggacatgacgggtccccgctcagctccgtgggggctcctgctactctggctccgaggtcgccagatgtgacagtcgagctcgacccagtcctaccatccctccctggtctgaccgaacggtgggacacgaggtcgtaccaaccgtntaccgacttcgggccgggataacggtacggacttagtcgaacctacctttaattttaaagttcggtaactaactaacagtaaccgaaccggacggggacccgacccgtaagtaccttaacctaactactacgttagcctagtccacgttacggtcggttaacaagggtaaccgtccggtactaggtacggcaagggtcgacgtacggtaggactacggtacggtaagacgtatacgtacttcaccgtaaccacttaacgtagtaccttaaggtcaaaccggttgtaacggaaacgtttacttaaaggttactaactttaaacgtttacgttactaactaacaacggttaaacttaacaacggttttacggtacctaacggggtaaccgaaccggtaaccgtaagtaaaacttaaaccgaaattaaccggtagtcgtaggctacgaactctaagtcgttactcgtacttcccaccgttacacctacgtgtaattacg

SEQ ID NO: 140277 - DNA, 968 bp, Homo sapiens
  misc_feature: GYAE6OF01B3MI0.46.67.G01.1.454.CMB.1.raw
  modified_base (232)..(232): a, c, t, g, unknown or other
  misc_feature (232)..(232): n is a, c, g, or t
tcagactagcagtacacgaccggtgctcgatttagagtatacatattgggtttgggggacctcctgtgcaagaacatgaagcacctgtggtttgtcctcctgctggtggcagcctcccagagtcgggtcctgtcccgtggtgacaactgcgaggagtacgggcccaagcgtggtgaggtcccttcgggacgcccctcgtcccctacaccgtggcgcttcgtctcgtggtccncctaccatcgtaaggtcggtttcggtttcgttcggtggggtccgtcggggtccggactcggcccgtaccgggaagggggtacgggtaccgtggtaactaacgtaggttacgggaagttcggttcctaccgtagtaaggttacgggttagggttaaccggttttccttaacgtttaaccggtacgtttcccggttcttaccgttaacgaaaacggttcggttaccggacttaacccacgttaacttaacttcgttaccggaccggtaacccgtaaccggttaccgaacgttaacccttaaacggtttaccctttaccggttttaccccgtaaggtaaaaggtgttacgggtttaacgggtttccgttacgggttaccccgggtaacccgttcccgggtaccggttaacgtacccggggttaacccggggtttaccttttagttacccgggtgggtacggtaaccgggtaggtaccggtaacgggttatttaacgggtttacggttaagggttttacgggttttaaagggttcggggttttaacgttttacccgggttaccgtaacccggttaaccggtacggtaccgggttacccggggtacccggggtaccccggttacccgggtacccggggtaaccggggaaccgggtaacgggtaccggtttacccggtacgggtttaccccttaccccggtttaccgttcccccggttaaccggtcccccgttaaacccggg

SEQ ID NO: 140278 - DNA, 746 bp, Homo sapiens
  misc_feature: GYAE6OF01CPGC5.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgaccaaccggtgggagacagtcgtccaccatcacgttggcccgggacaaggtcggaactattcgactaccttattttaaagtggtatacaacatacgaccgagggaccgaccctaagctacctatctatcgctcgacactccgtagtttacgacgtaacggtcgggtacccagttcggtacggtttacgaggttcggacgtagggtggtacgttccggtaggggaacttacggtacttttaccacctttacccgtaacctaacccgtaactcgttaaacgtttaacgttccgtacggtaccgtaaaccggttagtaaacgttttacgttttacgaacctttaaacgttttacgttaacgtacgtaaaccaaacgtaacgttaacttaacgtaagttttcggtttaccggaaccgtaaagggtaccctaaacgtaaccgttaaactaaaacgttaaccggtaacgttacggttcgtacccgttaacgtacccgttaacccgttagttaccgtttaacgttcccttaaccgttcccttacccgttaccccattaccttacgtcgttaacc

SEQ ID NO: 140279 - DNA, 1028 bp, Homo sapiens
  misc_feature: GYAE6OF01DEDSO.46.67.G01.1.454.CMB.1.raw
tcagactagcagtacacgaccggtgctcgatttagagtatacatattgggtttggggagtctcggtcaggacacagcatggacatggacgggtccccgctcagcctccgtggggcctcctgctactcgtggctccggaggtcgccagatgtacgacagtcgagcctcgaccctagtcctcctactccctccgtgtcgtagaccgtaaccggtgggaacgtacgtacggttcgtacctaccattccgtacggttacgggcccgggaactaaacggttaccggaaacttacgtttaaccggaaccttaaaccttttaagttttaaacggttacggttaaactacgtaaaacctaacgggtaaccggtaacccggaaccggggtaacccggttaccccttaaacggtacccctttaaccgttaaacgttaccgtttacggtacggtcccgtaggttacccttacgttaccggttagggttttaccggtaaacgggttaacggggtaccgggtttaccctaacgggtcgggttacggttaaccgtagggtaccggtaccggtaagggtttaggtaaccggttaccggtagggggttaaaccttaaggttacccttttaacccgaccgtttaccgaacccgttaacccgtaaggtttaacccgtaagtttaacggttaccctaaccgggttaaaccgttaaccggttaaggtttaaacgttttagtttaaacccgttacgttaaaacccgtttttagttaacccgtttaacggaacgttaaaaccgttaaacgtttaaccggttttaaacgttaacgggtttaccggggttttaaccgggaaaccgtaaccgggtaaccgttaaaacccgtaacgggttaaaaactttaaaacccggttaacaaccgggtttcggtaaccgtacccgttaaggaaccctaaaccggtttcgttacccgtttactttaaccggtacccttaacccgggttccctaacccggttaccttaacggttcccgtaaaggttttacccg

SEQ ID NO: 140280 - DNA, 618 bp, Homo sapiens
  misc_feature: GYAE6OF01BXTUH.46.67.G01.1.454.CMB.1.raw
  modified_base (402)..(402): a, c, t, g, unknown or other
  misc_feature (402)..(402): n is a, c, g, or t
  modified_base (457)..(457): a, c, t, g, unknown or other
  misc_feature (457)..(457): n is a, c, g, or t
  modified_base (488)..(488): a, c, t, g, unknown or other
  misc_feature (488)..(488): n is a, c, g, or t
  modified_base (564)..(564): a, c, t, g, unknown or other
  misc_feature (564)..(564): n is a, c, g, or t
tcagactagcagtacacgaccggtgctcgatttagagtatacatattgggtttggggagtctcggtcaggacacagcatggacatgagggtccccgctcagcctccgtggggctcctgctactctggctccggaggtgaccagatgtgacagtcgagctcgaaccctgtctcccactcccttcccgtgtcctcgaccaaccgggtgggagacgtagtcgtccaacctatccgtacgtcggacgggtactaaacggtcgaaactcgttagaacctaacgttaatttaagttcggtatacaactaaggtaccgaaccgacgggaccgtaccctaagcctactagtctagcgctacgtcacgtcgtagttacgaggtaacgtcggcctagcgtagtacgagtcgnaggtgtaactgtcggatagttctcgacgttcacgactatacgtacgtactcgtanacgtaactagtagttagtcctaataccgttntacgtagtactaagtataacttgtacttagtcgtacgaacgtataaccgtaataacgtaaagtactacgtggtacncgtacacgtacttacgtctattcgactacgttccctacccattcgtgtctacgg

SEQ ID NO: 140281 - DNA, 922 bp, Homo sapiens
  misc_feature: GYAE6OF01D2XLG.46.67.G01.1.454.CMB.1.raw
  modified_base (250)..(250): a, c, t, g, unknown or other
  misc_feature (250)..(250): n is a, c, g, or t
tcagactagcagtacacgaccggtgctcgatttagagtatacatattgggtttggggagtctcggtcaggacacagcatggacatgagggtccccgctcagctccgtggggctcctgctactctggctccggaggtgccagatgtgacagtcgagctcgaccctagtcctccactccctcccgtgtacctgaccgaaccggtgggaacacgacggttcgtaccaccatacctacgttcggacccgggtanaaacggttaccggaaactacttacggaaccttaaaccgtttaaattttaaacggttggttaactaaccgtaaaaccgtaagttaaaccggaacccggtaaaccggggggtaaccccggtaaccccgttaaacggtacccctttaacccgttaaacttaccgtttaaccgtgtaccgttacggtaccttaaccgttacccgttaagggttttaacgaaccggttaaacggggttccgggtacccgtaacggttccggtaacgggttactaagggttccgggacgttaaccgggtaggtaacgttacgggtacgggtaaccgttaagttaacgtttacccgtacctttacctaacccgtaacccttaagtaccttaacggttaaccttacgtacgtaaccgttaaacgtgttaaaacggttcttttacgtaacttaaaccgtttagtttaaccgttacgtaaccgtaaagtaacgtttaaacgttacgtttaacggtttaccggtttaacgggaacccgttaacgggtaacccgttaaacgttaaccttaaacgtaaaacgtacgttaacgtcggtacgtacgtaccggtaccctaacgttacgttacgttcgttacccgttaccgtacccgttacccgttaccccgtaaccgtcgttaacccgtagttacccg

SEQ ID NO: 140282 - DNA, 780 bp, Homo sapiens
  misc_feature: GYAE6OF01E00CV.46.67.G01.1.454.CMB.1.raw
  modified_base (735)..(735): a, c, t, g, unknown or other
  misc_feature (735)..(735): n is a, c, g, or t
  modified_base (770)..(770): a, c, t, g, unknown or other
  misc_feature (770)..(770): n is a, c, g, or t
tcagactagcagtacacgaccggtgctcgatttagagtatacatattgggtttggggagtctcggtcaggacacagcatggacatggacgggtccccgctcagcctccgtggggctcctgctactctggctccgaggtcgccagatgtgacatcgagctcgacccagtcctccactccctccctgtctgccgtaaccggtggagactacggtcgtaccaccactccacgttcggccgggactaaggtaccggaactagttacgaaccttacctttaagtttaaattcggtatacaaactagtacggaccgaaggggtaccgtaccctaaggtccttaaccctaatcttacgtgtaccgtagtaccaacgttacccgttaaggttttacgaaccggttaaaacggggtttcccgggaacccttaggtaccggttaacgggttcgtaaggtccggtacgtaggttacgggtacttacgggtacgggtaacctaaggttaaccttttcgaacccttagtaacccctacggttaactactaacgttaatccgttaaccgacgttaacggtagttaaagttcgttttaccgaagtttaaaacctttgttaacctaaggtactaaagtaacgttaaacttattaccgggtttgttaccgggaaaccgaacgggtacaaccgttaaactaaactaaaacgtacggtcgtaggtacgtcctacgtactaccgtattacccgtnttacctacggttactcccgttaacccaattacctntaacggtaac

SEQ ID NO: 140283 - DNA, 714 bp, Homo sapiens
  misc_feature: GYAE6OF01AHZK5.46.67.G01.1.454.CMB.1.raw
  modified_base (213)..(213): a, c, t, g, unknown or other
  misc_feature (213)..(213): n is a, c, g, or t
  modified_base (687)..(687): a, c, t, g, unknown or other
  misc_feature (687)..(687): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagacccctgtccctcacctgccgctgtctctggtcgcctcatcagtagtgtttctcgtgggtcgtgggtccggnacgcctaccggaggggaggggctagaactacgagttggaagtcgtctctactataggtggtacggtttaccttattacgacggttccgtactctacaacggagtacggacgtactacctatactctctacggaccaccgtacacgtactaacttcgttaacgttttccgtagaagtatacgtagttacgtggccggacccgccggtacgtacggtaacggtaccgggttcttttaagtacgttggtacggacggtacggtacggtacgttattaacgttagttagtttaggtttagggtacggtttagtttcgttacgaaccgtaccgtaggtcgggtacccgggtacggggtccttacccgggtacccgggtacggggccgtaaaggggtaacttccggtacggtacctaccgttcctaccgtcgtacccgtaccgacgtaccggccctcgtcccggttccccttcccggacncccttccctaccgacacgtcgtacccg

SEQ ID NO: 140284 - DNA, 773 bp, Homo sapiens
  misc_feature: GYAE6OF01DZ47F.46.67.G01.1.454.CMB.1.raw
  modified_base (182)..(182): a, c, t, g, unknown or other
  misc_feature (182)..(182): n is a, c, g, or t
  modified_base (280)..(280): a, c, t, g, unknown or other
  misc_feature (280)..(280): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgacaactgcaggagtcgggcccacgactggtgaggccttcggaanaccctgtcccctcaccgtgcgtctcgtctccgtggtcgccctaccgatcgacggttagttaggtttaccttcggtggggtacgttcgggggtccgganacggtccgtacccggaagggggtaacggggtcctagggtaaacttacgtagtttaagggaagttcgttcctacgtacagttacggtaggtacggttaccttaagtttaccgagttcccgtcttaccgtagaaacggtacggttacggaattaccaactaacgtaacttccgtagtacggaacctcggtaccaagactagttacgtaccgttttaccggaagtaaagtattagggtaacgttacgtacggtaccggaacccgtcggaccgtacggtaacggtaaccgggttagtttactacggtagtacggacgaagacggtacgtacttacttagtaggtttacttttagggagtttacgtttaacgttacgacgtaaccgtaggtacggtaccgggaccgggtaccgtcccggtaacccggtaggggacctaaggggtaaacttcggtacgtaccgtaaccgttccgtaaacccgtccgtccgtaaaccccg

SEQ ID NO: 140285 - DNA, 905 bp, Homo sapiens
  misc_feature: GYAE6OF01CSDVN.46.67.G01.1.454.CMB.1.raw
  modified_base (157)..(157): a, c, t, g, unknown or other
  misc_feature (157)..(157): n is a, c, g, or t
tcagactagcagtacacgaccggtgctcgatttagagtatacatagttggggtttggggagtctcggtcaggacacagcatggacatcggacgggtccccgctcagcctccgtggggcctccgtgccttactcgtggcctcggaggtcgccgaagtnttggacaacgatcggacgtcgtaccggaaccctgtcctacctccttcccctccgtacgtctacgaccggtaccgggaggactacgtcgtacgacccaccttatcctacgggttccgggaccgggtaacgtaacgggtaccgaacttacgttaccgtaacctttaacgttttaagttttaagttagttaacaaccgtaaacgttacggtaaccggaacccgggaccggggtaaacccggttaaccccgtaacgttaccccttaaactttacgtcggttacctcgggtaccttagaaccctttcgttaaccgtttacggttaacggtaaccgggttaccgggtacccgttaaccttacggggtacgttaccggtacgttaggggtaccgttacggagttacgggttaacgccggttaacgggaaattccggtttctaacctaccctactttaccggacctttaggtaacccttagttacgtaacgttaccggtaaccggtaagttaacgttttacgttaacgttaacgttaaccgttatttacgtaacgtaacgttaacaagtttaacttagttaccgtttagtaaccgggttacgaaacgtaacccggtaattaaccttaaacgtaaacccgttaagttaaccgttaggtacggtaaccgttaccgaccggttaacacggtttacttccgtttacgtaacccctttgttacccttacccgggttacacggtaatttcgtcgttaaaccg

SEQ ID NO: 140286 - DNA, 857 bp, Homo sapiens
  misc_feature: GYAE6OF01BC7C9.46.67.G01.1.454.CMB.1.raw
  modified_base (179)..(179): a, c, t, g, unknown or other
  misc_feature (179)..(179): n is a, c, g, or t
tcagactagcagtacacgaccggtgctcgatttagagtatacatattgggtttgggggacctcctgtgcaagaacatgaagcacctgtggtttgtcctcctgctggtggcagctcccagagtcgggtcctcgtcccgtggtgcaactggcgtaggacggtccggcccacgtacgtgggngacggtccgttcgggaacgtacccgtcggtcccctcgaccgtgcgtctgtcctcgtggtctcctactatcgtagttgttcggtttccgtggtacggggtcgtacggggtccgacgtacgtccgtaccgggaagggtacgggtacgtaggtaacgtacgttagtagggtaacgtcgttaccgttacgtacgtaaggttaggtacgggttaccggtttacctacgttaacccggtcggttccgtaccttacgtaacgacggtacggtacgtaccgtaccacgttactacgtctacgacgtactacgtacgacgtaactacgttacgttaccgttcgaagtaacgtagttacgtagttcgtccggtacgcccgtaccgtagtaaccggtccggtacggtttacgttacggttatcgggtaggacccgttacggcgttaaccggttagttactttaggtacgttttaggttacggttaacggttcgtttaaccggtaacctacccggtacgttaacgggtacccggtacccggggtaccgggttaaacccggttcccggggtcccggtaaccggggtacgggttaaacccgggtttaaacccgtccgggttaacccggttaccccgtttaaacccggtcccggtttaaccccgttaacccggacccccgttaaacccccggg

SEQ ID NO: 140287 - DNA, 787 bp, Homo sapiens
  misc_feature: GYAE6OF01CROZS.46.67.G01.1.454.CMB.1.raw
  modified_base (146)..(146): a, c, t, g, unknown or other
  misc_feature (146)..(146): n is a, c, g, or t
  modified_base (178)..(178): a, c, t, g, unknown or other
  misc_feature (178)..(178): n is a, c, g, or t
  modified_base (735)..(735): a, c, t, g, unknown or other
  misc_feature (735)..(735): n is a, c, g, or t
  modified_base (770)..(770): a, c, t, g, unknown or other
  misc_feature (770)..(770): n is a, c, g, or t
tcagactagcagtacacgaccggtgctcgatttagagtatacatatttggggtttgggggagtctcggtcaggacacagcatggacatggagggtccccgctcagctccgtggggctcctgctactctggctcggaggtgccgagnttggtgacatcgagctcgacctagtcctaccnctccctccgtgtctgaccgacggtggaagacgtagtcgaccactactcgtacgttcgggccggaactacggtaccggaattacgtaccgtaaccttaacgtttaattttaaggttacgtaactaaccaagtacggtaacggaaccgggaaccggggtacccgtaacccgttacgtaaccgttaaccttagttccgtaacgttcggacctcgtacctaacggttccgttaaggtttaccggaaggttaaccgggtccgggttaccaacggtcgggttaacggttcgtacggcggtagttagggcggtagtaccggaggttactaacgttcttaccgacttacctacgacgttactacgttaagtcttaggaacgtaacgttaacggtatttaccggtttaatttacctaacgtttaaatttacggaacctttacgaaactaacttaatttaaacttacggtttcggttaacggtacggtaaacgaacggtaacttaaccggaatttaaaacccgttaaaggtacggttacgttaagccgtaacacgaaacgttccttnttaccggttctccgttactaccccttcgttacccnttagttccgtaatacgg

SEQ ID NO: 140288 - DNA, 839 bp, Homo sapiens
  misc_feature: GYAE6OF01CUJOL.46.67.G01.1.454.CMB.1.raw
tcagactagcagtacacgaccggtgctcgatttagagtatacatattgggtttggggagtctcggtcaggacacagcatggacatgagggtccccgctcagctccgtggggctcctgctactctggctcgaggtgccagatgtgacatcgagctgacccagtctcctactcctccctgtctgaccaaccggtgggacgacgagtcgtaccaccatccaaccgttcggccgggtacaacggtaccggaactagttacggaacctaaccgtttaattttaaagttcggtaactactaaactaagtaacggaaccggaacggggtacccgtaacccgtaagtccttaactaacgttacctaagtcggtacctggtacctacgtaccgttaaggtttcgtaaccgtaaacgggttaccggggtaccctaggttacgggtaggttacggaggtacggtacggtacgggttacgggtacgtaccggtacgggtactaaggtacttttaccaccgttaccgtaacctaacgtacgtacgttaagttaaccttcggtaacgtaaccggtaaacgtacgttaacggttaacgttttacgtaaaccttaacgtttacgttaacgttacgttaaaccaaacgttaagttaaactttaacgttaacgttttccgggtttaaccggaaccggtaaggtaaccccgtaagtaaacccttaaaacgttaaacggttaacctacggttacgttacggacccgttagaaccccgtaacgttacgtttaccgttcgtttaccccttaccgttacccgtttaccccggtacccgtaccgttaactcgttaccgaaacg

SEQ ID NO: 140289 - DNA, 950 bp, Homo sapiens
  misc_feature: GYAE6OF01B4VDE.46.67.G01.1.454.CMB.1.raw
  modified_base (936)..(936): a, c, t, g, unknown or other
  misc_feature (936)..(936): n is a, c, g, or t
tcagactagcagtacacgaccggtgctcgatttagagtatacatattgggtttggggacctcctgtgcaagaacatgaagcacctgtggtttgtcctcctgctggtggcagctcccagatgggtcctgtcccgtaggtcgcaactgacaggacgtccgggacccacgtacgtgggtcgacggtccgtttacggacgtacccttcgtcccctcaccgttcgaccgtcgttgtcctcgtggactccctcctaatccgtaagttcggtttgttttcccgttcgggtcggggtaccttcgggggtaacccgtcgaccgtacccggtacccggaaggggtaacgggtcgtaacggtaaactaccgttaaggttacggtaagttacggtacctcgtaccgtaaggtacggttagggttaaccggtttacccgtttaacttacggtaacccgtttcccgtaccgttacgtaaccgtaacgggtaacggttaccgtaacgtacccgtaaacccttagttaaccgttccgttaaccggttaccgaaccggtacccgtaaccgtaacggtacctaaaccgtttccgttaacccggttttaacccggaagttaaacggtacgttacggtttacgttaccggtcggtaacccgtaaccgggtcccgacgggttaacccgtaaccggtttacgggtttaaccgtttaacgttaccggtaagggttaccggaacggtaacggtaaccgggtaaccgttaacgtttagtttaaacggttcggttttaaaggttttcggtaacggttttaccgtttaaacgttacccgtaaccgttaacccggttaaggaccggttacccggggtaccgtacccgttacccgggacccggttccggaaacggtaccgtaaccgttacgttacccggaccttaccgttaccctaccggtaccnccccgtaaacccgg

SEQ ID NO: 140290 - DNA, 1199 bp, Homo sapiens
  misc_feature: GYAE6OF01ADH95.46.67.G01.1.454.CMB.1.raw
tcagactagcagtacacgaccggtgctcgatttagagtatacatattgggtttggggacctcctgtgcaagaacatgaagcacctgtggtttgtcctcctgctggtggcagcctcccgagagtgggtcctgtccctggtgaccaacgtgacgaggacggtccgggcccacgacgtggtggacggtccgttcggacgtaccccgttcgtcccccttcgaccgttcggccgtccgttcgttccgttccggttcgggttacccgcccctttaccgtaacgttaccggttaacgggttttacgggtttttccgggttttttccgttaccgggggttacgggggttccggtttaccgggggttaccccggacgtaacccggtaccccgttaaccccgggggaaaggggggtaaccggggtaccggtttaagggtaaaccgtttaaccggttaaggttttaacccggggtaaaggtttcccggtttacccgtttaccgtttaaccggtaaggtttaacgggggtttaccgggggtttaaccgggttttaaccccttaacgttttaacccggttacccggttttaccccgttaccgtttacccggtaaaccggtaacgggttaaccgggttaacccgggtaaccgttaaccccgtaaaccttaacgtttaccgtttacccggttaccggttaaccgggtaaccccgttaaacccggtaaccgtaaccggtaaccgttaaccgtttaacccgttttaaccccgttttacccggaaagtaacggttaccgtttacggtttaccgttttacggtacccggtacccggtaacccggtccggttacggtaaccggtacccgggtttaccgggtttacgttttaacggtccgttacgggtaaccgggtacggtaacggtaccgggtaaaccgtttacgttttaaacggttacggtttttaccggttttaagggtttttcggggttaacgttttaccgggttttaaccgttaaccccgggtaaaccctttaccgggtaaacggggttacccggtaaccgggggtttaccccggggtaccccgttaacccccgggggttaccccgggaggggggttaaccccggttaaaggggttaacccccgtttaccggggttaaccccgttaacccccgggttttaccccgttttaccccccgggttaaccctttaccccc

SEQ ID NO: 140291 - DNA, 972 bp, Homo sapiens
  misc_feature: GYAE6OF01AFCIZ.46.67.G01.1.454.CMB.1.raw
  modified_base (195)..(195): a, c, t, g, unknown or other
  misc_feature (195)..(195): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggacgaccctgtccctcacctgcgctgtctctggtcgcctcatcagtgtggtttctcgngggtctcgggtccgcagccgtaccgaggggaaggggctaggaactacgagttaggaagttcgtcctctcgagttaggtggtacggtttcctattaccgacgtccgttctcacaagtacgtcgactccacctagttactccgtcgtacggacctaccgacctaaggacctaacgtccgtttaccgtttttacccgaagtaaacgtacgttacggttacgtttccgtacgggttaccggtaccccggtccggtcggtttaaccgggaacccgggttaacccgggggtttttacttttttaaaaccgttcccggttaggggttaccggaacgggtaacgggtaacgggtacccggtttactttaaagttttacggtttacggtttttaagggtttttacgggtaacggtttttacgggttttaacctttacccggtaaaccccgttaccgggttaacggtacccggggttacccgggggttaccgggggtacccccgtttcccccggggtaacccccggggtagggggtaaccccggttaacggggttaaaccgttacccggggtttaccgggtaccccgttaccccgggtttacccgtttaccccggtttaccggtaaccccccgtaaccccgggttaaaccccggggaacccgggttacccctttaacccgggtttcccccggtttaccccccccggtttccccggtaacccccgggttaccccctttaacccccggttaccccggtaacccggtaaccggttcccgtaacccccggg

SEQ ID NO: 140292 - DNA, 644 bp, Homo sapiens
  misc_feature: GYAE6OF01EG0LD.46.67.G01.1.454.CMB.1.raw
  modified_base (170)..(170): a, c, t, g, unknown or other
  misc_feature (170)..(170): n is a, c, g, or t
  modified_base (243)..(243): a, c, t, g, unknown or other
  misc_feature (243)..(243): n is a, c, g, or t
  modified_base (422)..(422): a, c, t, g, unknown or other
  misc_feature (422)..(422): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtagnggccttcggagaccctggtccctcacctggcgctgtctcgtggtcgcctccatcagtaggtggtttcttacgngggggctggggtccggcaggcctcccgaaggggaacgggcgtaggaataacgtacgttggaacgtgttactccgtacgattaaggtggtacgggtttaccttagttaaccagtccgtactcgtacaagacgtcgagtcaaccatatctctggacacgtccaggtcaatcagttttcccngtaaagatgattctagtcgaccgcgcgttgacacgggtcgtttattacctgtagcgtagaggacggtcttagttacttggtaacgtttttgggagttaggtttactttcgtaactacccgtagtacttcggacggggccgtcggtccccggtaggggacccgaggggaacttaacggttcgggtacctaaccggttccgttacccttccgccccgtaacccg

SEQ ID NO: 140293 - DNA, 781 bp, Homo sapiens
  misc_feature: GYAE6OF01CMYRI.46.67.G01.1.454.CMB.1.raw
  modified_base (99)..(99): a, c, t, g, unknown or other
  misc_feature (99)..(99): n is a, c, g, or t
  modified_base (771)..(771): a, c, t, g, unknown or other
  misc_feature (771)..(771): n is a, c, g, or t
tcagactagcagtacacgaccggtgctcgatttagagtatacatattgggtttgtcctcctgctggtggcagctcccagagtgggtcctgtccctggtncaactgcaggatccggccgaccgacgtacgtggaggaccgtccggttacggaccgtacccgtcccgtaccctaccgtaccgtcggccgttcgttcgttcgtcgtcggtcccgtaccctctactagttaaggttcggttttcgttcgtcggggtacggtcgggtccggcgcgcgtaccgtaccgggaaggggacgtagtagtaactagtaggtacggtagtcctcgtctacgtaggttacggtacgggttaccttaaccgttataaccggtccgttccttacgtctaaacggaggttaccggctaaccggtaccaactacgttcgtcgtacgtacccggaccgtccgacgaacgtacttaccgttaccgtttaccgttacgaagtaacggttgtagtttaccgtacgtccggtaccggtaaccgccgttacggtaacggttaccgggtagttttaacttcgttacggtgacggtaggaacggtacggtaacttagttacgtagtttaggtttaggttaagttcgtttacgtacctacgtacctacggtgtacggcgggcctcggcccgtagggcgaggtatcggtacgcgtccgtactccgtccgtacctccggaaccctcggtccctacggttcccacccgttcccgaccgtaccctacccttccgaaccgngtccgtaccg

SEQ ID NO: 140294 - DNA, 744 bp, Homo sapiens
  misc_feature: GYAE6OF01CMYX0.46.67.G01.1.454.CMB.1.raw
  modified_base (181)..(181): a, c, t, g, unknown or other
  misc_feature (181)..(181): n is a, c, g, or t
  modified_base (228)..(228): a, c, t, g, unknown or other
  misc_feature (228)..(228): n is a, c, g, or t
tcagactagcagtacacgaccggtgctcgatttagagtatacatattgggtttgtcctcctgctggtggcagctcccagatgggtcctgtccctggtgcaactgcaggacgtccgggcccacgactgggtgaggtccttcggacgaccctcgtccctcgacctgcgtctgtctcgtggtcnccctcatcgtagttagttcggtttctcggtcgggtctcgggtccgcncgcctccggaaggggacgggctagaactacgtagttggaagttgtctctctagtaggtcggtacgttaccttaatcgacgttccgtctactacgaacgtcgtacgacgtacaactacttacttcgtcgtacgacctaccgtcagtactaacttccttacgtttaccgaagtaagtagttcgtagtttacgtcggtaccgaccgacgtaccgtacgtaccggtacggtttacgtttacgtacgtggtacgacgtaggtaacgtaccggttatttagttaagttggttttaaggttggttaacggtttacgtttacgttaaccgaacccgttacgtaacggtccggtaacggggtccggttacccgtaccgggcccggtaggggtaccgtaaacggtacgttaccgtccggtaccgttaccgtaccgtaccgttaccgcccgtacgaccggacccggtccgtaccgttcccgtacccctcccgtacgacccgttaccctccgaacgcgtcccgtaccg

SEQ ID NO: 140295 - DNA, 746 bp, Homo sapiens
  misc_feature: GYAE6OF01ED6FB.46.67.G01.1.454.CMB.1.raw
  modified_base (718)..(718): a, c, t, g, unknown or other
  misc_feature (718)..(718): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtcgccagatgtgacagtcgagctcgacccagtcctccactccctcccgtgtctgaccgaacggtgggactacgaggtcgtaccaccactcgtacgttcggaccgggacaacgtacggaactagttcgaacttaactttaagtttaaacgttggtaattacaaacgtaagtacgaaccgaacgggaacccgtacccgtaagacttaacccgtaagttcttaacgtgtaccgtacgtaccgtactaccggttacggtttaggaccgttaagggtccgggtacctaacgttcggtaacggttacgaggtacggtagtacggtagaccgttaggtacggggtaactaacgggtttaactttccaccgttactacccgaactaacttaacgaaaggttactaccgtacgaaccgttaaccgggtaataacgttaagtttcaaacctttaacgttacgtttactacaacgtaaactaattaaccgttaattaacgtttacggttaccgaaccgtaacggtataacgtaaacctaaagttaactaacggagtacgtggactacgaactcgtagttacctgttacctaaccnctttaccgacccgtactgtcgtagtacg

SEQ ID NO: 140296 - DNA, 679 bp, Homo sapiens
  misc_feature: GYAE6OF01B6ZW9.46.67.G01.1.454.CMB.1.raw
  modified_base (97)..(97): a, c, t, g, unknown or other
  misc_feature (97)..(97): n is a, c, g, or t
  modified_base (139)..(139): a, c, t, g, unknown or other
  misc_feature (139)..(139): n is a, c, g, or t
  modified_base (146)..(146): a, c, t, g, unknown or other
  misc_feature (146)..(146): n is a, c, g, or t
  modified_base (224)..(224): a, c, t, g, unknown or other
  misc_feature (224)..(224): n is a, c, g, or t
  modified_base (264)..(264): a, c, t, g, unknown or other
  misc_feature (264)..(264): n is a, c, g, or t
tcagactagcagtacacgaccggtgctcgatttagagtatacatattgggtttggggagtctcggtcaggacacagcatggacatgagggtccccgntcagctcctggggctctgctactctggctccgaggtgccagntgtgacntcgagctgacccagtctaccgatcctccctgtcctgaccaaccgtgggacacagtcgtcaccagtcacttggccgganagtcggaactattgactactattaactggtatcacagtanaccgaggacgaccctagactactactactatcgcttcggctacgtacgtacgtttacgacgtaaacggtcgggttacccagtacggtacggttcaggtacggtcgtaggtacggtacttacgggtaggacgtaagtacttacggactccgtactacgtactcgtaacgtaatacgttacgacctaacgtacgtaactagttttacgtaccttaaacggtttactaacgttagtactaaacgtacggttaaattaacgttaacggttacgtttaacccggtaaccgttaaacggaaccgttacgtaaaccgttaacttaaacgttaacgtaacgttaggttagtacgtagaccgtactaccgttacttccgttacttctaccgttaccttccgtaactaccgtcgtaacgttaccg

SEQ ID NO: 140297 - DNA, 875 bp, Homo sapiens
  misc_feature: GYAE6OF01BIZOJ.46.67.G01.1.454.CMB.1.raw
  modified_base (575)..(575): a, c, t, g, unknown or other
  misc_feature (575)..(575): n is a, c, g, or t
tcagactagcagtacacgaccggtgctcgatttagagtatacatattgggtttgtcctcctgctggtggcagctcccagatgggtcctgtccctggtgcaactgcaggcgtccgggcccacggactgggtagacggtccttcggacgaccccttgtcccctcaccgtgccgtctggtcctcgtggtcgccctcatcgagttagttgttttccgtcggtggggtcgtcgggtccgatcgccgtaccggagggggacggtctaggaacgtacgtagttagggaagttcgttcctcgttacgagttacggtggtaacggtttcctaagtttaccggcgttccgtaccttcgtacgaaggtcgttacggaactccaactaacgtttctacgtccggtacggaacctaccgtcaacgtactaacgttccgtttaccgtttaccgaagtaacgtagttacggttacgtttcgtacgggtacccggacccgtcccggtacgtaccggtaacccgggtttaacgggtttacctttttaaacgtcggtcgggtacgtacgggtaacgggtcggtaaacccgttntttaaagtttacggttaggttttaaggttttaccgggttaggttttaacggtttacctttacccgggaaacccgttacggtaaggtaccggggttacccggggtacccggttaccgtccccgggtaacccgggtacgggtaaccggtaaggttacggttacccggttccgtaaccgggtccttaccgttccggtaaccctaccccgaaccggtaacccggtccgtaccttcccggttccgggttcccccttaccccggcgttaccccctacctaccgtacccgaggtccctaccccgggg

SEQ ID NO: 140298 - DNA, 818 bp, Homo sapiens
  misc_feature: GYAE6OF01CTWLK.46.67.G01.1.454.CMB.1.raw
  modified_base (157)..(157): a, c, t, g, unknown or other
  misc_feature (157)..(157): n is a, c, g, or t
  modified_base (179)..(179): a, c, t, g, unknown or other
  misc_feature (179)..(179): n is a, c, g, or t
  modified_base (211)..(211): a, c, t, g, unknown or other
  misc_feature (211)..(211): n is a, c, g, or t
  modified_base (330)..(330): a, c, t, g, unknown or other
  misc_feature (330)..(330): n is a, c, g, or t
tcagactagcagtacacgaccggtgctcgatttagagtatacatattgggtttgtcctcctgctggtggcagctcccagatgggtcctgtccctggtgcaactgcgaggagtcgggccccagactggtgacggccttcggacgacccctgtcccctnacctgcgctgtctcgtggtacnccctcctatcgtagtagttggttttcttcggnggggtcgtcgggtccggacacgtcctacccggaagggggaacggggtcctagggaacttacgtagttacgggaagttcgtccttcgtactagttaggtggtacggtttaccttattacncgttccgtctctagaaggtagcgtacgtctaacctagtactccgtcgtcgaaccgccttcgagtcctaacttcgtactttaccgagaacgtgtcgtagttcgtacggtaccgtcccgcgtcgtacgtaacccggtacgggtttacttttaggtacctggtcgagaaggtacggtacgtaccgttattacgtgtttagttttacggtaagtttacgtttacgttaccgtaacgtaacccgttaggaaccggtttacgggacccggggttacttaccccgggtacccggtcgggggtacccgtaagggttacctaccggttaccggtacccgttacccggttcccttacccgttaccgtaccccgacccgtaacccggggtaaacccgttccccgtaacggttccccccggttccccgttacccccggtccggtacccccgttaaccccccgttaccgtaaccccgtaaaccggtaccgtaacccccggg

SEQ ID NO: 140299 - DNA, 714 bp, Homo sapiens
  misc_feature: GYAE6OF01AHPNR.46.67.G01.1.454.CMB.1.raw
  modified_base (205)..(205): a, c, t, g, unknown or other
  misc_feature (205)..(205): n is a, c, g, or t
  modified_base (645)..(645): a, c, t, g, unknown or other
  misc_feature (645)..(645): n is a, c, g, or t
  modified_base (689)..(689): a, c, t, g, unknown or other
  misc_feature (689)..(689): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctcgaccctagtcctcctactccctcctagtctcgacgtaaccggtgggaanacgtagtcgtacaacctactacctacgttcggaccgggaactaaggtaccggaactacgttacgaaccttaacctttaagttttaaacgttcggtaataccaaatacgtaacggaccgtaacggggacccggtaccctaaggtacctactaactctaactgcctacgacaccttacgtagtttagaacgtaacgggtcgggtaccctaggaccggttaggtaccgtaggtcgacggtagtacggtacgtcggtaggtacagttacttacaactctaacactagtacgtaatacgtacgagtacgtacgtagtattaagttcgtaaccttaataacgttctaacgtaactaaactaagtaactttactagtttacggttacgaaccggtaacggaactaacgtaactaaacgtaaacgttaacgacgtggtaccgtactanaacccgtaacttacttagtctttacgtaccctacggttaccccncgtaacctcttacgtaattaacccg

SEQ ID NO: 140300 - DNA, 855 bp, Homo sapiens
  misc_feature: GYAE6OF01AGKHE.46.67.G01.1.454.CMB.1.raw
tcagactagcagtacacgaccggtgctcgatttagagtatacatattggggtttggggagtctcggtcaggacacagcatggacatgagggtccccgctcagctcctggggctcctgctactcgtggcctcggaggtgccagtattggtgacagtcgagtcctacgacccgagttccctccactccctcccgtgtctacggccgtaaccgggtagggacgaaccgtaggttccgtacgacctagtccgtacggttcggaccgggtactaaaggggtccggtaaactagtttaccggaacgttaaccctttaagttttaaaacgttggttaactaaccgaacgttagtaaaccggaccgaaagggggaccccggtaccgtaaacggtccttaccgtaactattaactgccgtgacctacgtcgtacggtttgaacgtaacgggtcggtccctagtcgtagttggtacgtaggtcgcgtaaaggtacgggtacgtttagggtaccggtaaagtacgttaactttcccgtaacgttccgtaacccgtacttaacgtacgggttaacccgtaaggttacccggaggttaacccgtaccgggtaaagttaagtttcggtttaaccgtaacctttaaggttaacccgttcttaaacgggaacccttaaagggtaacttttaagtaccggtttaacgtttccggtttaaccggaacggtaacgtaaccgtaaccgttaagaaaccgttaacgtaaccgtacggtcgtaaacgttcccgaagtacccgacgtttacgttccgttttaccataacccgggtttacccggttccccaaccgtttagttccggtaccttaaccggg

SEQ ID NO: 140301 - DNA, 923 bp, Homo sapiens
  misc_feature: GYAE6OF01E021U.46.67.G01.1.454.CMB.1.raw
  modified_base (252)..(252): a, c, t, g, unknown or other
  misc_feature (252)..(252): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagaccctgtccctcacctgcgctgtctctggtcgcctccatcagtagtggtttctcgtgggctgggtccgcagcctccgaggggagggctaggaactacagttagggaagttntctctcagttagtggagtttccttattacgacgtcccgtactcctacgaaagtcggtacgacgtacctaaccgattaaccttcctccggttacggaaccctaccggttccgaacgaccttaaacttccgtttaaccgtttttaccccgaaggtaaaacgtacgttaggttaacggttttccgttagggttccccggaccccgtacccgggtaccgttacgggaacccggttaaccgggggtttaacgttttttaacgtttaccggttaggtcgggaacgggtaaggaacggttaaccggtatttaacgttttaggtttgggttttaacgggttttttagggttaacgggttttacgggttttaacctttacccggtaaacccgtttaaccccgttagggtaaccggttccgggggaacccgggggttccctaaccccggggtacccccgggtttacggggaaccccgggtaaaggggtaacccgtttcgggttacccggttaccggttacccccgtttaccgttacccggtttacccgtcccccgtaaaccccgtaaccggggtaacccggtccccgttaacccggttccccgggtttaccccccgtccccggtacccggttacccccgtaccccccttacccggaccctaaacggtcccggtacccccgg

SEQ ID NO: 140302 - DNA, 859 bp, Homo sapiens
  misc_feature: GYAE6OF01C30UF.46.67.G01.1.454.CMB.1.raw
  modified_base (299)..(299): a, c, t, g, unknown or other
  misc_feature (299)..(299): n is a, c, g, or t
tcagactagcagtacacgaccggtgctcgatttagagtatacatattgggtttgggggacctcctgtgcaagaacatgaagcacctgtggtttgtcctcctgctggtggctagctcccagatggggtccctgtccctggtcgcaactgccgaggacgtcgggccaacgtacgtggtgacggtccttcggacgacccttcgtccctcgacctgcgcttgtctccgtgggtcctcccgtctatacgtacggtttagttcggggttttcttcggtcggggtcgtcggggttccccgagtccncccggttaaccggaacggggtaacggggtctaagggtaactaacgtagttacgggtaacggttcgtacttcgtaccgtaagttagggttacgggttacggtttacccgttaactttaccggtaaccggtttcccggttaccttccgttaacgaaaccggttggtaacggtacgtaccgtaaacctataccgtcttaccgtaggtaccctaccgtacgaacgtacctaagttacgttaccgttttaccgagtaaacgtgtttacggttacgttccgttacggtaccaccgggtactcccgggtagacggtttaccgggttaactttcgttacgtcggtacgacggacggtaagtaccggtacgtttaatttaggtttagtttacggtttttgggtaaggttgtttaccgttacgttaacccgttaccgtagtacccggtacgggccgggttaacccgccgggtaaaccccgggttgggtaaaccggtaacgggtacccgttacggttaccggtacctttacccgggttaccctttaccggttcccgtaaccccgtacccgg

SEQ ID NO: 140303 - DNA, 789 bp, Homo sapiens
  misc_feature: GYAE6OF01AL4C2.46.67.G01.1.454.CMB.1.raw
  modified_base (165)..(165): a, c, t, g, unknown or other
  misc_feature (165)..(165): n is a, c, g, or t
tcagactagcagtacacgaccggtgctcgatttagagtatacatattgggtttggggagtctcggtcaggacacagcatggacatggagggtccccgctcagctcctggggctcctgctactctggctccgaggtgccagatgtgacatcgagctgacccagtcnccatccctccctgtctgcaaccggtgggacacagtcgtccacctatcctacgttcggacccgggtacaaacggttccgggaaactagtttacggaacctaaccgtttaagtttttaaaacgttcggtaacttaccgaaactaacgttaaccggaacccgaacgggggtacccggaccccttaaacggtacccttacccttaaaacgttcctaaacgttcggtaccttcgacctaacttcccgtaaggttttacggaccgtaaaacggggttccggggtaccctagttaccgggtacgggtttacgaacgggttcggacgtacgggtcggtaacgttcggtaacgggtaacgtaggttactttacccgtactccgtacccgaacctagtaccaagttactcgtacggtacgtaacgtaggtaacgtttaacgtttacgtaacttaacgtttacttacgttagtaactaatacgtaatttaactaagtttcggtttacggaaccgtaacgggtaacctaccggtaaacttaaacgtaaacgttaaccgacgtacggtcgacttacgactacctatcgttcttacgttacctaccgttccctacccgtacttattccgtaggttacc

SEQ ID NO: 140304 - DNA, 932 bp, Homo sapiens
  misc_feature: GYAE6OF01AYHFO.46.67.G01.1.454.CMB.1.raw
  modified_base (96)..(96): a, c, t, g, unknown or other
  misc_feature (96)..(96): n is a, c, g, or t
  modified_base (134)..(134): a, c, t, g, unknown or other
  misc_feature (134)..(134): n is a, c, g, or t
  modified_base (202)..(202): a, c, t, g, unknown or other
  misc_feature (202)..(202): n is a, c, g, or t
tcagactagcagtacacgaccggtgctcgatttagagtatacatattgggtttggggagtctcggtcaggacacagcatggacatgaggtccccgntcagctccgtgggctcctgctactctggctccgaggtnccagatgtagacatcgagctcgacccagtcctaccactcctccctgtctcgaccgtaaccggtggganacgtagtcgtaccaaccgtattacctacgttacggcccgggtacaaacggtaccggaaactaagtttaccgaaccttaaccgtttaaagtttttaaaacgttcggtaacttaccgaaaacctaagttaacggaacccgtaacgggggtaaccccgtaacccccgtaaaggtacccttaccgttaaaattccttaagtccggtaccttacgtacctaaccttaccgttaaggttttacggaaccggtttaaacgggttaccggggtacccttaacggttccggttaacgggttttaccgtaacgggttaccgggtaccggttaagggtaccggtaacggttaccggtaaggggtaccgtaaacggtttactttacccgtaaaccgttccgtaaccctaaacccgttaagtaccgtaaacgttaccgttcgttaaccgtaaccggtaaccgttagtaaacgtttaacgtttacggtaactttaaacgtttacgtaacgttaacggaacctaaacgttaacgtaaacgtttaacgttacgtttaacggttaccggtaaccgtaaggaacccgttaaagtaacccgttaaaacgttaaacgtaaacggtacgttacggtaccgtacgtaaccgttaccgtaaccgtactttacccggttacgtttaccccttaaccgtttacccgttttaccccgaccccgttaacgttaccgtttccgtaacgtttaaacccg

SEQ ID NO: 140305 - DNA, 716 bp, Homo sapiens
  misc_feature: GYAE6OF01DSD51.46.67.G01.1.454.CMB.1.raw
  modified_base (249)..(249): a, c, t, g, unknown or other
  misc_feature (249)..(249): n is a, c, g, or t
  modified_base (711)..(711): a, c, t, g, unknown or other
  misc_feature (711)..(711): n is a, c, g, or t
tcagactagcagtacacgaccggtgctcgatttagagtatacatattggggtttgggggagtctcggtcaggacacagcatggacatgagggtccccgctcagcctccgtggggctcctgctactctggctccggaggtgccagatgtgacatcgagctacgacccagtcctccacttccctccctgtctcggaccgaaccggtgggaacacgtaggtcgtaccacctatccgtacgttcggccggganaacggtacgactagtacgacctaacttaatttaaagtggtaactacaactagtacggaccgacgggtacccgacctaagtccttacctatcgtatcgtctagcctactcgtagtacgaccggtaacgggtcggtaccctagttacgggtacggtttacgagggtcggtacgtaggttacgtcggtacgggtacgggtacttacggttaccttacgtccctttacaacccgtaacctagttacgtaacttaccgtacggtaacgtaaccgtaaggtaagttaacgtttacttaacgtactttaaacgtttagtaacctacgtaacgtaataacttaacttacgttaggtttaccggtacggaacgtaacggaactacgtaaaccttaaacgtaacgtacgtagtcggtataccgtacgactaactcgtacgttctaccgtctacctcctacccgtattacgtntgtac

SEQ ID NO: 140306 - DNA, 587 bp, Homo sapiens
  misc_feature: GYAE6OF01DZ4D8.46.67.G01.1.454.CMB.1.raw
  modified_base (199)..(199): a, c, t, g, unknown or other
  misc_feature (199)..(199): n is a, c, g, or t
  modified_base (286)..(286): a, c, t, g, unknown or other
  misc_feature (286)..(286): n is a, c, g, or t
  modified_base (337)..(337): a, c, t, g, unknown or other
  misc_feature (337)..(337): n is a, c, g, or t
  modified_base (360)..(360): a, c, t, g, unknown or other
  misc_feature (360)..(360): n is a, c, g, or t
tcagactagcagtacacgaccggtgctcgatttagagtatacatattgggtttgggggagtctcggtcaggacacagcatggacatgagggtccccgctcagctcctggggctcctgccttactctggctccgaggtgccagatgtgacatcgagctgaccccagtctccatcctccctgtctgcaaccgtgggacacngtgtcaccatcacttggccggacaagtcggaacattgacactatttaatggtatcaacatagaccaggacgaccctaagctactaanctatgctgctagtccagttgcaaggtgggtccagtcgaggttcaggtggcngtggatctagggactagacttcnctctacacatcagtaactctagactaacgtagaacgtatttacgactaactttaattactacgtactaacgtataaacttaacgtacgtagtttaccggacgtaacggtactaacgtaaccgtaacgtaaacgtaacgtaagtacggtaggaccgtacggtaccaaccgtatacgttcgttacttaccgtaccttccgtaccccgtacctacgtccgtagttaaccg

SEQ ID NO: 140307 - DNA, 613 bp, Homo sapiens
  misc_feature: GYAE6OF01EE2BB.46.67.G01.1.454.CMB.1.raw
  modified_base (222)..(222): a, c, t, g, unknown or other
  misc_feature (222)..(222): n is a, c, g, or t
  modified_base (296)..(297): a, c, t, g, unknown or other
  misc_feature (296)..(297): n is a, c, g, or t
  modified_base (352)..(352): a, c, t, g, unknown or other
  misc_feature (352)..(352): n is a, c, g, or t
  modified_base (390)..(390): a, c, t, g, unknown or other
  misc_feature (390)..(390): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgacgaaccgtgggagacagtgtccaccatcacttggcccgggnaaggtcggaacattgactaccttatttaaattggtatcgaacatagaccagggacgccctaagctctaatctannctgcatccagtttgactaaagtgggtccagtcgtagttcagtgcgagtggatcgngggacagtactttcagtcactaccattcgataacttcngacaagttacgtaagtatttgaccttaaattacttacgtagtacaacgtagtaactttaacagtttacgttttaccggaaccgtaacgggtacctaaaccgtaactttaaaccgtaaacttaaacgaacgttacggtacggtacgtacgtacctaaccgttactacgttccggtacttaccgtaactttaccccgttacccgaccttacgtcttagtaacccg

SEQ ID NO: 140308 - DNA, 660 bp, Homo sapiens
  misc_feature: GYAE6OF01D97S6.46.67.G01.1.454.CMB.1.raw
  modified_base (136)..(136): a, c, t, g, unknown or other
  misc_feature (136)..(136): n is a, c, g, or t
  modified_base (199)..(199): a, c, t, g, unknown or other
  misc_feature (199)..(199): n is a, c, g, or t
  modified_base (223)..(223): a, c, t, g, unknown or other
  misc_feature (223)..(223): n is a, c, g, or t
  modified_base (309)..(309): a, c, t, g, unknown or other
  misc_feature (309)..(309): n is a, c, g, or t
  modified_base (539)..(539): a, c, t, g, unknown or other
  misc_feature (539)..(539): n is a, c, g, or t
  modified_base (559)..(559): a, c, t, g, unknown or other
  misc_feature (559)..(559): n is a, c, g, or t
  modified_base (606)..(606): a, c, t, g, unknown or other
  misc_feature (606)..(606): n is a, c, g, or t
  modified_base (647)..(647): a, c, t, g, unknown or other
  misc_feature (647)..(647): n is a, c, g, or t
  modified_base (653)..(653): a, c, t, g, unknown or other
  misc_feature (653)..(653): n is a, c, g, or t
tcagactagcagtacacgaccggtgctcgatttagagtatacatattgggtttggggacctcctgtacaagaacatgaagcacctgtggtttgtcctcctgctggtgcagctcccagatgggtcctgtccctggtncaactggcaggacgtcgggcccacggacgtggtgacgtccgttcggagacccctgtcccctanaccgtcgcgctcgtctcgtggtcncctcgatcgtagtgttcgtttctcgagggctcgggtccgcacgtccgtaccggagggaggcgtagaactacgtagtaggtacgttntcttcactagtagttcggtacgtttactagttacgtacggtcctcgtactactaaaggtgccgtgacccttagtactcctttacgtccgtacgtaaccgcctaccctaagactaccttacgtttaccgtttacccaagaagtctttagtcgtttaccgtgttccgacccgcgtcgtagtcccggttacgttacgtttagtccgtgggtacacgggtagaacggtccgttnttaagtttacgttaggtttnttagggttattcggttaacttcggacttcgtacgcgtagggtccggncccgggtacgtggacctaggctacgtcgcgtacccgttacncgtccncgtaccg

SEQ ID NO: 140309 - DNA, 731 bp, Homo sapiens
  misc_feature: GYAE6OF01EA0ZZ.46.67.G01.1.454.CMB.1.raw
  modified_base (205)..(205): a, c, t, g, unknown or other
  misc_feature (205)..(205): n is a, c, g, or t
tcagactagcagtacacgaccggtgctcgatttagagtatacatattgggtttggggagtctcggtcaggacacagcatggacatgagggtccccgctcagcctccgtggggctcctgctactctggctccgaggtgccagatgtgacatcgagctcgaccctagtcctccactccctcccgttgtctgaccgaaccggtggganacgtagtcgtaccaccatccgacgttcggcccgggacgtaacggtccggaaactattacgaacctaacctttaaagttttaaagttggtaactacaactagtaacggaccgacggggaccgtaccctaagtcctactattctatcgtctgctacgttccgtaggtttagacgtaacgggtcgggtaccctagtacggtaggttcgaggtcgacgtaggttcgtacgtacggtacggacgtagttacttacctactcctaccaacgtatacgtaagttactcgtacgaacgttaacggtaagttaactttagtttactaactttaacgtttactttacgttacgtaacgtaacgttaagtaacgtttcgtaacgttaacgtttcgggttaaccggaacggtaacggtacctaaacgtaaataaacgtaaaccgttaaacgtacgttaggtccgtacgtaccgaccctaacttcgttaccgttagttccttacgtaccctttaccctaccgtcttaaccgtgttaacg

SEQ ID NO: 140310 - DNA, 824 bp, Homo sapiens
  misc_feature: GYAE6OF01BUIUG.46.67.G01.1.454.CMB.1.raw
  modified_base (189)..(189): a, c, t, g, unknown or other
  misc_feature (189)..(189): n is a, c, g, or t
  modified_base (787)..(787): a, c, t, g, unknown or other
  misc_feature (787)..(787): n is a, c, g, or t
  modified_base (817)..(817): a, c, t, g, unknown or other
  misc_feature (817)..(817): n is a, c, g, or t
tcagactagcagtacacgaccggtgctcgatttagagtatacatattgggtttggggagtctcggtcaggacacagcatggacatgagggtccccgctcagctcctggggctcctgctactctggctcgagtgccagatgtgacatcgagctgacccagtctccactcctcctgtctgacacggtgganacgagtgtcaccatcaacgttcggaccgggacgtaaacgtaccggaaactacgttacgaaccttaaccgtttaaagtttttaaaagtttacggttaactaaccgaaaactaacgtaaccgaaccggaacgggggtaaccccggaccccttaaaggaccctttaacccttaaagttcctaagtcggtcttacggaccgtaacgtttaccgttaaggttttacggaacggtaaacgggtaccggggttacccaggttacggtaaacggtttccggaagggttcgacgtaaggttggtaactacggtagggtaaacttagttaacctttaccaccgtttacctacgaaacccgtaacttaacgtaacgtttaaactcgttaaccgtaacgttaaacggttaggttaaacgtttaactttttaacgaaaccgtttaaactttaacgtttaaccgtaacgttaacgtaaaactaaggtttaaacttttaaacgtaagttttaccgggtttaaccggaaacggtaaacgggtaacaaccggttaaacgttaaactaaaacgttaacgaacgttgtaacgtcgtaacgacgttacttattccgtnttactaactcttacccgtaccagtaacgtntaaagtc

SEQ ID NO: 140311 - DNA, 787 bp, Homo sapiens
  misc_feature: GYAE6OF01CT8EB.46.67.G01.1.454.CMB.1.raw
  modified_base (765)..(765): a, c, t, g, unknown or other
  misc_feature (765)..(765): n is a, c, g, or t
  modified_base (781)..(781): a, c, t, g, unknown or other
  misc_feature (781)..(781): n is a, c, g, or t
  modified_base (783)..(783): a, c, t, g, unknown or other
  misc_feature (783)..(783): n is a, c, g, or t
tcagactagcagtacacgaccggtgctcgatttagagtatacatattggggtttggggagtctcggtcaggacacagcatggacatgacgggtccccgctcagctccgtggggctcctgctactctggctccggaggtcgccagtatgtgacatcgacgctacgaccctagtcctacctactccctcctcgtcgtcggaccgtaaccgggtgggacgacgtagtcgtaccacctatccgtaccgttcgggaccgggtaacgtaacggtacggtaactcgttacggtaaccttaactttaattttaacgtaggttaactaaccaaacgtacgtaaccggaaccggaacggggtaccccgtacccgttaacgtacccttaccttaactcgttaagtcgtacgtcgtaccgtaaccgttaccgttaggtttaacggaacgtaacggggttacccgggttacccctaagggttaccgggtacgttacggtacgggtcggtaccggtaagggttacgggtacgttacgggtacgggtaactacgggtttaccttaccgtacctacctaaccgtaactacgtaaccgttagtacgtccgtaacgaacggttaacgtaagttacgtttacttacgtaaactttacgtttactaacgttacgtaaactaacttaagttaacttaacgttacgttaccggttaccgaacggttaagacctaagtaaacttaaacgtaacgtacgtagtacgtcggtacacacgtacctgtactntcgactactccatctntntctg

SEQ ID NO: 140312 - DNA, 697 bp, Homo sapiens
  misc_feature: GYAE6OF01DF6XP.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccactcctcctgtctcgcaaccggtgggagacagtcgtccaccatccacttggcccgggctaaggtccggaactagttacgaaccaacctttaattttaaacgttggtaactacaaacagtaacgaccgagggaccggaccctaagcctacctaatctatgctgctatcctagttcgacgtaacggtcgggtccctagtcgtaggttcgagtcggactaggtggagtcgtagggtaactacggtactttaccgaccttccgtacctaacctattacgtaagttaacgtcgtaggaccgtaaacggtaggttaaagtttagttttaacgttaaacttaagtttactagttaacctaattaacgttaatttaacgttaagtttacgggtttaaccggaacgtaacggtaacctaacgttaaactaaactaaaggttaaaccgtagtacggtagtactacggacctaacgtcgttacgttacgttccttacgttaacttcccgttaccccgtaacttagttactgttaacgttacg

SEQ ID NO: 140313 - DNA, 736 bp, Homo sapiens
  misc_feature: GYAE6OF01A4V5J.46.67.G01.1.454.CMB.1.raw
  modified_base (194)..(194): a, c, t, g, unknown or other
  misc_feature (194)..(194): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgaccagtctccatcctcctgtctcgcaaccgtgggacacngtcgtcaccatctacgttcggccgggactaaggtccggaactatttcgactaacctttaagttttaaagttggtaattacaaactacgtaacggaacccggaacggggaccggtaccctaagtaccttaccgttaatactagtcgtactagactactaccgttaggtttacgaacgtaacggtccgggtacccaggttacggtaggttacgacggtcggacgtacggtaggtacgtcggtacggaactacggttactttacaccgtccgtactaacctacgtactaaggttaactcgtacgtaacgtaacgttaggtaaattacgtttagaacctttaactttatttaccgtagtaaccgtaaataacggttaacttaacggtagtttaccggtttaaccggacgtaaacgggtacctaaccgttaactaaacgtaaacttaacggacgttacggacgttacgtactaccgtaaccgttagttcgttcttaccgttacttaccgtttcccctacccggttacctacgttaccgttgtaaccg

SEQ ID NO: 140314 - DNA, 741 bp, Homo sapiens
  misc_feature: GYAE6OF01AY7AA.46.67.G01.1.454.CMB.1.raw
  modified_base (199)..(199): a, c, t, g, unknown or other
  misc_feature (199)..(199): n is a, c, g, or t
  modified_base (704)..(704): a, c, t, g, unknown or other
  misc_feature (704)..(704): n is a, c, g, or t
  modified_base (711)..(711): a, c, t, g, unknown or other
  misc_feature (711)..(711): n is a, c, g, or t
  modified_base (738)..(738): a, c, t, g, unknown or other
  misc_feature (738)..(738): n is a, c, g, or t
tcagactagcagtacacgaccggtgctcgatttagagtatacatattgggtttggggagtctcggtcaggacacagcatggacatgagggtccccgctcagctcctggggctcctgctactctggcctccgaggtgccagatgtgacatcgagctcgacccagtcctccactccctccctgtctgccaaccggtggganacgtagtcgtaccacctatactacgttcggaccgggactaacggtccggaacctagttacgaccttaccgtttaattttaaacgttcggtactacgaactagtaacgaccggtacgggacccgtaccctaagtcctacctattacgtactcgctcgactactaccgtagttacgacgtaacgggtcgggaccctaggtacgtgttcgacgtcggacgtagtggtactcggtacggacgtacgttactttacccgacgttacctacctaacccgtattaaccggtaacttaaccgttccggtaaccggtaaccgtaacgggtttacgttaaaccgttttaaggtttaaccgaaacgttttaactttaaccggtttaacttaacgaaccttaaacgtaaagtttaaccttaacggtttaacgtttccgggttaaccgaaccggtaaagtacccgaacgttaacgttaaacaaacggttaacgtgtacggtacgactccgacctactntccgttntacctctacctccgtaccatactcgtnacg

SEQ ID NO: 140315 - DNA, 972 bp, Homo sapiens
  misc_feature: GYAE6OF01BOU4X.46.67.G01.1.454.CMB.1.raw
  modified_base (147)..(147): a, c, t, g, unknown or other
  misc_feature (147)..(147): n is a, c, g, or t
tcagactagcagtacacgaccggtgctcgatttagagtatacatattgggtttggggagtctcggtcaggacacagcatggacatgacgggtccccgctcagcctccgtggggctcctgctactctggctcggaggtgaccagatgngacagtcgagctacgaccgtagtcctacctacgttccctccgtgtctacgaccgtaacgggtagggagtaccgtaggtcgtaccaccgtactaccgtaccggttcgggaccgggtacgtaacggtacggtaactagttaccgtaaccttaacgtttaagttttaacgttaggtaactaccgtaaactaacgtaaccggaaccggtaaccggggtaacccgtaccgtaacgtccttaaccgtaacgttacgtacgtacggtactcgtaacctacgttaccggttaggtttaccgtaacggttaaccgggtaccgggttacccttaacggttacggttacgttacggtacgggttacggtaacggtacgggttacggttcgggttaaccggtaacggggtaaccgttacgggtttaacccgtttacctaaccgttacctaaccgttaaccgtaacgtttaaccgtaagttaacccgtttagaacccgggtaacgttaacggttaacggttaacgttttacggtttacctaaacttttaacggtttaacctaacgggttaaaccttaaacgtaaacggttaaacccggtttaacgtttaacgggttaaccgtttttaaccggggtaacccggaaaccggttaaaccgggtaaacccgttaaaccggttaaaacccgttaaacgtaaaacccggttacggttaaccggttacgtacccggggttaaacctaccgggtaacctaacccgtttagtaccccggtttacgttaaccctttcgttacccccggtttaacgccccgttaaggttaacccttggtaaacggttcc

SEQ ID NO: 140316 - DNA, 496 bp, Homo sapiens
  misc_feature: GYAE6OF02FZGYV.46.67.G01.1.454.CMB.1.raw
tcagactagcagtacacgaccggtgctcgatttagagtatacatattgggtttgggagtctcggtcaggacacagcatggacatgagggtcccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatctgggacagatttcactctcaccatcagtaatctgcaacgtgaagattttgcaacttattactgtcaacagaattacaatgttttacgcctaagggacacgactacaaattaaacgaactagtgctgcacatctgtcttcatcttccgcatctgtac

SEQ ID NO: 140317 - DNA, 503 bp, Homo sapiens
  misc_feature: GYAE6OF02G3SNV.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatctgggacagatttcactctcaccatcagtaatctgcaacgtgaagattttgctaacttattactgtcaacagaattacaatgttttcggaccaagggacacgactacaaattaaacgaaactgtagctgcacatctgtcttcattcttcccgccatctgtac

SEQ ID NO: 140318 - DNA, 501 bp, Homo sapiens
  misc_feature: GYAE6OF02GQWPP.46.67.G01.1.454.CMB.1.raw
  modified_base (485)..(485): a, c, t, g, unknown or other
  misc_feature (485)..(485): n is a, c, g, or t
tcagactagcagtacacgaccggtgctcgatttagagtatacatattgggtttgggagtctcggtcaggacgcagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatctgggacagatttcactctcaccatcagtaatctgcaacgtgaagattttgactaacttattactgtacaacagaattacaattgtttcggaccaagggacacgactaacaaattaaacgaactgtagctgcaacatctgtcttnatctccgcatctgtac

SEQ ID NO: 140319 - DNA, 503 bp, Homo sapiens
  misc_feature: GYAE6OF02I88LQ.46.67.G01.1.454.CMB.1.raw
tcagactagcagtacacgaccggtgctcgatttagagtatacatattgggtttggggagtctcggtcaggacacagcatggacatgagggtcccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatctgggacagatttcactctcaccatcagtaatctgcaacgtgaagattttgcaacttattactgtcaacagaattacaatgttttcggcctaagggacacgactacaaattaaacgaaactgtaggctagcaccatctgtcttcatcttcccgccatctgtac

SEQ ID NO: 140320 - DNA, 491 bp, Homo sapiens
  misc_feature: GYAE6OF02I2A5V.46.67.G01.1.454.CMB.1.raw
  modified_base (464)..(464): a, c, t, g, unknown or other
  misc_feature (464)..(464): n is a, c, g, or t
  modified_base (474)..(474): a, c, t, g, unknown or other
  misc_feature (474)..(474): n is a, c, g, or t
tcagactagcagtacacgaccggtgctcgatttagagtatacatattgggtttgggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaattggtatcaacatagaccagggacggcccctaagctcctaatctatgctgcatccagtttgcaaagtgggtcccatcgaggttcagtggcagtggatctgggacagatttcactctcaccatcagtaatctgcaacgtgaagattttgcaacttattactgtcaacagaattacaattgtttcggccaaggacacgactacaaattaaacgaatgtgctgcncatctgtctnatcttccgcatctgtac

SEQ ID NO: 140321 - DNA, 498 bp, Homo sapiens
  misc_feature: GYAE6OF02HM7TW.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccaggacggcccctaagctcctaatctatgctgcatccagtttgcaaagtggggtcccatcgaggttcagtggcagtggatctgggacagatttcactctcaccatcagtaatctgcaacgtgaagattttgcaacttattactgttcaacagaattacaatgtttcgacaaggacacgactacaaattaaacgaactagtggctgcaccatctgtcttcatcttccgctatctgtac

SEQ ID NO: 140322 - DNA, 503 bp, Homo sapiens
  misc_feature: GYAE6OF02H7QRW.46.67.G01.1.454.CMB.1.raw
tcagactagcagtacacgaccggtgctcgatttagagtatacatattgggtttggggagtctcggtcaggacacagcatggacatgagggtccccgctcagctcccggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggccctaagctcctaatctatgctgcatccagtttgcaaagtggggtcccatcgaggttcagtggcagtggatctgggacagatttcactctcaccatcagtaatctgcaacgtgaagattttgcaacttattactgtcaacagaattacaatgtttcggccaagggacaacgactaacaaattaaacgaactagtagctgcacatctgtcttcattcttcccgcctatctgatac

SEQ ID NO: 140323 - DNA, 496 bp, Homo sapiens
  misc_feature: GYAE6OF02HWRJZ.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaattggtatcaacatagaccagggacggcccctaagctcctaatctatgctgcatccagtttgcaaagtgggtcccatcgagttcagtggcagtgatctgggacagatttcactctcaccatcagtaatctgcaacgtgaagattttgctaacttattactgtcaacagaattacaatgtttcggccaagggacacgactacaaattaaacgaactgtagctgcaccatctgtcttcatcttccgccatctgtac

SEQ ID NO: 140324 - DNA, 504 bp, Homo sapiens
  misc_feature: GYAE6OF02FRVQI.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatctgggacagatttcactctcaccatcagtaatctgcaacgtgaagattttgtaacttattactgtcaacagaattacaattgttttacggcctaagggacacgactaacaaattaaacgaactgtagctgcaccatctgtcttcatcttccgctatctgatac

SEQ ID NO: 140325 - DNA, 516 bp, Homo sapiens
  misc_feature: GYAE6OF02H2WCE.46.67.G01.1.454.CMB.1.raw
  modified_base (332)..(332): a, c, t, g, unknown or other
  misc_feature (332)..(332): n is a, c, g, or t
  modified_base (503)..(503): a, c, t, g, unknown or other
  misc_feature (503)..(503): n is a, c, g, or t
  modified_base (506)..(506): a, c, t, g, unknown or other
  misc_feature (506)..(506): n is a, c, g, or t
  modified_base (511)..(511): a, c, t, g, unknown or other
  misc_feature (511)..(511): n is a, c, g, or t
  modified_base (515)..(515): a, c, t, g, unknown or other
  misc_feature (515)..(515): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggagggctggaatacattggaagtgtctctcatagtggaggttcctattacagtccgtctctcaagagtcgagtcaccatatctctggacacgtccagcaatcagttttcccngaagatgagttctgtgaccgccgctgacacgggtcgttttattactgtgcgagagacggcttattatgtattttggagtggtttatttcgactacctagatcgacggggctcgacccgtgggccagggatacgtgtcacgtctctagcctcaccaaggccatcgtctcccngcncctcncagnc

SEQ ID NO: 140326 - DNA, 505 bp, Homo sapiens
  misc_feature: GYAE6OF02H5DQH.46.67.G01.1.454.CMB.1.raw
tcagactagcagtacacgaccggtgctcgatttagagtatacatattgggtttggggagtctcggtcaggacacagcatggacatgagggtccccgctcagcgtcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgagttcagtggcagtggatctgggacagatttcactctcaccatcagtaatctgcaacgtgaagattttgcaacttattactgttacaacagaattacaattgtttcggaccaagggacacgactaacaaattaaacgaactgtagctgcaccatctgtcttcatcttcccgcctatctgtac

SEQ ID NO: 140327 - DNA, 497 bp, Homo sapiens
  misc_feature: GYAE6OF02JHQ2X.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctcctaatctatgctgcatccagtttgcaaagtgggtcccatcgaggttcagtggcagtggatcgtgggtacagatttcactctcaccatcagtaatctgcaacgtgaagattttgctaacttattactgtcaacagaattacaatgtttcgacaagggacacgactacaaattaacgaactgtagctgacacatctgtcttcatctcccgcatctgtac

SEQ ID NO: 140328 - DNA, 515 bp, Homo sapiens
  misc_feature: GYAE6OF02H9G7Z.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagacagggacggcccctaagctcctaatctatgctgcatccagtttgcaaagtgggtcccatcgaggttcagtggcagtggatctgggacagatttcactctcaccatcagtaatctgcaacgtgaagtatttgactaacttattactgtcaacagtaattacaatgttttacggaccgaaggacacgaactaacaaattaaacgaactagtagactagcaccatactgtacttcactcttcccgcctactcctgtac

SEQ ID NO: 140329 - DNA, 546 bp, Homo sapiens
  misc_feature: GYAE6OF02I3CW5.46.67.G01.1.454.CMB.1.raw
  modified_base (389)..(389): a, c, t, g, unknown or other
  misc_feature (389)..(389): n is a, c, g, or t
tcagactagcagtacacgaccggtgctcgatttagagtatacatattgggtttgggggacctcctgtgcaagaaccatgaaggcacctgtggtttgtcctcctgctggtggcagcctcccgagactggggtcctgtcccgtggtgcgaactgtcaggagtccgggcccacgactaggtgaggtccttcggaggaccctgtccctcacctgcgctgtcctcgtggtgccctccatcagtagtcggttccttctgggctgggtccgcagctccgagggaagggctggaatacgattggaagtgtctctcatagtggaggttcctattacagtccgtctctcaagagtcgagtcaccatatctctggacacgtccagcaatcagttttcccngaagatgagttctgtgaccgccgctgacacgggctttatactgtgcgagagacgctattatgtatttttggagttggttatttcgactaccctagatcgacggggtctcgacccgtgggccagggactacgtggtcaccgtctccttacgcctaccg

SEQ ID NO: 140330 - DNA, 501 bp, Homo sapiens
  misc_feature: GYAE6OF02IXM55.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagattttgctaacttattactgtacaacagaattacaatgttttcggccaagggacacgactacaaattaaacgaactgtgctgcaccatctgtcttcatcttcccgcatctgtac

SEQ ID NO: 140331 - DNA, 502 bp, Homo sapiens
  misc_feature: GYAE6OF02HEL9Q.46.67.G01.1.454.CMB.1.raw
  modified_base (482)..(482): a, c, t, g, unknown or other
  misc_feature (482)..(482): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccaggacggcccctaagctcctaatctatgctgcatccagtttgcaaagtgggtcccatcgaggttcagtggcagtggatctgggacagatttcactctcaccatcagtaatctgcaacgtgaagattttgctaacttattactgtcaacagtaattacaatgtttcgacctaagggacacgactaacaaattaaacgaactgtgctgacacatctgtcttnactcttcccgctatctgtac

SEQ ID NO: 140332 - DNA, 499 bp, Homo sapiens
  misc_feature: GYAE6OF02INO04.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccaggacggcccctaagctcctaatctatgctgcatccagtttgcaaagtgggtcccatcgagttcagtgcagtggatctgggacagatttcactctcaccatcagtaatctgcaacgtgaagattttgctaacttattactgtacaactagaattacaattgtttcgactaaggacacgactacaaattaaacgaactgtgctagcaacatctgtcttcatcttcccgctatctgtac

SEQ ID NO: 140333 - DNA, 504 bp, Homo sapiens
  misc_feature: GYAE6OF02ITVD9.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagattttgctaacttattactgtcaacagaattacaatgtttcggccaagggacacgactaacaaattaaacgaaactgtaggctgcaccatctgtcttcatcttcccgccattctgtac

SEQ ID NO: 140334 - DNA, 545 bp, Homo sapiens
  misc_feature: GYAE6OF02I66UH.46.67.G01.1.454.CMB.1.raw
  modified_base (333)..(333): a, c, t, g, unknown or other
  misc_feature (333)..(333): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggccgggtccggcagctcccagggaagggctggaatacattggaagtgtctctcatagtggaggttcctattacagtccgtctctcaagagtcgagtcaccatatctctggacacgtccagcaatcagttttcccngaagatgagttctgtgaccgccgctgacacgggctttatactgtgcgagagacgctattatgtattttggagttggttatttcgactaccctagatcgacggggctcgacccgtgggccagggatacgtggtcaccgtctccttagcctccaccacgggcccatccggtccttccccgtcggcccaccctccctaccgacgacgcctacccg

SEQ ID NO: 140335 - DNA, 500 bp, Homo sapiens
  misc_feature: GYAE6OF02GXCRI.46.67.G01.1.454.CMB.1.raw
  modified_base (481)..(481): a, c, t, g, unknown or other
  misc_feature (481)..(481): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaattggtatcaacatagaccaggacggcccctaagctcctaatctatgctgcatccagtttgcaaagtgggtcccatcgaggttcagtggcagtggatctgggacagatttcactctcaccatcagtaatctgcaacgtgaagattttgactaacttattactgtacaacagaattacaatgtttcggacaaggacacgacttaacaaattaaacgaactgtagctgcacatctgtcttnactcttcccgcatctgtac

SEQ ID NO: 140336 - DNA, 502 bp, Homo sapiens
  misc_feature: GYAE6OF02GY9MG.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatctgggacagatttcactctcaccatcagtaatctgcaacgtgaagattttgctaacttattacttgtcaacagaattacaattgtttacggacaagggacacgactacaaattaaacgaactgtgctgcaccatctgtcttcactcttcccgcatctgtac

SEQ ID NO: 140337 - DNA, 549 bp, Homo sapiens
  misc_feature: GYAE6OF02GBOR2.46.67.G01.1.454.CMB.1.raw
  modified_base (334)..(334): a, c, t, g, unknown or other
  misc_feature (334)..(334): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttcccngaagatgagttctgtgaccgcgctgacacgggctttatactgtgcgagagacggctattatgtatttttggagttggttatttcgactacccttagatcgacggggctcgacccgtggggccagggaatacgtggtcaccgtctccttagcctccaccgaacgggccctagtccggtccttccccgtcggcccaccctccctccaacgcgtaccc

SEQ ID NO: 140338 - DNA, 722 bp, Homo sapiens
  misc_feature: GYAE6OF02GH45N.46.67.G01.1.454.CMB.1.raw
  modified_base (175)..(175): a, c, t, g, unknown or other
  misc_feature (175)..(175): n is a, c, g, or t
  modified_base (179)..(179): a, c, t, g, unknown or other
  misc_feature (179)..(179): n is a, c, g, or t
  modified_base (197)..(197): a, c, t, g, unknown or other
  misc_feature (197)..(197): n is a, c, g, or t
  modified_base (232)..(232): a, c, t, g, unknown or other
  misc_feature (232)..(232): n is a, c, g, or t
tcagactagcagtacacgaccggtgctcgatttagagtatacatattgggtttggggagtctcggtcaggacacagcatggacatgagggtcccgctcagctcctggggctcctgctactctggctccgaggtgccagatgtgacatcgagctgacccagtctccatcccctctntctnaccacggtggacacagtnaccactatctactcggccggacacggtacgaactntacgacctacttaatttaagttagtactacaactagtacgaccggacgggacccgtaccctaagtccttaacctaacttactagtcgtcgtcgactacctaccgttaggtttcgaaacgtaaagggggttcccgggtaccctagtacgggttacggttacagggtcggacgtagggtaggtacttcgggtacgggaactagtttacttaccacttcctaccaactatacgtaagttaactcgtcgaacgtaacggtaaggtaaagtttagtttacgaaccttaaactttaacttacgttcgtaacctaaacgtaagttaaacttaaactaagttttacggttttaccggaaccggtaacgggtaacctaacgtaaccttaaacttaaaacgttaaaccgtaacgttaggtacggtacgtacgacctaacctacttcgttacgtttccttactactttcccgttaccccgtactacttacgtagttaaccg

SEQ ID NO: 140339 - DNA, 506 bp, Homo sapiens
  misc_feature: GYAE6OF02I6EZ4.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccaggacggcccctaagctcctaatctatgctgcatccagtttgcaaagtgggtcccatcgaggttcagtggcagtggatctgggacagatttcactctcaccatcagtaatctgcaacgtgaagtatttgactaacttattactgtcaacagtaattacaatgtttcggacctaagggacacgactaacaaattaaacgaactagtgactgacaccatctgtcttcatcttccgccactctgtac

SEQ ID NO: 140340 - DNA, 499 bp, Homo sapiens
  misc_feature: GYAE6OF02H3SVD.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatctgggacagatttcactctcaccatcagtaatctgcaacgtgaagattttgcaacttattactgttcaacagaattacaatgtttacggccaagggacacgactacaaattaaacgaactgtagctgcacatctgtcttcatcttccgccatctgtac

SEQ ID NO: 140341 - DNA, 500 bp, Homo sapiens
  misc_feature: GYAE6OF02IV9JN.46.67.G01.1.454.CMB.1.raw
  modified_base (383)..(383): a, c, t, g, unknown or other
  misc_feature (383)..(383): n is a, c, g, or t
  modified_base (481)..(481): a, c, t, g, unknown or other
  misc_feature (481)..(481): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatctgggacagatttcactctcaccatcagtaatctgcaacgtnaagatttgctaacttattactgtcaacagaattacaatgtttacggccaagggacacgactacaaattaaacgaaactgtagctgcacatctgtcttnatcttcccgcactctgtac

SEQ ID NO: 140342 - DNA, 546 bp, Homo sapiens
  misc_feature: GYAE6OF02IW39T.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctccagggaagggctggaatacattggaagtgtctctcatagtggaggttcctattacagtccgtctctcaagagtcgagtcaccatatctctggacacgtccagcaatcagttttccctgaagatgagttctgtgaccgcgctgacacgggcgtttattactgtgcgagagacggctattatgtattttggagttggttatttcgactaccctagatcggacggggctcgacccgtggggccagggactacgtggtcaccgtctccttagcctccaccgaacgggcccagtccggtccttccccgtcggccacccctccctccacgcgtaccg

SEQ ID NO: 140343 - DNA, 939 bp, Homo sapiens
  misc_feature: GYAE6OF02GBPDS.46.67.G01.1.454.CMB.1.raw
tcagactagcagtacacgaccggtgctcgatttagagtatacatattagggttgggagtacggtcggtcaggacacagcatggacatgaggtcccgctcagcgtccctggggctcctgcctacgtctcggctccgaggtgccgagactggtgaccatcgagctgacccagtctccatccctcctgtcctgcctaaccgtgggagacagtgtcaccatcacttgccgggcaacgtcggaacattgaccgacctaattaaacttggtaatctaacgatagacctaagggtaacggtccccgtaagctaccgtaactactaactaggacctacgacctaactcccgaagttttcgactaaaacggttcgggggttaccccaagttaccggtaacgggtttacgtacggtacgggtacgtacgggttacgggtaacgttcgtacggggtaacgtaggttaacgttttccggaacgtttaccgttaccggtaaccccgttaacggttacccgtaacgggtttaaacctttcccgtttacggtacccttaaaaccgggtttacgttaaaacggttaacgttttttacgggtaacctttaaaaccgttttaacgttttaaacccgtttaacggtttaaccgttaaaaaccgttaaggttttaaaaacttttaaaccgttaaaacgtttttaccgggtttttttaaccgggtaacccgtttaaaacgggggttaaaccctaaacccgggttaaacccgttttaaaaccgttaaaaaaccgttttaaaacccgggtaaacccgtttaacgggtttaacgggttacccgtttaacggtaacccgtaaacccggtaacgtttaacccggttaacggttaccgtttaccgttaaacgtttacccgtttaacccccggtaccctaacgtttacccgttacggttaaaccccg

SEQ ID NO: 140344 - DNA, 497 bp, Homo sapiens
  misc_feature: GYAE6OF02I8OSA.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatctgggacagatttcactctcaccatcagtaatctgcaacgtgaagattttgcaacttattactgtcaacagaattacaatgtttacgcctaaggacacgactacaaattaaacgaactgtagctgcacatctgtcttcatcttcccgcatctgtac

SEQ ID NO: 140345 - DNA, 519 bp, Homo sapiens
  misc_feature: GYAE6OF02H4M5O.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagattttgctaacttattactgtacaacagaaattacaattgttttacggacctaagggacacgaacttacaaattaaagaactagtaggactgacaccattctgttacttcgactcttcccgcattcctatac

SEQ ID NO: 140346 - DNA, 505 bp, Homo sapiens
  misc_feature: GYAE6OF02G7MGL.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagattttgctaacttattactgtacaacagaattacaattgttttcggaccaagggacacgactacaaattaaacgaactgtagctgacaccatctgtcttcatcttccgccatctgtac

SEQ ID NO: 140347 - DNA, 500 bp, Homo sapiens
  misc_feature: GYAE6OF02FNROI.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctcctaatctatgctgcatccagtttgcaaagtgggtcccatcgagttcagtggcagtggatctgggacagatttcactctcaccatcagtaatctgcaacgtgaagattttgctaacttattactgtcaacagaattacaatgtttacggcaagggacacgactaacaaattaaacgaactgtgctagcaaccatctgtcttcactcttcccgcatctgtac

SEQ ID NO: 140348 - DNA, 566 bp, Homo sapiens
  misc_feature: GYAE6OF02F4QYK.46.67.G01.1.454.CMB.1.raw
  modified_base (150)..(150): a, c, t, g, unknown or other
  misc_feature (150)..(150): n is a, c, g, or t
  modified_base (203)..(203): a, c, t, g, unknown or other
  misc_feature (203)..(203): n is a, c, g, or t
  modified_base (275)..(275): a, c, t, g, unknown or other
  misc_feature (275)..(275): n is a, c, g, or t
  modified_base (326)..(326): a, c, t, g, unknown or other
  misc_feature (326)..(326): n is a, c, g, or t
  modified_base (334)..(334): a, c, t, g, unknown or other
  misc_feature (334)..(334): n is a, c, g, or t
tcagactagcagtacacgaccggtgctcgatttagagtatacatattgggtttgtcctcctgctggtggcagctcccagatgggtcctgtccctggtgcaactgcaggatcggcccagactggtgagggccttcggagaccctgtccctnacctgcgctgtctctggtgcctcatcagtagtggttctctgggctgggtccgnagctccagggaggctggaatcattggaatgtctctcatagtggaggttcctattacagtccgtctctcaagngtcgagtcacatatctctggacacgtccagcaatcagtttcccagaacgtntgagttcngtgaccgtcgctagactacgggtctttatacgtgtcgcgtagagtacggtctagttatgtagttttggagttcggttattcggtactacccgttagactcggtacgggtctcgacccgtgggcctagggtaactcgtcggtactacgtctccgtagcctaccgaccgtacgggtccctagtccggttaccgttaccccgtggtacctacccgtcgtaccgacgtcgtacccg

SEQ ID NO: 140349 - DNA, 503 bp, Homo sapiens
  misc_feature: GYAE6OF02JF9G9.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagattttgctaacttattactgtcaacagaattacaatgtttcgctaagggacacgactacaaattaaacgaactgtagctgcaccatctgtcttcacttcttcccgctactctgtac

SEQ ID NO: 140350 - DNA, 514 bp, Homo sapiens
  misc_feature: GYAE6OF02H8KB7.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatctgggacagatttcactctcaccatcagtaatctgcaacgtgaagtatttgactaacttattactgtcaacagaattacaattgttttacggacctaagggacacgaactaactaaaattaaacgaaactgtaggctagacacatctgtcttcattcttcccgctatctgtac

SEQ ID NO: 140351 - DNA, 539 bp, Homo sapiens
  misc_feature: GYAE6OF02JGT4R.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaatggtatcaacatagaccagggacggcccctaagctcctaatctatgctgaatccagtttgcaaagtgggtcccatcgagttcagtggcagtggatctgggacagatttcactctcaccatcagtaatctgcaacgtgaacgtattttgactaacttattactagtcaacagtaattaacaattgttttacgacctaagggactacgtactaactaaattaacgaacttgtaggtctagtacaccattactcgttacttcgtaacttccttacccggcctattcctagtacttaacg

SEQ ID NO: 140352 - DNA, 579 bp, Homo sapiens
  misc_feature: GYAE6OF02HDYHN.46.67.G01.1.454.CMB.1.raw
tcagactagcagtacacgaccggtgctcgatttagagtatacatattgggtttgggggagtctcggtcaggacacagcatggacatgacgggtccccgctcagctcctggggctcctgctactctggctccgaggtgccagatgtgacatcgagctgacccagtctccatcctcccttgtctgcgaaccgtgggagacagtgtcaccatcgacttgccgggcaagtcggaacattgacacctatttaaattggtatcaacatagaccaggcggcccctaagctcctaatctatgctgcatccagtttgcaagtcgggtcccagtcgaggttcagtggcagtggatcgtgggactaggatttcgacttctcacctatcagtaatctagacaacgtgaagtacttttagactaacttattacttgttactaacagtaattacaattcgttttcggacctaagggtacctaacggtacttaactaaacttaaacggtaactagtacggtactaggaccgtaaccgtattaccgtagttaccttactaacttccgtttaccccggccttacttcctaggtaac

SEQ ID NO: 140353 - DNA, 500 bp, Homo sapiens
  misc_feature: GYAE6OF02H6L42.46.67.G01.1.454.CMB.1.raw
  modified_base (482)..(482): a, c, t, g, unknown or other
  misc_feature (482)..(482): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccaggacgcccctaagctcctaatctatgctgcatccagtttgcaaagtggggtcccatcgaggttcagtggcagtggatctgggacagatttcactctcaccatcagtaatctgcaacgtgaagattttgcaacttattactgtcaactagaattacaattgttttcggaccaagggacacgactaacaaataaacgaactagtgctgcacatctgtcttnatcttccgccatctgtac

SEQ ID NO: 140354 - DNA, 505 bp, Homo sapiens
  misc_feature: GYAE6OF02HQP85.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagattttgcaacttatactgtcaacagaattacaatgtttacgccaagggacacgactaacaaattaaacgaactagtgactgacacatctgtcttctactcttcccgcctactctgtac

SEQ ID NO: 140355 - DNA, 533 bp, Homo sapiens
  misc_feature: GYAE6OF02GCS3N.46.67.G01.1.454.CMB.1.raw
  modified_base (372)..(372): a, c, t, g, unknown or other
  misc_feature (372)..(372): n is a, c, g, or t
  modified_base (377)..(377): a, c, t, g, unknown or other
  misc_feature (377)..(377): n is a, c, g, or t
tcagactagcagtacacgaccggtgctcgatttagagtatacatattgggtttggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctcatcagtagtggtttcttctggggctgggtccggcagcctccagggaaggggctggaatacattggaagtgtctctcatagtggaggttcctattacagtccgtctctcaagagtcgagtcaccatatctctggacacgtccagcaatcagttttcccngaagntgagttctgtgaccgccgctgacacgggctttatactgtgcgagagacggctattatgatttttggagttggttatttcgactaccctagactcgacggggctcggaccccgtggggccagggaatacgtcggtcaccgtctccttagccctaccg

SEQ ID NO: 140356 - DNA, 523 bp, Homo sapiens
  misc_feature: GYAE6OF02H2L9C.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatctgggacagatttcactctcaccatcagtaatctgcaacgtgaagtattttgacaacttattactgttacaacagtaaattacaaattgttttacggacctaagggacaacgaacttaacaaattaaacgaactagtgactgcacctatctagttcttcactccttcccgtcctatctgtac

SEQ ID NO: 140357 - DNA, 496 bp, Homo sapiens
  misc_feature: GYAE6OF02GYJ0B.46.67.G01.1.454.CMB.1.raw
  modified_base (479)..(479): a, c, t, g, unknown or other
  misc_feature (479)..(479): n is a, c, g, or t
tcagactagcagtacacgaccggtgctcgatttagagtatacatattgggtttgggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatctgggacagatttcactctcaccatcagtaatctgcaacgtgaagattttgcaacttattactgtcaacagaattacaatgttttcggccaagggacacgactacaaattaaacgaactgtagctgcacatctgtcttnatcttccgcatctgtac

SEQ ID NO: 140358 - DNA, 511 bp, Homo sapiens
  misc_feature: GYAE6OF02I4XK2.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagtattttgactaacttattactgtacaacagaattacaattgtttcggaccaagggacaacgtactaactaaattaaacgaactgtagctagcacatctgtcttcactcttccgctactctgtac

SEQ ID NO: 140359 - DNA, 505 bp, Homo sapiens
  misc_feature: GYAE6OF02ICW5J.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaattggtatcaacatagaccagggacgcccctaagctcctaatctatgctgcatccagtttgcaaagtgggtccatcgagttcagtggcagtgatctgggacagatttcactctcaccatcagtaatctgcaacgtgaaagtattttgctaacttattactgtcaacagaattaacaattgttttacggacctaagggacacgactaacaaattaaacgaactgtagctgcaccatctgttctcatcttcccgccatctgtaac

SEQ ID NO: 140360 - DNA, 515 bp, Homo sapiens
  misc_feature: GYAE6OF02I67BP.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagtattttgctaacttattactgtacaacagtaattacaattgtttcggacctaagggacacgtactaacaaattaaacgaactagtaggctagcacatactgtcttcacttccttcccgccatctgtac

SEQ ID NO: 140361 - DNA, 498 bp, Homo sapiens
  misc_feature: GYAE6OF02G13R8.46.67.G01.1.454.CMB.1.raw
  modified_base (480)..(480): a, c, t, g, unknown or other
  misc_feature (480)..(480): n is a, c, g, or t
  modified_base (494)..(494): a, c, t, g, unknown or other
  misc_feature (494)..(494): n is a, c, g, or t
tcagactagcagtacacgaccggtgctcgatttagagtatacatattgggtttgggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatctgggacagatttcactctcaccatcagtaatctgcaacgtgaagattttgcaacttattacttgtcaacagaattacaatgttttcgccaagggacacgactacaaattaaacgaactgtagctgcaccatctgtcttnatcttccgccatcngtac

SEQ ID NO: 140362 - DNA, 496 bp, Homo sapiens
  misc_feature: GYAE6OF02IONU7.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctcctaatctatgctgcatccagtttgcaaagtgggtcccatcgaggttcagtggcagtgatctgggacagatttcactctcaccatcagtaatctgcaacgtgaagtattttgtaacttattactgtacaacagaattacaatgtttcgcaagggacacgactacaaattaacgaactgtagctgacacatctgtcttcatcttccgccatctgatac

SEQ ID NO: 140363 - DNA, 512 bp, Homo sapiens
  misc_feature: GYAE6OF02HNV49.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatccgagctgacccagtctccatcctccctgtctgcaaccgtgggagacagtgtcaccatcacttgccgggcaagtcggaacattgacacctatttaaatggtatcaacatagaccagggacggcccctaagctcctaatctatgctgcatccagtttgcaaagtgggtcccatcgaggttcagtggcagtggatctgggacagatttcactctcaccatcagtaatctgcaacgtgaagtattttgctaacttattactgttcaactagaaattacaattgttttcggacctaagggacacgactacaaattaaacgaacttgtaggctgcaacatctgtcttcattcttcccgccatctgtaac

SEQ ID NO: 140364 - DNA, 518 bp, Homo sapiens
  misc_feature: GYAE6OF02HGPJ7.46.67.G01.1.454.CMB.1.raw
  modified_base (396)..(396): a, c, t, g, unknown or other
  misc_feature (396)..(396): n is a, c, g, or t
  modified_base (515)..(515): a, c, t, g, unknown or other
  misc_feature (515)..(515): n is a, c, g, or t
tcagactagcagtacacgaccggtgctcgatttagagtatacatattggggtttggggagtctcggtcaggacacagcatggacatgagggtccccgctcagctcctggggctcctgctactctggctccgaggtgccagatggtgacatcgagctgacccagtctccatcctccctgtctgcaaccgtgggagacagtgtcaccatcacttgccgggcaagtcggaacattgactacctatttaaattggtatcaacatagaccagggacggcccctaaggctcctaatctatgactgcatccagtttgcaaagtgggtcccagtcgaggttcagtggcagtggatcgtgggacagtatttcactctcaccatcagtaatctgcaacgtgaagtntttgctaattattacttgtacaatagaattacaattgtttacgacctaagggacacgtactaactaaattaaacgaactgtgactgacaactatctgtcttcactccttccgctatctntac

SEQ ID NO: 140365 - DNA, 546 bp, Homo sapiens
  misc_feature: GYAE6OF02GP6MP.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctatttacagtccgtctctcaagagtcgagtcaccatatctctggacacgtccagcaatcagttttccctgaagatgagttctgtgaccgcgctgacacgggctttattactgtgcgagagacggctattatgtatttttggagttggttatttcgactaccctagatcgacggggctcgaccctggggccagggaatacgtggtcaccgtctccttagcctccaccgaacgggcccacgtccggtccttccccgtcggccacccctcctccacgacgccc

SEQ ID NO: 140366 - DNA, 497 bp, Homo sapiens
  misc_feature: GYAE6OF02I1FVF.46.67.G01.1.454.CMB.1.raw
  modified_base (478)..(478): a, c, t, g, unknown or other
  misc_feature (478)..(478): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccaggacggcccctaagctcctaatctatgctgcatccagtttgcaaagtgggtcccatcgaggttcagtggcagtggatctgggacagatttcactctcaccatcagtaatctgcaacgtgaagattttgctaacttattactgtacaacagaattacaatgtttcgaccaagggacacgactacaaattaaacgaactgtgctgcacatctgtcttnactcttccgctatctgtac

SEQ ID NO: 140367 - DNA, 500 bp, Homo sapiens
  misc_feature: GYAE6OF02I1SD1.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaattggtatcaacatagaccagggacggcccctaagctcctaatctatgctgcatccagtttgcaaagtgggtcccatcgaggttcagtggcagtggatctgggacagatttcactctcaccatcagtatctgcaagtgaagtatttgactaacttattactgtcaacagtaattacaattgtttcgacaagggacacgactaacaaagttaacgaactgtgctgacacatctgtcttcatccttaccgctatctgtac

SEQ ID NO: 140368 - DNA, 547 bp, Homo sapiens
  misc_feature: GYAE6OF02IJPE7.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggttttcttctggggctgggtccggcagctcccgagggaaggggctggaatacattggaagtgtctctcatagtggaggttcctattacagtccgtctctcaagagtcgagtcaccatatctctggacacgtccagcaaatcagttttccctgaagatgagtttctgtgaccgccgctgacacgggtcgtttattactgttgcgagagacggctattattgtagtttttggagttggtttatttcgtactacctagatcggacggggctcggacccctggggccgagggatacgtggtcaccgtcctccttacgcctacccg

SEQ ID NO: 140369 - DNA, 506 bp, Homo sapiens
  misc_feature: GYAE6OF02FYM70.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagattttgctaacttattacttgtcaacagaattacaatgttttcggacaagggacacgactaacaaattaaacgaactagtgctgctaaccatctgtcttcatcttcccgccatctgtac

SEQ ID NO: 140370 - DNA, 504 bp, Homo sapiens
  misc_feature: GYAE6OF02J1ZPN.46.67.G01.1.454.CMB.1.raw
  modified_base (478)..(478): a, c, t, g, unknown or other
  misc_feature (478)..(478): n is a, c, g, or t
  modified_base (485)..(485): a, c, t, g, unknown or other
  misc_feature (485)..(485): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatctgggacagatttcactctcaccatcagtaatctgcaacgtgaagattttgctaacttatactgtcaacagaattacaattgtttacggacctaagggacacgactaacaaattaaacgaactgtgactgcaacatntgtcttnacttctccgcactctgtac

SEQ ID NO: 140371 - DNA, 535 bp, Homo sapiens
  misc_feature: GYAE6OF02INU7F.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacactatttaaattgtatcaacatagaccaggacggcccctaagctcctaatctatgctgcatccagtttgcaaagtgggtccatcgaggttcagtgcagtgatctgggacagatttcactctcaccatcagtaatctgacaacgtgaagtattttgactaacttattactgtacaactagtaattacaagttgtttacggaccgtaaggacaacgtaactaactaaacttaaacgaacgtgtaggactagcaacctatacttacgtctttacacttccttacccgtacctacttacctgtaac

SEQ ID NO: 140372 - DNA, 496 bp, Homo sapiens
  misc_feature: GYAE6OF02IRB30.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccaggacggcccctaagctcctaatctatgctgcatccagtttgcaaagtgggtcccatcgagttcagtggcagtggatctgggacagatttcactctcaccatcagtaatctgcaacgtgaagtatttgctaacttattactgtacaacataattacaattgtttcggaccaagggacacgactacaaattaacgaatgtaggctgcacatctgtcttcatctccgcatctgtac

SEQ ID NO: 140373 - DNA, 666 bp, Homo sapiens
  misc_feature: GYAE6OF02FEHD5.46.67.G01.1.454.CMB.1.raw
  modified_base (191)..(191): a, c, t, g, unknown or other
  misc_feature (191)..(191): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccggtgganacagtgtcaccatccacgttcggccgggacaaggtcgaactattacgactaccttaatttaagtgtatacaacagtacgaccgagggaccgaccctaagcctactaatctatcgctgactacgtaccgtagtttacgacgtaacggtcgggtacccagtcgtaggttcaggtgcgtaggtcgatcgtaggactagttacttacactcgtacacctatacgtaagttaactcgtacgtactaaacggttagtaaagtttactttacgaaccttaacttaacttacgtacgtaacctaaacgtaagttaacttaacgtacgtttacggttaccgaacgtaaacgtaacctaacgtaaacttaaacgtaaacttaaacgtcgttacggtacgtacctacgtaccgtaactacttcccgttacttaccctttaccgtaccgtttcccgttaacccgtcttacttacgttacgttaaccg

SEQ ID NO: 140374 - DNA, 497 bp, Homo sapiens
  misc_feature: GYAE6OF02FVZVL.46.67.G01.1.454.CMB.1.raw
  modified_base (493)..(493): a, c, t, g, unknown or other
  misc_feature (493)..(493): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaattggtatcaacatagaccagggacggcccctaagctcctaatctatgctgcatccagtttgcaaagtgggtcccatcgaggttcagtggcagtggatctgggacagatttcactctcaccatcagtaatctgcaacgtgaagattttgcaacttattactgtcaacagaattacaatgttttcggccaagggacacgactacaaattaaacgaactagtagctgcacatctgtcttcatcttccgcatcngtac

SEQ ID NO: 140375 - DNA, 540 bp, Homo sapiens
  misc_feature: GYAE6OF02JFPFW.46.67.G01.1.454.CMB.1.raw
  modified_base (143)..(143): a, c, t, g, unknown or other
  misc_feature (143)..(143): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgngacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgtaaagtgggtcccatcgaggttcagtggcagtggatctgggacagatttcactctcaccatcagtaatctgcaacgtgaagtatttgactaacttattacttgtacaacagtaattaactaattcgttttacggacctaagggacacgaactaacaaattaaacgtaactagtaggtactgacaaccattactcgtcttactacttccttcccgtacctacttctagtacttacg

SEQ ID NO: 140376 - DNA, 506 bp, Homo sapiens
  misc_feature: GYAE6OF02IXJBU.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagattttgcaacttattactgtcaacagaattacaattgttttcggcctaagggacacgaactaaaaattaaacgaactagtagctagcacatctgtcttcatctcccgccatctgatacg

SEQ ID NO: 140377 - DNA, 554 bp, Homo sapiens
  misc_feature: GYAE6OF02JYHO7.46.67.G01.1.454.CMB.1.raw
  modified_base (390)..(390): a, c, t, g, unknown or other
  misc_feature (390)..(390): n is a, c, g, or t
tcagactagcagtacacgaccggtgctcgatttagagtatacatattgggtttggggtagtctcggtcaggacacagcatggacatgagggtccccgctcagctcctggggctcctgctactctggctccgaggtgccagatgtgacatcgagctgacccagtctccatcctccctgtctgcaaccgtggagacagtgtcaccatcacttgccgggcaagtcggaacattgacactatttaaactggtatcaacatagacaggacgcccctaagctctaatctatagctgcatccagtttgctaaagtcgggtacccatcgaggttcagtggcagtggatctgggacagtatttcacgtctcaccatcagtaactctgacacgtagaatntttagactaacttattactgttacaactagtaaattaccaattacgttttcgacctaagggtacacgtaacttaactaacgttaaacgaactagtacgtatcgaactacccgtaattccgtaagttaccttacaactcctttacccgacctattccgtataacg

SEQ ID NO: 140378 - DNA, 499 bp, Homo sapiens
  misc_feature: GYAE6OF02H6QR6.46.67.G01.1.454.CMB.1.raw
  modified_base (406)..(406): a, c, t, g, unknown or other
  misc_feature (406)..(406): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtccatcgaggttcagtggcagtgatctgggacagattcactctcacatcagtaatctgcaacgtgaagtatttgctaacttattactgtcaanagtaatacaattgttttcggactaaggacacgaactaacaaattaaacgaactagtagactagcacatctgtctctatctccgcactctgtac

SEQ ID NO: 140379 - DNA, 507 bp, Homo sapiens
  misc_feature: GYAE6OF02JAHES.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagtattttgactaacttattactgtacaacagaattacaattgtttcgcctaagggacacgactacaaattaaacgaactgtgctgcacatctagtcttacactccttcccgcctatctgtac

SEQ ID NO: 140380 - DNA, 503 bp, Homo sapiens
  misc_feature: GYAE6OF02FN6FA.46.67.G01.1.454.CMB.1.raw
  modified_base (485)..(485): a, c, t, g, unknown or other
  misc_feature (485)..(485): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatctgggacagatttcactctcaccatcagtaatctgcaacgtgaagattttgcaacttattactgtcaacagaattacaattgttttcggacctaagggacaacgactaacaaattaaacgaactgtggctgcacatctgtcttnatcttcccgcatctgtac

SEQ ID NO: 140381 - DNA, 555 bp, Homo sapiens
  misc_feature: GYAE6OF02GMK99.46.67.G01.1.454.CMB.1.raw
  modified_base (299)..(299): a, c, t, g, unknown or other
  misc_feature (299)..(299): n is a, c, g, or t
  modified_base (552)..(552): a, c, t, g, unknown or other
  misc_feature (552)..(552): n is a, c, g, or t
tcagactagcagtacacgaccggtgctcgatttagagtatacatattgggtttcgtacctcctcgctgggtggcacgctcccagatgggtcctgtccctggtgcaactgcaggagtcgggcccacgtactgggtgaggccttcggagaccctgtccctcacctgcgctgtctctggtgcctccatcagtagtggtttcttctggggctggggtccgcagctcccgagggaagggctggaatacattggaagtgttctctcattagtggaggtttccgtattacagtccgtctctcaagngttcgagtcaccagtatctctggacacgtccagcaatcagttttccccagaagatgagttctagtcgaccgccgctgacaccgggtcgttttatactgtgcgagagacgctattatgtattttggagttggttatttcgacgacctagatcggacgggtctcggaccctggggccgagggatacgtgtcacgtctctagcctccgactaggcccacgtcggtccttcccgtcgcctaccctccgtccacgacnccg

SEQ ID NO: 140382 - DNA, 512 bp, Homo sapiens
  misc_feature: GYAE6OF02IN9XL.46.67.G01.1.454.CMB.1.raw
  modified_base (487)..(487): a, c, t, g, unknown or other
  misc_feature (487)..(487): n is a, c, g, or t
  modified_base (492)..(492): a, c, t, g, unknown or other
  misc_feature (492)..(492): n is a, c, g, or t
  modified_base (509)..(509): a, c, t, g, unknown or other
  misc_feature (509)..(509): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaatggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagtatttgctaacttattacttgtacaacagtaattacaattgttttacggacctaagggacacgaactaacaaaattaaacgaaactgtaggctgacacatctntcttnacttcttcccgcatctntac

SEQ ID NO: 140383 - DNA, 544 bp, Homo sapiens
  misc_feature: GYAE6OF02JZ731.46.67.G01.1.454.CMB.1.raw
  modified_base (378)..(378): a, c, t, g, unknown or other
  misc_feature (378)..(378): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcgggagacccctgtccctcacctgcgctgtctctggtgcctccatcagtagtggttcttctggggctggggtccggcagcctcccgagggaaggggctggaatacattggaagtgtctctcatagtggaggttcctattacagtccgtctctcaagagtcgagtcaccatatctctggacacgtccagcaatcagttttcccngaagatgagtttctgtgaccgccgctgacacgggtcgtttattactgtgcgagagacggctattatgatttttggagttggttatttcgactaccctgatcggtacggggctcggaccccgtgggccgagggactacgtggtccaccgttctccttagccctaccg

SEQ ID NO: 140384 - DNA, 549 bp, Homo sapiens
  misc_feature: GYAE6OF02I4CX2.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctcctaatctatgctgcatccagtttgcaaagtgggtcccatcgaggttcagtggcagtggatcgtagggacagtatttcgactctcaccatcagtaatctgacaacgtgaagtattttgactaatttattacttgtacaaacagtaaattactaagttcgttttcggaccaaagggtacaacgaacttaacgaaaattaaacgaactagtacgacttagaccactaatcgttagtacttacactttccgttacccgacctacttctagtac

SEQ ID NO: 140385 - DNA, 542 bp, Homo sapiens
  misc_feature: GYAE6OF02GLOPH.46.67.G01.1.454.CMB.1.raw
  modified_base (328)..(328): a, c, t, g, unknown or other
  misc_feature (328)..(328): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagngtcgagtcaccatatctctggacacgtccagcaatctagttttccctagaagatgagttctgtcgaccgccgctgacgacgggtcgtttatacgtgtgcgagagacgctattatgtattttggagttggttatttcgactaccgtagagtcggacggggctccggacccgtgggccgagggactacgtcgtcaccgtctccgttagcctacccg

SEQ ID NO: 140386 - DNA, 539 bp, Homo sapiens
  misc_feature: GYAE6OF02IB66W.46.67.G01.1.454.CMB.1.raw
  modified_base (331)..(331): a, c, t, g, unknown or other
  misc_feature (331)..(331): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggagggctggatacattggaagtgtctctcatagtggaggttcctattacagtccgtctctcaagagtcgagtcaccatatctctggacacgtccagcaatcagttttcccngaagatgagttctgtgaccgccgctgacacgggtcgtttattactgtgcgagagacggctattatgtattttggagttggttatttcgactaccctagatcggacggggctcgacccgtgggcccagggatacgtgtcaccgtctccttagcctccaccgaacgggcccagtccggtccttccccgtggccaccctcctccacgcacc

SEQ ID NO: 140387 - DNA, 500 bp, Homo sapiens
  misc_feature: GYAE6OF02G5SXN.46.67.G01.1.454.CMB.1.raw
  modified_base (387)..(387): a, c, t, g, unknown or other
  misc_feature (387)..(387): n is a, c, g, or t
  modified_base (411)..(411): a, c, t, g, unknown or other
  misc_feature (411)..(411): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccaggacggcccctaagctcctaatctatgctgcatccagtttgcaaagtgggtcccatcgaggttcagtggcagtggatctgggacagatttcactctcaccatcagtaatctgcaacgtgaaagnttttgctaacttatactgtcaacngaaattacaatgtttacggccaagggacacgactacaaattaaacgaatgtagctagcacatctgtcttcatcttccgcctatctgtac

SEQ ID NO: 140388 - DNA, 527 bp, Homo sapiens
  misc_feature: GYAE6OF02GF689.46.67.G01.1.454.CMB.1.raw
  modified_base (401)..(401): a, c, t, g, unknown or other
  misc_feature (401)..(401): n is a, c, g, or t
tcagactagcagtacacgaccggtgctcgatttagagtatacatattgggtttgggggagtctcggttcaggacacagcatggacatgagggtccccgctcaagctcctggggctcctgctactctggctccgaggtgccagatgtggacatccgagctgacccagtctccatcctccctggtcctgcaaccgtgggagtacagtcgtcacccatcacttgccgggcaagtcggaacattgacacctatttaaatggtatcaactatagaccgagggacggcccctaagcctacctaactcgtagtgctgcatccgagtttgcaaagtgggtcccagtcgagttcagtggcagtgatctgggacagattcactctcacatcagtaatctgctaacgtgaantttgctaacttattactgtacaacagaattacaattgtttcgactaaggactacgaactaacaaattaaacgaacgtagtaggctgacacgatcgtagtcttcacttccttcccgcactctgtaac

SEQ ID NO: 140389 - DNA, 497 bp, Homo sapiens
  misc_feature: GYAE6OF02HEVH9.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccaggacggcccctaagctcctaatctatgctgcatccagtttgcaaagtgggtcccatcgaggttcagtggcagtggatctgggacagatttcactctcaccatcagtaatctgcaacgtgaagtattttgctaacttattactgtcaacagaattacaatgtttcgacaagggacacgactacaaataaacgaactagtgctgcacatctgtcttcatcttcccgccatctgtac

SEQ ID NO: 140390 - DNA, 537 bp, Homo sapiens
  misc_feature: GYAE6OF02FWJE1.46.67.G01.1.454.CMB.1.raw
  modified_base (333)..(333): a, c, t, g, unknown or other
  misc_feature (333)..(333): n is a, c, g, or t
  modified_base (361)..(361): a, c, t, g, unknown or other
  misc_feature (361)..(361): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaagggctggaatacattggaagtgtctctcatagtggaggttcctattacagtccgtctctcaagagtcgagtcaccatatctctggacacgtccagcaatcagttttcccngaagatgagttctgtgaccgcgctgacncgggctttatactgtgcgagagacggctattatgtattttggagttggttatttcgacacctagatcgacggggctcgaccccgtggggccagggatacgtggtccaccgtctccttagcctccaccgaacggcccagtccgtcttcccccgtggccaccctcctccacgacgccg

SEQ ID NO: 140391 - DNA, 530 bp, Homo sapiens
  misc_feature: GYAE6OF02F554B.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccgcagctccagggagggctggaatacattggaagtgtctctcatagtggaggttcctattacagtccgtctctcaagagtcgagtcaccatatctctggacacgtccagcaatcagttttccctgaagatgagttctgtgaccgccgctgacacgggcgtttatactgtgcgagagacggctattatgtatttttggagttggttatttcgactaccctagatcgacggggctcggaccctggggccgagggaatacgtggtcaccgtctccttagcctacccg

SEQ ID NO: 140392 - DNA, 517 bp, Homo sapiens
  misc_feature: GYAE6OF02HT3WV.46.67.G01.1.454.CMB.1.raw
  modified_base (489)..(489): a, c, t, g, unknown or other
  misc_feature (489)..(489): n is a, c, g, or t
  modified_base (514)..(514): a, c, t, g, unknown or other
  misc_feature (514)..(514): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatcgtgggacagatttcactctcaccatcagtaatctgcaacgtgaagtattttgactaacttattacttgtacaactagtaattacaattgtttacgactaagggacacgactaacaaattaaacgaactgtagctgacaacctatctntacttctactcttcccgcctatctntac

SEQ ID NO: 140393 - DNA, 502 bp, Homo sapiens
  misc_feature: GYAE6OF02HRXEF.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccaggacgcccctaagctcctaatctatgctgcatccagtttgcaaagtgggtcccatcgagttcagtgcagtgatctgggacagatttcactctcaccatcagtaatctgcaacgtgaagattttgctaacttattactgtacaacagtaattacaatgtttcggaccaagggacacgaactaacaaattaaacgaactgtagctgacacatctagtcttcacttctcccgctatctgtac

SEQ ID NO: 140394 - DNA, 533 bp, Homo sapiens
  misc_feature: GYAE6OF02JRY0E.46.67.G01.1.454.CMB.1.raw
  modified_base (521)..(521): a, c, t, g, unknown or other
  misc_feature (521)..(521): n is a, c, g, or t
tcagactagcagtacacgaccggtgctcgatttagagtatacatattgggtttggggagtctcggtcaggacacagcatggacatgagggtccccgcctcagctcctggggctcctgctactctggctccgaggtgccagatgtgacatcgagctgacccagtctccatcctccctgtctgcaaccgtgggagacagtgtcaccatcacttgccggcaagtcggaacattgacacctatttaaactggtaatcaacattagacctagggacgcccctaagctcctaatctatgctgcatccagtttgcaaagtgggtcccatcgaggttcaggtgcagtggatcgtgggacaggatttcacgtctactaccatcagtaactctagactaacgtgaagtatttagactaacttattacttgtacaactagtaattacaattgtttacgactaaggactacgtacttaactaaattaaacgaactagtagacttagactacgatctacgtcttcgatctaccnctactctagtac

SEQ ID NO: 140395 - DNA, 549 bp, Homo sapiens
  misc_feature: GYAE6OF02I5M19.46.67.G01.1.454.CMB.1.raw
  modified_base (334)..(334): a, c, t, g, unknown or other
  misc_feature (334)..(334): n is a, c, g, or t
  modified_base (394)..(394): a, c, t, g, unknown or other
  misc_feature (394)..(394): n is a, c, g, or t
  modified_base (435)..(435): a, c, t, g, unknown or other
  misc_feature (435)..(435): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttcccngaagatgagttctgtgaccgccgctggacacgggcgttttattactgtgcgagagacggntattatgtatttttggagttggttatttcgactaccctagntcgacggggctcggacccgtggggccagggaactcgtggtcaccgttctcttacgcctccaccgacggcccagtccggtccttccccgtggccctaccctccctccagacgccg

SEQ ID NO: 140396 - DNA, 528 bp, Homo sapiens
  misc_feature: GYAE6OF02IYJL9.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccgcagctcccagggaggggctggaatacattggaagtgtctctcatagtggaggttcctattacagtccgtctctcaagagtcgagtcaccatatctctggacacgtccagcaatcagttttccctgaagatgagttctgtgaccgccgctgacacgggcgtttattactgtgcgagagacggctattatgtatttttggagttggttatttcgactacctagatcgacggggctcggacccgtgggccagggatacgtggtcaccgtctccttagcctacc

SEQ ID NO: 140397 - DNA, 578 bp, Homo sapiens
  misc_feature: GYAE6OF02GQ78T.46.67.G01.1.454.CMB.1.raw
  modified_base (334)..(334): a, c, t, g, unknown or other
  misc_feature (334)..(334): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttcccngaagatgagttctgtgaccgccgctgacacgggctttatactgtgcgagagacggctattagtgtatttttggagttggttatttcgactacccgtagactcggtacggggcctcggaccccgtggggcccaggggaactacgtggtccaccgtctccgttagccctccgaccgaacgggtcccacgttcccggtaccttcccccgtcggccctaccccttcccgtacccaacgtacgtacccg

SEQ ID NO: 140398 - DNA, 556 bp, Homo sapiens
  misc_feature: GYAE6OF02JZ13E.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctcctaatctatgctgcatccagtttgcaaagtgggtccatcgaggttcagtggcagtggatctgggacaggatttcactctcaccatcagtaatctgcaacgtgaagtagttttgactaactttattactgttacaaactagaattgacctaaagttcgttttacggacctaaaggggtaccaacggtaccttaacaaaacttaaacgaacgttagtgtacttagcctaacctacttcgtagttccttactacttccttacccgcccgtatcttaacg

SEQ ID NO: 140399 - DNA, 497 bp, Homo sapiens
  misc_feature: GYAE6OF02FNZ7U.46.67.G01.1.454.CMB.1.raw
  modified_base (461)..(461): a, c, t, g, unknown or other
  misc_feature (461)..(461): n is a, c, g, or t
tcagactagcagtacacgaccggtgctcgatttagagtatacatattgggtttggggagtctcggtcaggacacagcatggacatgagggtcccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagattttgcaacttattactgtcaacagaattacaatgtttacggcaagggacacgactacaaattaaacgaactgngctgcaccatctgtcttcatcttcccgcatctgtac

SEQ ID NO: 140400 - DNA, 549 bp, Homo sapiens
  misc_feature: GYAE6OF02H4ZQA.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacacctatttaaaattggtatcaacatagaccagggacggcccctaagctcctaatctatgctgcatccagtttgcaaaagtgggtcccatcgaggttcagtggcagtgatctgggacagatttcaactctcaccatcagtaatctgacaacgtgaaagtattttgactaatttattacttgtacaacagtaattacaaattgtttacgacctaagggaacacgtaacttaaactaaattaaaacgaacttagtaggactagaccactaattctacgtttacttactacttccttcccgtacctaacttcctagtaac

SEQ ID NO: 140401 - DNA, 507 bp, Homo sapiens
  misc_feature: GYAE6OF02GILSP.46.67.G01.1.454.CMB.1.raw
  modified_base (496)..(496): a, c, t, g, unknown or other
  misc_feature (496)..(496): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctcctaatctatgctgcatccagtttgcaaagtgggtcccatcgaggttcagtggcagtgatctgggacagatttcactctcaccatcagtaatctgcaacgtgaagtatttgactaacttattactgtacaactagaattacaattgtttcgactaagggactacgactacaaattaaacgaactagtagtctagacacatctgttcttcatcttccncctatctgtac

SEQ ID NO: 140402 - DNA, 515 bp, Homo sapiens
  misc_feature: GYAE6OF02IR14T.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtgcagtggatctgggacagatttcactctcaccatcagtaatctgcaacgtgaagattttgactaacttattacttgtacaacagaattacaattgtttcgaccaagggacaacgactaacaaacttaaacgaacgtagtacggctagcaccatactgtcttctactcttcccgccattctgtac

SEQ ID NO: 140403 - DNA, 509 bp, Homo sapiens
  misc_feature: GYAE6OF02GZMPS.46.67.G01.1.454.CMB.1.raw
  modified_base (305)..(305): a, c, t, g, unknown or other
  misc_feature (305)..(305): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttncaaagtgggtcccatcgaggttcagtggcagtggatctgggacagatttcactctcaccatcagtaatctgcaacgtgaagattttgcaacttattactgtcaacagaaattacaatgttttcggacaagggacacgactacaaattaaacgaactgaggtctgcaccaatctagttcttcatccttcccgccaatctagtaac

SEQ ID NO: 140404 - DNA, 501 bp, Homo sapiens
  misc_feature: GYAE6OF02FINH4.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccccctaagctcctaatctatgctgcatccagtttgcaaagtggggtcccatcgaggttcagtggcagtggatctgggacagatttcactctcaccatcagtaatctgcaacgtgaagattttgcaacttattactgtcaacagaattacaattgttttcgcaagggacacgactacaaattaaacgaactgtgctgcaccatctgtcttcatcttcccgccactctgtac

SEQ ID NO: 140405 - DNA, 539 bp, Homo sapiens
  misc_feature: GYAE6OF02I1A0Z.46.67.G01.1.454.CMB.1.raw
  modified_base (374)..(374): a, c, t, g, unknown or other
  misc_feature (374)..(374): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactacaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttcccngaagatgagttctgtgaccgccgctgacacgggtcgtttattactgtgcgagagacggctattatgtattttggagttggttatttcgactaccctagatcgacggggctcggacccgtggggccagggaactacgtggtcaccgtctccttacgccctccaccg

SEQ ID NO: 140406 - DNA, 500 bp, Homo sapiens
  misc_feature: GYAE6OF02IQMKW.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatctgggacagatttcactctcaccatcagtaatctgcaacgtgaagtatttgcaacttattactgtcaacagaattacaatgtttcgcaagggacacgactaacaaattaaacgaactgtagctagcaccatctgtcttcactcttcccgccatctgtac

SEQ ID NO: 140407 - DNA, 532 bp, Homo sapiens
  misc_feature: GYAE6OF02IU9BR.46.67.G01.1.454.CMB.1.raw
  modified_base (332)..(332): a, c, t, g, unknown or other
  misc_feature (332)..(332): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggagggctggaatacattggaagtgtctctcatagtggaggttcctattacagtccgtctctcaagagtcgagtcaccatatctctggacacgtccagcaatcagttttcccngaagatgagttctgtgaccgccgctgacacgggcttttatactgtgcgagagacggctattatgtattttggagttggttatttcgactaccctagatcggacggggctcgacccgtggggccagggatactggtcacgtctcctagcctccacgaacggcccagtccggtcttccccgtggccaccctcctccagcgcc

SEQ ID NO: 140408 - DNA, 496 bp, Homo sapiens
  misc_feature: GYAE6OF02F72V7.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattgtatcaacatagaccagggacgcccctaagctcctaatctatgctgcatccagtttgcaaagtgggtcccatcgaggttcagtgcagtgatctgggacagattcatctcacatcagtaatctgcaacgtgaagtattttgctaacttattactgtacaacagaattacaattgtttcgactaagggacacgactacaaattaaacgaactgtagctagcacatctgtcttcattcttcccgcatctgtac

SEQ ID NO: 140409 - DNA, 537 bp, Homo sapiens
  misc_feature: GYAE6OF02GGUJT.46.67.G01.1.454.CMB.1.raw
  modified_base (332)..(332): a, c, t, g, unknown or other
  misc_feature (332)..(332): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctccagggaagggctggaatacattggaagtgtctctcatagtggaggttcctattacagtccgtctctcaagagtcgagtcaccatatctctggacacgtccagcaatcagttttcccngaagatgagttctgtgaccgcgctgacacgggctttattactgtgcgagagacggctattatgtatttttggagtggttatttcgactaccctagatcgacggggctcgacccgtggggccagggactacgtgtcacgtctcctagcctccaccgaaggcccatccggtccttccccgtcggccaccctcctcccagacgtaccc

SEQ ID NO: 140410 - DNA, 513 bp, Homo sapiens
  misc_feature: GYAE6OF02GAMC6.46.67.G01.1.454.CMB.1.raw
  modified_base (509)..(509): a, c, t, g, unknown or other
  misc_feature (509)..(509): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatcgtgggacagatttcactctcaccatcagtaatctgcaacgtgaagattttgctaacttattacttgtacaactagaattacaattgttttcggacctaagggactaacgacttaacaaattaaacgaactagtagctgcaccatctgtcttcatcttcccgcatcngtac

SEQ ID NO: 140411 - DNA, 730 bp, Homo sapiens
  misc_feature: GYAE6OF02F4UQ6.46.67.G01.1.454.CMB.1.raw
  modified_base (262)..(262): a, c, t, g, unknown or other
  misc_feature (262)..(262): n is a, c, g, or t
tcagactagcagtacacgaccggtgctcgatttagagtatacatattggggtttgggggaagtcgtacggtcaggacgaccacgcgattggacgatgaggggtccccgccttcaggctcctgggggactcctgcgtactctggctcggaggttggccagatggttcgactatcgagttactggacccagtctccatccgtccctgtcttgcgtaaccggtgggagtacggaggtgtcgacccagtccacgttggcccgggtnaaaggtccggaactacttggactaccgtatttaaacttggtatcaacctatagacctaggacgggccccttaagctccgtaacgtctaatgcctggcaaggtcccaggtttgcgaaagtgggggtccctattcggaggttcagtggcaagtggaatctgggacagagtttcactcgtcgaccgatcacgtaatctcgacgaacgtagtaacgaagttttaggacctaacttaattaccttaggtacctaaactaggaaaactttaactaagttaggtttttaccgggaccgtaaaggggactaaccgggtaacctttaaacgtaaaaacttttaaacggtaaacgttacgggttaacgggtaccgttagggaccgtaacccggtaagtttaccggtaaacggtttaccgtttacgtaacgtttccctttaccccggtaccccgtacggttacccttcggttaaccggg

SEQ ID NO: 140412 - DNA, 506 bp, Homo sapiens
  misc_feature: GYAE6OF02GBNXX.46.67.G01.1.454.CMB.1.raw
  modified_base (479)..(479): a, c, t, g, unknown or other
  misc_feature (479)..(479): n is a, c, g, or t
  modified_base (502)..(502): a, c, t, g, unknown or other
  misc_feature (502)..(502): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggagacagtgtcaccatcacttgccgggcaagtcggaacattgacacctatttaaatggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagtattttgactaacttattactgtacaacagaattacaattgttttcggcctaagggacacgactacaaattaaacgaactgtgctgcacatctntcttcactccttccgccactctntaac

SEQ ID NO: 140413 - DNA, 520 bp, Homo sapiens
  misc_feature: GYAE6OF02G22AZ.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccaggacggcccctaagctcctaatctatgctgcatccagtttgcaaagtgggtcccatcgaggttcagtggcagtggatctgggacagatttcactctcaccatcagtaatctgcaacgtgtaagtattttgactaacttattaactgtacaacagaattacaattgtttacggaccaagggacacgtaactaacaaattaaacgaactagtcgactgactaaccatctagttcttctacttctcccgctactctagtac

SEQ ID NO: 140414 - DNA, 521 bp, Homo sapiens
  misc_feature: GYAE6OF02JF6E3.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgcccctaagctcctaatctatgctgcatccagtttgcaaagtgggtcccatcgagttcagtggcagtggatctgggacagatttcactctcaccatcagtaatctgcaacgtgaagtattttagactaacttattactgtacaactagaattacaattacgttttcggacctaagggacaacgtaacttaacaaattaaacgaactgtacgctagacaccatctagtcttcacttccttccgcctatctgtac

SEQ ID NO: 140415 - DNA, 726 bp, Homo sapiens
  misc_feature: GYAE6OF02HUJVJ.46.67.G01.1.454.CMB.1.raw
tcagactagcagtacacgaccggtgctcgatttagagtatacataaggttgggttggggagtctcggtccaggacacgagcatggacagtgagggtcccgcgtccagctcctggggctccggtgtctactctggctccgaggtgcccaggatcgtggacacgtcggacgtccgtacgtaccgtacgtcctcctacctccttccccttcgttcgtcgtaccgaccggtagggacgtacgtagggtcgtaccaacgtacgtcctaccgttcgggccggtacgaacgggtacggaaactcgtacggacctactttaactttaaagttcggttatacctaagtaactacgacgacggaccgaacctagcctaacctactacgtactcgtacgtcgactactccgtagtttcggaccgttaaacgggtcgggttaccaggtacgggtacggtaccgaggtcggacgtcggtaggacgtcggagggtacgagtacttacggactcgtacgtacctataccgacttaactcgtacgacgtaacgtaggtacttagttacgaactaacgtttatacgtacttacgaactaagttaattacgaagtttcgttaaccgaacgttaacgaactaccgtaactaactaaaacgtaacgtacgtacgtaacgggtacacggtacaactacgttcgtacgttctacgtcgttacccgtccgtaccctattccgtagtacc

SEQ ID NO: 140416 - DNA, 500 bp, Homo sapiens
  misc_feature: GYAE6OF02GDNK1.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgcccctaagctcctaatctatgctgcatccagtttgcaaagtgggtcccatcgaggttcagtggcagtggatctgggacagatttcactctcaccatcagtaatctgcaacgtgaagattttgctaacttattactgtacaacagaattacaattgtttcgacaagggcacgactaacaaattaaacgaactgtgctgacacatctgtcttacactcttccgccatctatac

SEQ ID NO: 140417 - DNA, 500 bp, Homo sapiens
  misc_feature: GYAE6OF02GA65B.46.67.G01.1.454.CMB.1.raw
  modified_base (497)..(497): a, c, t, g, unknown or other
  misc_feature (497)..(497): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgcccctaagctcctaatctatgctgcatccagtttgcaaagtgggtcccatcgaggttcagtgcagtgatctgggacagatttcactctcaccatcagtaatctgcaacgtgaagtattttgactaacttattacttgtacaacagaattacaattgttttcgaccaagggacacgactaacaaattaaacgaactgtgctgcacatctgtctcactcttccgcatctntac

SEQ ID NO: 140418 - DNA, 534 bp, Homo sapiens
  misc_feature: GYAE6OF02HEA7G.46.67.G01.1.454.CMB.1.raw
  modified_base (325)..(325): a, c, t, g, unknown or other
  misc_feature (325)..(325): n is a, c, g, or t
  modified_base (371)..(371): a, c, t, g, unknown or other
  misc_feature (371)..(371): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccgcagctccgaggaaggggctggaatacattggaagtgtctctcatagtggaggttcctattacagtccgtctctcaagngtcgagtcaccatatctctggacacgtccagcaatcagttttcccngaagatgagttctgtgaccgcgctgacacgggctttatactgtgcgagagacgctattatgtattttggagttggttatttcgactaccctagacttcggacggggtctccggacccgtggggccagggaatacgtggtcaccgttctccttacgcctacccg

SEQ ID NO: 140419 - DNA, 537 bp, Homo sapiens
  misc_feature: GYAE6OF02JY3DR.46.67.G01.1.454.CMB.1.raw
  modified_base (333)..(333): a, c, t, g, unknown or other
  misc_feature (333)..(333): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaagggctggaatacattggaagtgtctctcatagtggaggttcctattacagtccgtctctcaagagtcgagtcaccatatctctggacacgtccagcaatcagttttcccngaagatgagttctgtcgaccgcgctgacacgggtctttatactgtgcgagagacgctattatgtattttggagtgttattcgactaccgtagatcgacggggctcgacccgtgggcctagggactacgtgtaccacgtctccttacgcctcgaccgaacggccctagtccgtccttccccgcgtccaccctcctacacgcgacc

SEQ ID NO: 140420 - DNA, 590 bp, Homo sapiens
  misc_feature: GYAE6OF02JTG3U.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacacctattaaatgtatcaacatagaccagggacggcccctaagctcctaatctatgctgcatccagtttgcaaagtgggtcccatcgaggttcagtggcagtggatctgggacagattcactctcacatcagtaatctgcaacgtgaagtatttgactaacttattacttgtactaacagtaattacaattcgttttacggacctaaagggactaacgtacttaactaaaattaaaaccgaaacttaggtacgggtacttacggtacctaaacccgtaattaccgttacggtttacctttaccgtaacgtttaccccttttaccccggacccttaaacgttcccgttacggttaaacc

SEQ ID NO: 140421 - DNA, 514 bp, Homo sapiens
  misc_feature: GYAE6OF02ISDU8.46.67.G01.1.454.CMB.1.raw
  modified_base (511)..(511): a, c, t, g, unknown or other
  misc_feature (511)..(511): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatcgtgggacagatttcactctcaccatcagtaatctgcaacgtgaagtattttgactaacttattactagtacaactagtaattacaattgtttcggacaaggtacacgactaactaaataaacgaactgtagactagcacatctcgtcttcacttccttcccgctatctntac

SEQ ID NO: 140422 - DNA, 508 bp, Homo sapiens
  misc_feature: GYAE6OF02GYR3T.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatctgggacagatttcactctcaccatcagtaatctgcaacgtgaagtattttgctaacttattactgtcaacagaattacaattgtttacggacctaagggacacgtaactacaaattaaacgaactgtagctgcacatctgtcttcattcttcccgcctatctgtac

SEQ ID NO: 140423 - DNA, 509 bp, Homo sapiens
  misc_feature: GYAE6OF02IA2WZ.46.67.G01.1.454.CMB.1.raw
  modified_base (506)..(506): a, c, t, g, unknown or other
  misc_feature (506)..(506): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagtattttgcaactttattaacttgtacaacagaaattacaatgttttacggacctaagggacacgactaacaaattaaacgaactgtgctgcaccatctgtcttcatcttcccgcattcntac

SEQ ID NO: 140424 - DNA, 503 bp, Homo sapiens
  misc_feature: GYAE6OF02GAAUE.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatctgggacagatttcactctcaccatcagtaatctgcaacgtgaagtattttgactaacttattacttgtcaacagtattacattgtttcgcaaggacacgactaacaaattaaacgaactagtgctgacacatctgtcttcatccttcccgctactctgtac

SEQ ID NO: 140425 - DNA, 506 bp, Homo sapiens
  misc_feature: GYAE6OF02IGTDE.46.67.G01.1.454.CMB.1.raw
  modified_base (477)..(477): a, c, t, g, unknown or other
  misc_feature (477)..(477): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctcctaatctatgctgcatccagtttgcaaagtgggtcccagtcgaggttcagtggcagtgatctgggacagatttcactctcaccatcagtaatctgcaacgtgaagtattttgtaaactttattactgtcaacagaattacaattgtttcggacctaagggacacgtactaacaaattaaacgaactgtgctgcaccntctgtcttcatcttcccgcatctgatacg

SEQ ID NO: 140426 - DNA, 534 bp, Homo sapiens
  misc_feature: GYAE6OF02IA2H0.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaattggtatcaacatagaccaggacggcccctaagctctaatctatgctgcatccagtttgcaaagtgggtccatcgaggttcagtggcagtggatctgggacagatttcactctcaccatcagtaatctgacaacgtgaagtatttagactaactttattactagttacaaacagtaaattacaattgttttacggacctaaggacaacgaacttaaacaaattaaacgaactagtagactagacaaccatactcgttacttctacttccttcccgacctattacctgtaac

SEQ ID NO: 140427 - DNA, 503 bp, Homo sapiens
  misc_feature: GYAE6OF02HXDIB.46.67.G01.1.454.CMB.1.raw
  modified_base (500)..(500): a, c, t, g, unknown or other
  misc_feature (500)..(500): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatctgggacagatttcactctcaccatcagtaatctgcaacgtgaagattttgctaacttattactgtcaaacagtaattacaattgttttacggaccaagggacacgactaacaaattaaacgaactgtgctgcacatctgtctcatctcccgcactctntac

SEQ ID NO: 140428 - DNA, 504 bp, Homo sapiens
  misc_feature: GYAE6OF02I16G1.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatgtatcaacatagaccagggacgcccctaagctcctaatctatgctgcatccagtttgcaaagtgggtcccatcgaggttcagtggcagtggatctgggacagatttcactctcaccatcagtaatctgacaacgtgaagtatttgactaacttattactgtcaacagaaattacaattgttttcgacctaagggacacgactaacaaattaaacgaactgtagactgacaccatctgtcttcatcttccgcatctgtac

SEQ ID NO: 140429 - DNA, 510 bp, Homo sapiens
  misc_feature: GYAE6OF02J16E1.46.67.G01.1.454.CMB.1.raw
  modified_base (385)..(385): a, c, t, g, unknown or other
  misc_feature (385)..(385): n is a, c, g, or t
  modified_base (491)..(491): a, c, t, g, unknown or other
  misc_feature (491)..(491): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaaagctcctaatctatgctgcatccagtttgcaaagtggggtcccatcgaggttcagtggcagtggatctgggacagatttcactctcaccatcagtaatctgcaacgtnaaagattttgcaaacttattaactgtcaaacagaattacaaatgttttacggccaaagggacacgactaacaaattaaacgaactgtaggctgcacatctgtcttnatcttcccgcatctgtaac

SEQ ID NO: 140430 - DNA, 506 bp, Homo sapiens
  misc_feature: GYAE6OF02IJ0JM.46.67.G01.1.454.CMB.1.raw
  modified_base (303)..(303): a, c, t, g, unknown or other
  misc_feature (303)..(303): n is a, c, g, or t
  modified_base (503)..(503): a, c, t, g, unknown or other
  misc_feature (503)..(503): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccaggacggcccctaagctctaatctatgctgcatccagtttncaaagtgggtcccatcgaggttcagtgcagtggatctgggacagatttcactctcaccatcagtaatctgcaacgtgaagtatttgactaacttattaactgtacaactagtaattacaattgtttacggaccaagggacagaactaacaaattaaacgaactagtgctagcacatctgtctctatcttccgcctatctntac

SEQ ID NO: 140431 - DNA, 648 bp, Homo sapiens
  misc_feature: GYAE6OF02HYR89.46.67.G01.1.454.CMB.1.raw
tcagactagcagtacacgaccggtgctcgatttagagtatacatattggggtttgggggacgtactaccggtcaggaccaccagcaatccggacatgagggtaccccgcctcacgctccgtggggcgtccctggcgtactcctggttcgtccggaggtggccaggactgtggacgactcgacgcgtcgacccagttctccatcctccctggtctgcgacgtgggagccaggtcgtcaccatacgtacttggccgggacaacgtcggaacgattgacctacctatttaattggtaattctaacatagtaccgtagggaccggcccctaaggcccgtacctaaagtccttattggacttgggctagtccagtttagctaaaggtcggggtacccagtacgaggttacagtgacagtaggtatcggtgggacaggtactttaccactcctaccaccgatacagtaactctagcaacgtgacgtatttagactaacgttattactgtacaactagtaattaacattagtttaccgaccgtaagggactacgaacttaactaaagttaaacgacgtagtagggtactggacctaaccaactacgtcgttaccttcgtacttcccttcccggaccctacgttccctagtaaccg

SEQ ID NO: 140432 - DNA, 502 bp, Homo sapiens
  misc_feature: GYAE6OF02FHP8C.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagattttgcaacttattactgtcaacagaattacaatgttttcgcaagggacacgactaacaaattaaacgaactagtgctgcaaccatctgtctttatcttcccgccatctgatac

SEQ ID NO: 140433 - DNA, 548 bp, Homo sapiens
  misc_feature: GYAE6OF02HBUC9.46.67.G01.1.454.CMB.1.raw
  modified_base (334)..(334): a, c, t, g, unknown or other
  misc_feature (334)..(334): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttcccngaagatgagttctgtgaccgccgctgacacgggctttattactgtgcgagagacggctattatgtattttggagttggttatttcgactaccctagatcgacggggctcgacccgtggggccagggaatacgtggtcaccgtctccttagcctccaccgaacgggcccagtccggtccttccccgtggcccacccctcctcccagacgtacccg

SEQ ID NO: 140434 - DNA, 512 bp, Homo sapiens
  misc_feature: GYAE6OF02G9U7E.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgcccctaagctcctaatctatgctgcatccagtttgcaaagtgggtcccatcgaggttcagtggcagtggatctgggacagatttcactctcacatcagtaatctgcaacgtgaagtattttgactaacttattacttgtacaacagtaattaacaattcgttttacggacctaaagggtacaacgactaacaaattaaacgaatgtgctagcacatctgtcttcattcttccgctatctgtac

SEQ ID NO: 140435 - DNA, 519 bp, Homo sapiens
  misc_feature: GYAE6OF02IPUV9.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaatggtatcaacatagaccaggacggcccctaagctcctaatctatgctgcatccagtttgcaaagtgggtcccatcgaggttcagtggcagtgatctgggacagatttcactctcaccatcagtaatctgcaacgtgaagtattttgactaacttattactgtacaactagtaattacaattgttttacgacctaagggacacgaactaactaaaattaaacgaactgtagctagacaccatctgtcttctacttccttcccgcctacttctagtac

SEQ ID NO: 140436 - DNA, 505 bp, Homo sapiens
  misc_feature: GYAE6OF02JCMLO.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaattggtatcaacatagaccaggacggcccctaagctcctaatctatgctgcatccagtttgcaaagtggggtcccatcgaggttcagtggcagtggatctgggacagatttcactctcaccatcagtaatctgcaacgtgaagtattttgactaacttattactgtacaacagaattacaattgtttacgcaagggacacgactacaaattaaacgaactgtagctagacaacatctgtcttcactcttacccgcatctgtac

SEQ ID NO: 140437 - DNA, 502 bp, Homo sapiens
  misc_feature: GYAE6OF02GSUXA.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatctgggacagatttcactctcaccatcagtaatctgcaacgtgaagattttgactaacttattactgtacaacagtaattacaattgtttcggacaagggacacgactaacaaattaaacgaactgtgctgcacatctgtcttcatcttcccgcatctgtac

SEQ ID NO: 140438 - DNA, 530 bp, Homo sapiens
  misc_feature: GYAE6OF02GQ7SC.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatgtatcaacatagaccagggacggcccctaagctcctaatctatgctgcatccagtttgcaaagtggggtcccatcgaggttcagtggcagtggatctgggacagatttcactctcaccatcagtaatctgcaacgtgaagtattttgactaacttattacttgtacaacagtaattacaattgtttacggactaagggacacgaactaacaaaattaaacgaactgtagctagacaaccgtatcgtagttcttactacttccttcccgaccctattcctagtaac

SEQ ID NO: 140439 - DNA, 519 bp, Homo sapiens
  misc_feature: GYAE6OF02J16A6.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtgatctgggacagatttcactctcaccatcagtaatctgcaacgtgaagtattttgactaacttattactgtacaacagaattacattgttttcggacaaggtacaacgactaacaaattaaacgaactgtagctgacaacctatctgttaccttctacttccttacccgcctattctgtac

SEQ ID NO: 140440 - DNA, 501 bp, Homo sapiens
  misc_feature: GYAE6OF02FTQ7Q.46.67.G01.1.454.CMB.1.raw
  modified_base (465)..(465): a, c, t, g, unknown or other
  misc_feature (465)..(465): n is a, c, g, or t
  modified_base (498)..(498): a, c, t, g, unknown or other
  misc_feature (498)..(498): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaattggtatcaacatagaccagggacgcccctaagctcctaatctatgctgcatccagtttgcaaagtggggtcccatcgaggttcagtggcagtggatctgggacagatttcactctcaccatcagtaatctgcaacgtgaagtattttgctaacttattactgtcaacagaattacaattgtttacgacctaaggacacgactacaaattaaacgaactagngctgcacatctgtcttcatcttcccgccatctntac

SEQ ID NO: 140441 - DNA, 509 bp, Homo sapiens
  misc_feature: GYAE6OF02HF7EP.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagttttgcaaagtggggtcccatcgaggttcagtggcagtggatctgggacagatttcactctcaccatcagtaatctgcaacgtgaagtattttgactaacttattactgtacaacagaattacaattgtttcggaccaagggacacgactaacaaattaaacgaactgtagctgacacatctgtcttcactcttcccgcactctgtac

SEQ ID NO: 140442 - DNA, 695 bp, Homo sapiens
  misc_feature: GYAE6OF02IQPKT.46.67.G01.1.454.CMB.1.raw
tcagactagcagtacacgaccggtgctcgatttagagtatacatatttggggttttgggggagtactcggtcaggacacagcagtcggacagtacgagggtccccggacctcagctcctggggtctcctcgctactctggctcgagtcgccaagagtgtgactatcgagctgacccagtcctccgatccctcctgttctgccaaccggtggagacacgtcgtcaccatcgaccttgccggactaagtccggacattacgacacctagttaaactggtactacgaaacctagtacgaccgacgggtaccgacccctaagcctacctaatcctaatagcttagccaatccgagtttcggactaaagtccgggtacccaagttcggtaggttctaggtcggacgtaggtggtagtccgtagggaactagtactttcactctacacatcagtaatcgtagctaagtagtaagttatttcgacttaacgtttattacttacgtacaacgtaagtaaactttaactaagttcgttttaccggaaccccgtaaagggtacctaaccggttaaccgtaaactaaaaacggttaaaccgaaacgttacgttacggccttaaggaccgtaaaccctaacgttacgttggttacccgtttactaccgttccctttaccccggaccttacgtttaccgtagttaacc

SEQ ID NO: 140443 - DNA, 505 bp, Homo sapiens
  misc_feature: GYAE6OF02GMK0H.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagtattttgactaacttattactgtacaacagaattacaattgtttacgacaaggacacgactaactaaattaaacgaactgtgctgcacatctgtcttcacttctcccgctactctgtac

SEQ ID NO: 140444 - DNA, 530 bp, Homo sapiens
  misc_feature: GYAE6OF02GBMS5.46.67.G01.1.454.CMB.1.raw
  modified_base (374)..(374): a, c, t, g, unknown or other
  misc_feature (374)..(374): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttcccngaagatgagttctgtgaccgccgctgacacgggcgtttatactgtgcgagagacggctattatgtattttggagttggttatttcgacaccctagatcgacggggctcggacccgtgggccagggatacgtggtcaccgtctccttagcctacccg

SEQ ID NO: 140445 - DNA, 530 bp, Homo sapiens
  misc_feature: GYAE6OF02GGPBE.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccggcagctcccagggagggctggaatacattggaagtgtctctcatagtggaggttcctattacagtccgtctctcaagagtcgagtcaccatatctctggacacgtccagcaatcagttttccctgaagatgagttctgtgaccgccgctgacacgggtcgtttattactgtgcgagagacggctattatgtatttttggagttggttatttcgactacctagatcgacggggctcggaccctgggccagggaactacgtggtcaccgtctccttagcctcccg

SEQ ID NO: 140446 - DNA, 574 bp, Homo sapiens
  misc_feature: GYAE6OF02GUQKW.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacactatttaatggtatcaacatagaccagggacggcccctaagctcctaatctatgctgcatccagtttgacaaggtcgggtcccatcggaggttcagtggctagtggatcgtgggacagtatttcgacttcctaccacctatactaagtaacttcgtgactaacgtagtaagttagtttagactaaacttattacttgtactaaatagtaattaactaattcgtttacgacgtaaggacaacgtaactaactaaagttaaacgaactgtacgacgtacgacgtaactattcttacgttcgttacctacttaccgttccccgacctacttccgtagtaaccg

SEQ ID NO: 140447 - DNA, 537 bp, Homo sapiens
  misc_feature: GYAE6OF02IHY4E.46.67.G01.1.454.CMB.1.raw
  modified_base (211)..(211): a, c, t, g, unknown or other
  misc_feature (211)..(211): n is a, c, g, or t
  modified_base (233)..(233): a, c, t, g, unknown or other
  misc_feature (233)..(233): n is a, c, g, or t
  modified_base (249)..(249): a, c, t, g, unknown or other
  misc_feature (249)..(249): n is a, c, g, or t
  modified_base (372)..(372): a, c, t, g, unknown or other
  misc_feature (372)..(372): n is a, c, g, or t
  modified_base (432)..(432): a, c, t, g, unknown or other
  misc_feature (432)..(432): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttctntggggctgggtccggnagctccgaggaagggctggaatacattggaagtgtctctcatagtggaggttcctattacagtccgtctctcaagagtcgagtcaccatatctctggacacgtccagcaatctagttttcccngaacgatgagttctgtgaccgccgctgacgacgggtcgttattactgtgcgtagagacgntattatgtattttggagttgttatttcgactacctagatcggacggggtctccgtacccgtgggtccgaaggtatacgtgtcctaccgtctctacgtcctacccg

SEQ ID NO: 140448 - DNA, 575 bp, Homo sapiens
  misc_feature: GYAE6OF02GSZ04.46.67.G01.1.454.CMB.1.raw
  modified_base (191)..(191): a, c, t, g, unknown or other
  misc_feature (191)..(191): n is a, c, g, or t
  modified_base (336)..(336): a, c, t, g, unknown or other
  misc_feature (336)..(336): n is a, c, g, or t
tcagactagcagtacacgaccggtgctcgatttagagtatacatattgggtttggggagtctcggtcaggacacagcatggacatgagggtcccgctcagctcctggggctcctgctactctggctccgaggtgccagatgtgacatcgagctgacccagtctccatcctccctgtctgcaaccgtggganacagtgtcaccatcacttgccgggcaagtcggaacattgacacctatttaaattggtatcaacatagaccagggacggcccctaagctcctaatctatgctgcatccagtttgcaagtgggtccatcgagttcagtgcagtgatntgggacagatttcactctcaccatcagtaatctagcaacgtgaagtattttagtaaacttattactgtacaactagtaattacaattggttttacgaccgtaagggtacctaacgaacttaactaaatttaaaccgaaacttaggtagaccttaggacctaaccctagttccttaggttcctttacctaagtttcccctttaccccggaccctaacgttaccttacgtaactttaaccg

SEQ ID NO: 140449 - DNA, 500 bp, Homo sapiens
  misc_feature: GYAE6OF02JICJ3.46.67.G01.1.454.CMB.1.raw
  modified_base (464)..(464): a, c, t, g, unknown or other
  misc_feature (464)..(464): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagtattttgctaacttattactgtcaacagaattacaatgtttcgcaagggacagactaacaaattaaacgaactgtagnttgcaccatctgtcttcattctcccgctatctgtac

SEQ ID NO: 140450 - DNA, 525 bp, Homo sapiens
  misc_feature: GYAE6OF02IW390.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccccctaagctcctaatctatgctgcatccagtttgcaaagtgggtcccatcgaggttcagtggcagtggatctgggacagatttcactctcaccatcagtaatctgacaacgtgaagtattttgctaaacttattacttgtacaacagtaaattactaaattgttttacggacctaaagggacaacgaactaactaaaattaaaacgaactgtaggctgacaaccatctgtcttcatcttcccgccatctgtac

SEQ ID NO: 140451 - DNA, 503 bp, Homo sapiens
  misc_feature: GYAE6OF02HP7AM.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagttttgcaaagtggggtcccatcgaggttcagtggcagtggatctgggacagatttcactctcaccatcagtaatctgcaacgtgaagtattttgctaacttattactgtcaacagaattacaattgtttcggcaagggacacgactacaaattaaacgaactgtgctgcacatctgtcttcactcttcccgcctatctgtac

SEQ ID NO: 140452 - DNA, 500 bp, Homo sapiens
  misc_feature: GYAE6OF02GQWQV.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatctgggacagatttcactctcaccatcagtaatctgcaacgtgaagattttgctaacttattactgtcaacagaattacaatgtttcgaccaagggacacgactaacaaattaaacgaactgtagctagcacatctgtcttcatcttccgctatctgtac

SEQ ID NO: 140453 - DNA, 542 bp, Homo sapiens
  misc_feature: GYAE6OF02HWLEI.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccgcagctccagggagggctggaatacattggaagtgtctctcatagtggaggttcctattacagtccgtctctcaagagtcgagtcaccatatctctggacacgtccagcaatcagttttccctgaagatgagttctgtgaccgccgctgacacgggtcgtttattactgtgcgagagacggctattatgtatttttggagttggttatttcgactaccctagatcggacggggctcgacccgtggggccagggactacgtggtcaccgtctccttagcctccaccgaacggcccagtccggtccttccccgcggcctaccctcctccagcgtacc

SEQ ID NO: 140454 - DNA, 526 bp, Homo sapiens
  misc_feature: GYAE6OF02I97PL.46.67.G01.1.454.CMB.1.raw
  modified_base (330)..(330): a, c, t, g, unknown or other
  misc_feature (330)..(330): n is a, c, g, or t
  modified_base (523)..(523): a, c, t, g, unknown or other
  misc_feature (523)..(523): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccgcagctccagggagggctggaatacattggaagtgtctctcatagtggaggttcctattacagtccgtctctcaagagtcgagtcaccatatctctggacacgtccagcaatcagttttcccngaagatgagttctgtgaccgcgctgacacgggcgtttatactgtgcgagagacggctattatgtatttttggagttggttatttcgactacccgtagatcgacgggggctcgacccgtggggccagggaatacgtggtcaccgtctcttagcctcaccgaggccatcggtcttccctcggcaccctctccagnacc

SEQ ID NO: 140455 - DNA, 551 bp, Homo sapiens
  misc_feature: GYAE6OF02G69UC.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacgccctaagctctaatctatgctgcatccagtttgcaaagtgggtcccatcgaggttcagtgcagtgatctgggacagtatttcactctcacatcagtatctgacaagtgaagtattttgactaactttattactgtacaaactagtaaattactaagttgttttacggacctaaagggaccaacgtaacttaactaaaatttaaacgaaacgttgtaggtactaggacctaaacctattacgtagttaccttacacttaccttccccgacctacttctagtaac

SEQ ID NO: 140456 - DNA, 520 bp, Homo sapiens
  misc_feature: GYAE6OF02HR930.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatctgggacagatttcattctcaccatcagtaatctgcaacgtagaagtattttgactaacttattacttgtacaacagtaattacaattgtttacggaccgtaaggacacgtactaactaaattaaacgaactgtaggactgacacatctgtcttactacttcttcccgccactctgtac

SEQ ID NO: 140457 - DNA, 504 bp, Homo sapiens
  misc_feature: GYAE6OF02JBOXL.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatctgggacagatttcactctcaccatcagtatctgcaacgtgaagattttgctaacttattactgtcaacagaattacaattgtttacgccaagggacacgactaacaaataaacgaactgtagctagcaccatctgtcttcacttcttcccgcctatctgtac

SEQ ID NO: 140458 - DNA, 506 bp, Homo sapiens
  misc_feature: GYAE6OF02ITIFE.46.67.G01.1.454.CMB.1.raw
  modified_base (487)..(487): a, c, t, g, unknown or other
  misc_feature (487)..(487): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgagttcagtggcagtgatctgggacagatttcactctcaccatcagtaatctgcaacgtgaagtattttgactaacttattactgtcaacagtaattacaattgtttcggaccaagggacacgactaactaaattaaacgaactgtaggctgacacatctgtcttnactcttcccgcatctgtac

SEQ ID NO: 140459 - DNA, 519 bp, Homo sapiens
  misc_feature: GYAE6OF02IVDIC.46.67.G01.1.454.CMB.1.raw
  modified_base (499)..(499): a, c, t, g, unknown or other
  misc_feature (499)..(499): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctcctaatctatgctgcatccagtttgcaaagtggggtcccagtcgaggttcagtggcagtggatcgtgggacagatttcactctcaccatcagtaatctgcaacgtgaagtattttgactaacttattactgtacaactagtaaattacaattgttttacggaccaaagggtacacgtactaactaaaataacgaaactgtagctagctacatctgtcttnacttctcccgcactctgtac

SEQ ID NO: 140460 - DNA, 507 bp, Homo sapiens
  misc_feature: GYAE6OF02F353M.46.67.G01.1.454.CMB.1.raw
  modified_base (504)..(504): a, c, t, g, unknown or other
  misc_feature (504)..(504): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgcccctaagctcctaatctatgctgcatccagtttgcaaagtgggtcccatcgaggttcagtggcagtggatctgggacagatttcactctcaccatcagtaatctagcaacgtgaagtattttgactaacttattactgtacaacagaattacaattgttttacggacctaagggacacgactaacaaattaaacgaatgtagctgcacatctgtcttcatcttcccgctatctntac

SEQ ID NO: 140461 - DNA, 552 bp, Homo sapiens
  misc_feature: GYAE6OF02F1HUL.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttccctgaagatgagttctgtgaccgccgctgacacgggcgttttatactgtgcgagagacggctattatgtatttttggagttggttatttcgactacccttagatcgacggggtctcgaccccgtggggccagggaatacgtgtcaccgtctccgttacgcctccaccgaacgggcccagtccggtccttcccccgtggccacccctcctccacgcgtaccg

SEQ ID NO: 140462 - DNA, 567 bp, Homo sapiens
  misc_feature: GYAE6OF02H503P.46.67.G01.1.454.CMB.1.raw
  modified_base (305)..(305): a, c, t, g, unknown or other
  misc_feature (305)..(305): n is a, c, g, or t
  modified_base (374)..(374): a, c, t, g, unknown or other
  misc_feature (374)..(374): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccaaaggacggcccctaagctcctaatctatgctgcatccagtttncaaagtgggtcccatcgagttcagtggcagtggatctgggacagatttcactctcaccatcagtaatcngtcaaacgtgaaagtattttgactaaactttattaacttgttacaaacagtaaattaacaattgttttacggacctaaaggggactaacggaacttaacaaaaatttaaaaccgaaaacttgtaggaccttggaccaaccgtaatccgtagttcctttactattacccttccccgaccctaatccgtagtaac

SEQ ID NO: 140463 - DNA, 504 bp, Homo sapiens
  misc_feature: GYAE6OF02IVKHM.46.67.G01.1.454.CMB.1.raw
tcagactagcagtacacgaccggtgctcgatttagagtatacatattgggtttggggagtctcggtcaggacacagcatggacatgatggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccaggacggcccctaagctcctaatctatgctgcatccagtttgcaaagtggggtcccatcgaggttcagtggcagtggatctgggacagatttcactctcaccatcagtaatctgcaacgtgaagtatttgactaacttattactgtacaactagaattacaattgttttcggacaagggacacgactaacaaattaaacgactgtgctgcacatctgtcttcatccttcccgctactctacg

SEQ ID NO: 140464 - DNA, 497 bp, Homo sapiens
  misc_feature: GYAE6OF02GOOY8.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccaggacggcccctaagctctaatctatgctgcatccagtttgcaaagtgggtcccatcgaggttcagtgcagtgatctgggacagatttcactctcaccatcagtaatctgcaacgtgaagattttgctaacttattactgtacaacagaattacaatgtttcggccaagggacacgactaacaaattaaacgaactagtgctgcacatctgtcttcactcttcccgcatctgtac

SEQ ID NO: 140465 - DNA, 511 bp, Homo sapiens
  misc_feature: GYAE6OF02JGXR1.46.67.G01.1.454.CMB.1.raw
  modified_base (490)..(490): a, c, t, g, unknown or other
  misc_feature (490)..(490): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaatggtatcaacatagaccaggacggcccctaagctcctaatctatgctgcatccagtttgcaaagtgggtcccatcgaggttcagtggcagtggatctgggacaggatttcactctcaccatcagtaatctagcaacgtgaaagattttgacaacttattactgttcaactagaattacaatgttttcggacctaagggacacgtactaacaaattaaacgaactgtagctagcaccatctgtcttanatcttcccgacactctagtac

SEQ ID NO: 140466 - DNA, 496 bp, Homo sapiens
  misc_feature: GYAE6OF02IE0SY.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatctggacagatttcactctcacatcagtaatctgcaacgtgaagtatttgcaacttattactgtcaacagaattacaatgttttcggcaaggacacgactacaaattaaacgaactagtgctagcacatctgtcttcatcttcccgcatctgtac

SEQ ID NO: 140467 - DNA, 560 bp, Homo sapiens
  misc_feature: GYAE6OF02HS3Y1.46.67.G01.1.454.CMB.1.raw
tcagactagcagtacacgaccggtgctcgatttagagtatacatattgggtttggggagtctcggtcaggacacagcatggacatggagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaaagctacctaatctatgctgcatccagtttgcaaagtgggtcccatcgagttcagtgcagtggatcgtgggacagatttcacttctcaccatcagtaatctgacaagtgaagtattttagactaactttattactgtacaaactaagtaaattactaattgttttacggacctaaagggaccaacgaacttaaacaaaattaaaacgaacttaggtagtaccttgacctaacctaattcttacgttctttactacttccgttccccgtactacttctagtaac

SEQ ID NO: 140468 - DNA, 498 bp, Homo sapiens
  misc_feature: GYAE6OF02I3TH2.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagattttgcaacttattactgtcaacagaattacaatgtttcggccaagggacacgactaacaaattaaacgaactgtggctgcacatctgtcttcatctcccgcatctgtac

SEQ ID NO: 140469 - DNA, 500 bp, Homo sapiens
  misc_feature: GYAE6OF02IZX86.46.67.G01.1.454.CMB.1.raw
  modified_base (497)..(497): a, c, t, g, unknown or other
  misc_feature (497)..(497): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtgatctgggacagatttcactctcaccatcagtaatctgcaacgtgaagatttgctaacttattactgtcaacagaattacaatgtttcggacctaagggacacgtactaacaaattaaacgaactgtagctgcacatctgtcttcactcttccgcatctntac

SEQ ID NO: 140470 - DNA, 506 bp, Homo sapiens
  misc_feature: GYAE6OF02IZZY1.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaagtgggtcccatcgagttcagtggcagtggatctgggacagatttcactctcaccatcagtaatctgcaacgtgaagtattttgctaacttattactgtacaacagtaattacaattgtttacggactaagggacacgtactaacaaattaaacgaactagtagctagcacatctgtcttcatcttccgccatctgtac

SEQ ID NO: 140471 - DNA, 508 bp, Homo sapiens
  misc_feature: GYAE6OF02G6LYN.46.67.G01.1.454.CMB.1.raw
  modified_base (489)..(489): a, c, t, g, unknown or other
  misc_feature (489)..(489): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatctgggacagatttcactctcaccatcagtaatctgcaacgtgaagtattttgactaacttattactgtcaacagaattacaattgtttacggacctaagggacacgactaacaaattaaacgaactgtagctagacacatctgtcttnactcttcccgcatctgtac

SEQ ID NO: 140472 - DNA, 542 bp, Homo sapiens
  misc_feature: GYAE6OF02HDJLE.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtgatctgggacagatttcactctcaccatcagtaatctgcaacgtgaagtattttgctaacttattacttgtacaacagtaattacaattgttttacggacctaagggaccaacggtaacttaacaaaattaaaaccgaagttcgtaggctaggaccaaccgtaatcgttgtacctttcacttcctcccgacctactcctagtaac

SEQ ID NO: 140473 - DNA, 506 bp, Homo sapiens
  misc_feature: GYAE6OF02GFML7.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagattttgctaacttattactgtcaacagaattacaattgtttacggccaagggacacgactaacaaattaaacgaactgtagctagcacatctgtcttcattccttccgcctatctgtac

SEQ ID NO: 140474 - DNA, 506 bp, Homo sapiens
  misc_feature: GYAE6OF02HGMH5.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtgatctgggacagatttcactctcaccatcagtaatctgcaacgtgaagtattttgactaacttattactgtacaactagaattacaattgtttcgacctaaggacacgactacaaattaaacgaactgtgactgacaacatctgtcttcattccttcccgcatctgtac

SEQ ID NO: 140475 - DNA, 511 bp, Homo sapiens
  misc_feature: GYAE6OF02G23WS.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccaggacggcccctaagctcctaatctatgctgcatccagtttgcaaagtggggtcccatcgaggttcagtggcagtggatctgggacagatttcactctcaccatcagtaatctgcaacgtgaagtattttgctaacttattaactgtcaacagaaattacaattgttttacggaccaagggacaacgacttaacaaattaaacgaactgtagctagacacatctgtcttcatcttcccgctactctgtac

SEQ ID NO: 140476 - DNA, 542 bp, Homo sapiens
  misc_feature: GYAE6OF02G2BKD.46.67.G01.1.454.CMB.1.raw
  modified_base (334)..(334): a, c, t, g, unknown or other
  misc_feature (334)..(334): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttcccngaagatgagttctgtgaccgcgctgacacgggcttttatactgtgcgagagacggctattatgtatttttggagttggttatttcgactaccctagatcggacggggctcgacccgtggggccagggaatacgtggtcaccgtctccgttagcctccaccgaacggcccagtccgtccttcccctggccaccctccctccacgcgacc

SEQ ID NO: 140477 - DNA, 543 bp, Homo sapiens
  misc_feature: GYAE6OF02GGO1V.46.67.G01.1.454.CMB.1.raw
  modified_base (526)..(526): a, c, t, g, unknown or other
  misc_feature (526)..(526): n is a, c, g, or t
  modified_base (539)..(539): a, c, t, g, unknown or other
  misc_feature (539)..(539): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttccctgaagatgagttctgtgaccgcgctgacacgggtcgttttatactgtgcgagagacggctattatgtatttttggagttggttatttcgactaccctagatcgacggggctcggacccgtggggccagggactacgtggtcaccgtctccttagcctccaccgaacgggcccagtccggtcctccccgtgccnccctcctccacgncccg

SEQ ID NO: 140478 - DNA, 505 bp, Homo sapiens
  misc_feature: GYAE6OF02IIDAN.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaattggtatcaacatagaccagggacgcccctaagctcctaatctatgctgcatcagtttgcaaagtgggtcccatcgaggttcagtggcagtggatcgtggacagatttcactctcaccatcagtaatctgcaacgtgaagtatttgactaacttattacttgtacaacagtaattacaattgtttcggaccaagggacacgactacaaattaaacgaactgtagctgacacatctgttcttcactccttccgcactctgtac

SEQ ID NO: 140479 - DNA, 500 bp, Homo sapiens
  misc_feature: GYAE6OF02HGM39.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccaggacggcccctaagctcctaatctatgctgcatccagtttgcaaagtggggtcccatcgaggttcagtggcagtggatctgggacagatttcactctcaccatcagtaatctgcaacgtgaagattttgctaacttattactgtacaacagaattacaattgtttacgaccaaggacacgactacaaattaaacgaactgtagctgcacatctgtcttcatctccgctactctatac

SEQ ID NO: 140480 - DNA, 546 bp, Homo sapiens
  misc_feature: GYAE6OF02FSPEJ.46.67.G01.1.454.CMB.1.raw
  modified_base (334)..(334): a, c, t, g, unknown or other
  misc_feature (334)..(334): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttcccngaagatgagttctgtgaccgcgctgacacgggctttatactgtgcgagagacggctattatgtatttttggagttggttatttcgactaccctagactcgacggggctcgacccgtgggccagggatacgtggtcaccgtctcttacgcctccacgaacggcccacgtccggtccttccccgtcggcctacccgtcctccacgacgtacccg

SEQ ID NO: 140481 - DNA, 511 bp, Homo sapiens
  misc_feature: GYAE6OF02GBGAF.46.67.G01.1.454.CMB.1.raw
  modified_base (484)..(484): a, c, t, g, unknown or other
  misc_feature (484)..(484): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatctgggacagatttcactctcaccatcagtaatctgcaacgtgaaagtattttgactaacttattacttgtacaacagaattacaattgttttcggaccaaggacacgactaactaaattaaacgaactgtgctgcacatctntcttcacttctcccgcacttctgtaac

SEQ ID NO: 140482 - DNA, 575 bp, Homo sapiens
  misc_feature: GYAE6OF02JA9K6.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgcccctaagctcctaatctatgctgcatccagtttgcaaagtgggtcccatcgaggttcagtggcagtggatcgtgggacagtattcactctcacatcagtaatctagcaacgtgaagtatttgactaacttattactgtacaaactagtaaattaactaatttcggttttaccggaccgtaaagggtacctaacgtaaccgttaaactaaaaattaaaccgaaacgttacggtaggtctaggtaccaaccttaatccgttgttacctttactaacttccttccccggactaacttcctagtaaccg

SEQ ID NO: 140483 - DNA, 548 bp, Homo sapiens
  misc_feature: GYAE6OF02HF9XO.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttcccctgaagatgagttctgtgaccgccgctgacacgggcgtttattactgtgcgagagacggctattatgatttttggagttggttatttcgactaccctagatcgacggggctcgacccgtggggccagggatacgtggtcaccgtctccttagccctccaccgaaggcccagtccggtccttcccccgtggccaccccgtcctcccaacgcgaccc

SEQ ID NO: 140484 - DNA, 525 bp, Homo sapiens
  misc_feature: GYAE6OF02FWC67.46.67.G01.1.454.CMB.1.raw
  modified_base (368)..(368): a, c, t, g, unknown or other
  misc_feature (368)..(368): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccggcaagtcgaacattgacacctatttaaatggtatcaacatagaccagggacgcccctaagctcctaatctatgctgcatccagtttgacaaagtgggtcccatcgagttcagtgcagtgatctagggacagtattcactctcacatcagtaatntgcaacgtgaagtatttgactaaacttattactgtacaacagtaattacaattcgtttcgacaagggacaacgaacttaacaaaacttaaacgaactgtacggctacgccgaacattactcgttacttcgacttccgttacccgctacttctgtaac

SEQ ID NO: 140485 - DNA, 509 bp, Homo sapiens
  misc_feature: GYAE6OF02GF6UK.46.67.G01.1.454.CMB.1.raw
  modified_base (386)..(386): a, c, t, g, unknown or other
  misc_feature (386)..(386): n is a, c, g, or t
  modified_base (488)..(488): a, c, t, g, unknown or other
  misc_feature (488)..(488): n is a, c, g, or t
  modified_base (493)..(493): a, c, t, g, unknown or other
  misc_feature (493)..(493): n is a, c, g, or t
tcagactagcagtacacgaccggtgctcgatttagagtatacatattgggtttggggagtctcggtcaggacacagcactggaccatgagggtccccgctcagctcctggggctcctgctactctggctccgaggtgccagatggtgacatcgagctgacccagtctccatcctccctgtctgcaaccgtgggagacagtgtcaccgatcacttgccgggcaaggtcggaacattgacacctatttaaattggtatcaacatagaccaggacgcccctaagctcctaatctatgctgcatccagtttgcaaagtggggtcccatcgagttcagtggcagtgatctgggacagatttcactctcgaccatcagtaatctgcaacgtnaagattttagactaacttattactgtacaacagtaattacaattgttttcgactaagggtacaacgactaacaaattaaacgaactagtgctgcaacatctntcttnatctccgcatctgtac

SEQ ID NO: 140486 - DNA, 507 bp, Homo sapiens
  misc_feature: GYAE6OF02HQB39.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatctgggacagatttcactctcaccatcagtaatctgcaacgtgaagtattttgactaacttattactgtacaactagaattacaattgtttcgaccaaggacacgactaactaaattaaacgaactagtagctgacacatctgtcttcactctcccgccatctgtac

SEQ ID NO: 140487 - DNA, 498 bp, Homo sapiens
  misc_feature: GYAE6OF02FJKJP.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctcctaatctatgctgcatccagtttgcaaagtggggtcccatcgaggttcagtggcagtggatctgggacagattcactctcaccatcagtaatctgcaacgtgaagattttgcaacttattactgtcaacagaattacaatgttttcgccaagggacacgactacaaattaaacgaactgtagctgcaccatctgtcttcatcttcccgccatctgtac

SEQ ID NO: 140488 - DNA, 500 bp, Homo sapiens
  misc_feature: GYAE6OF02IK47J.46.67.G01.1.454.CMB.1.raw
  modified_base (481)..(481): a, c, t, g, unknown or other
  misc_feature (481)..(481): n is a, c, g, or t
  modified_base (496)..(496): a, c, t, g, unknown or other
  misc_feature (496)..(496): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaattggtatcaacatagaccagggacgcccctaagctcctaatctatgctgcatccagtttgcaaagtgggtcccatcgagttcagtggcagtggatctgggacagatttcactctcaccatcagtaatctgcaacgtgaagtattttgctaacttattacttgtacaacagaattacaattgtttcgctaaggacacgactacaaattaaacgaactagtagctgcaacatctgtcttnactctcccgcatccngtac

SEQ ID NO: 140489 - DNA, 522 bp, Homo sapiens
  misc_feature: GYAE6OF02JD4WH.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatctgggacagatttcactctcaccatcagtaatctgcaacgtgaagtattttgactaacttattactgtacaacagaattacaattgttttcggaccaagggacaacgactaacaaattaaacgaactagtacggctagactaaccatctagttcttcacttcttcccgcctactctgtaac

SEQ ID NO: 140490 - DNA, 508 bp, Homo sapiens
  misc_feature: GYAE6OF02GRING.46.67.G01.1.454.CMB.1.raw
  modified_base (498)..(498): a, c, t, g, unknown or other
  misc_feature (498)..(498): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagtattttgctaacttattacttgtcaacagaattacaattgttttcggcctaagggacacgactaacaaattaaacgaactagtaggctgcaccatctgtcttcatcttcccnccatctgtac

SEQ ID NO: 140491 - DNA, 555 bp, Homo sapiens
  misc_feature: GYAE6OF02J2L64.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggagggctggatacattggaagtgtctctcatagtggaggttcctattacagtccgtctctcaagagtcgagtcaccatatctctggacacgtccagcaatcagttttccctgaacgatgagttctgtgaccgcgctgacacgggtctttatactgtgcgagagacggtctattatgtatttttggagttggttatttcgacacctagatcgacggggctcggaccctggggccagggaatacgtggtccaccgtcgtccttagccctccaccgaacgggcccagtccggtccttacccccgtggtcccacccgttccctccctaaggcgtacccg

SEQ ID NO: 140492 - DNA, 524 bp, Homo sapiens
  misc_feature: GYAE6OF02IM3DC.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccaggacggcccctaagctcctaatctatgctgcatccagtttgcaaagtgggtccatcgaggttcagtggcagtgatctgggacagattcactctcaccatcagtaatctgcaacgtgaagtattttgactaacttattactgttacaactagtaattacaattgtttacggacaagggactaacgaactaactaaattaaacgaacttgtaggactagacaacctatctagttcttacacttccttcccgctactctagtac

SEQ ID NO: 140493 - DNA, 550 bp, Homo sapiens
  misc_feature: GYAE6OF02IO0RZ.46.67.G01.1.454.CMB.1.raw
  modified_base (531)..(531): a, c, t, g, unknown or other
  misc_feature (531)..(531): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctggggtccggcagctcccagggaaggggctggaatacattgggaagtgtctctcatagtggaggttcctattacagtccgtctctcaagagtcgagttcaccatatctctggacacgtccagcaatcagttttccctgaagatgagttctgtgaccgccgctgacacgggcgtttattactgtgcgagagacggctattatgtatttttggagttggttatttcgactaccctagatcgacggggctcgacccgtgggccagggaactacgtgtcaccgtctccgttacgcctccaccgaacggcccagtccggtccttccccgtcggccnccctccctccacgacgccg

SEQ ID NO: 140494 - DNA, 550 bp, Homo sapiens
  misc_feature: GYAE6OF02H7ZF5.46.67.G01.1.454.CMB.1.raw
  modified_base (335)..(335): a, c, t, g, unknown or other
  misc_feature (335)..(335): n is a, c, g, or t
  modified_base (543)..(543): a, c, t, g, unknown or other
  misc_feature (543)..(543): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggcctttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttcccngaagatgagttctgtgaccgccgctgacacggtcgtttattactgtgcgagagacggctattatgtattttggagtggttatttcgactacctagatcggacggggctcggaccccgtggggccagggatacgtggtcacgtctcctagccctccaccgacggcccagtcccggttccttcccccgtggccacccctcctaccaacgngtacccg

SEQ ID NO: 140495 - DNA, 533 bp, Homo sapiens
  misc_feature: GYAE6OF02JFDGE.46.67.G01.1.454.CMB.1.raw
  modified_base (334)..(334): a, c, t, g, unknown or other
  misc_feature (334)..(334): n is a, c, g, or t
  modified_base (531)..(531): a, c, t, g, unknown or other
  misc_feature (531)..(531): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttcccngaagatgagttctgtgaccgcgctgacacgggcgtttatactgtgcgagagacggctattatgtattttggagtggttatttcgactaccctagatcgacggggctcgacccgtgggccagggaatactggtcaccgtctccttagcctccaccgaacgggcccatccgtcttccccgtggccaccctcctccagcncc

SEQ ID NO: 140496 - DNA, 537 bp, Homo sapiens
  misc_feature: GYAE6OF02IT9D3.46.67.G01.1.454.CMB.1.raw
  modified_base (414)..(414): a, c, t, g, unknown or other
  misc_feature (414)..(414): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaatgtatcaacatagacaggacggccctaagctcctaatctatgctgcatccagtttgcaaagtgggtccatcgaggttcagtggcagtggatctgggacagatttcaactctacaccatcagtaatctgacaacgtgaaagtattttagctaaacttattactgttacaaanagtaaattacaaattgttttacggacccaaagggacaacgaacttaacaaaattaaacgaaactagtacggcttagacaaccatcttagtcttcaacttccttcccgacgaattccgtataac

SEQ ID NO: 140497 - DNA, 553 bp, Homo sapiens
  misc_feature: GYAE6OF02GYUPA.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctcctaatctatgctgcatccagtttgcaaagtggggtcccatcgaggttcagtggcagtggatctgggacagatttcactctcaccatcagtaatctgacaagtgaagttatttgactaacttattacttgtacaacagtaatactaagttgtttacgaccgtaaggactaacgtaactaactaaaacttaaacgaacgtgtagtactacggacctaacctattcgtagttaccttactacttccgtttaccccgacctacttccgtagttaacg

SEQ ID NO: 140498 - DNA, 510 bp, Homo sapiens
  misc_feature: GYAE6OF02GLQZK.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattgtatcaacatagaccaggacggcccctaagctcctaatctaatgctgcatccagtttgcaaaagtggggtcccatcgaggttcagtggcagtggatctgggacagatttcactctcaccatcagtaatctgcaacgtgaagtattttgacaacttattacttgtcaacagaattacaattgttttcggaccaagggacaacgactaacaaattaaacgaactagtagctgcaaccatctgtcttcatcttcccgcactctgtac

SEQ ID NO: 140499 - DNA, 511 bp, Homo sapiens
  misc_feature: GYAE6OF02IUQ1H.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatcgtgggacagatttcactctcacatcagtaatctgcaacgtgaagtatttgctaacttattactgtacaacagtaattacaattgtttacgacctaagggacacgactaactaaattaaacgaactgtagctgactacatctagtcttctactcttcccgctatctgtac

SEQ ID NO: 140500 - DNA, 582 bp, Homo sapiens
  misc_feature: GYAE6OF02H3OWM.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggcctttcggagaccctgtccctcacctgcgctgtctctggtgcctccatcagtagtggtttcttctggggctgggtccggcagctcccagggagggctggaatacattggaagtgtctctcatagtggaggttcctattacagtccgtctctcaagagtcgagtcaccatatctctggacacgtccagcaatctagttttccctgaagatgagttctgtgaccgcgctgacgacgggtcgttttatactgtgcgagagacggctattatgtattttggagttggtttatttcgactacccgtagtacgtcggacgggccgtccggtacccgtcggggaccgaagggaatacgttcggtcacccgtcttaccgtacgtccctcccaccgaacggccctagtcccgttcccttccccgtcggccctaccccgttccctaccgacgacgtacccg

SEQ ID NO: 140501 - DNA, 734 bp, Homo sapiens
  misc_feature: GYAE6OF02J229W.46.67.G01.1.454.CMB.1.raw
  modified_base (327)..(327): a, c, t, g, unknown or other
  misc_feature (327)..(327): n is a, c, g, or t
  modified_base (332)..(332): a, c, t, g, unknown or other
  misc_feature (332)..(332): n is a, c, g, or t
  modified_base (373)..(373): a, c, t, g, unknown or other
  misc_feature (373)..(373): n is a, c, g, or t
  modified_base (391)..(391): a, c, t, g, unknown or other
  misc_feature (391)..(391): n is a, c, g, or t
  modified_base (425)..(425): a, c, t, g, unknown or other
  misc_feature (425)..(425): n is a, c, g, or t
  modified_base (445)..(445): a, c, t, g, unknown or other
  misc_feature (445)..(445): n is a, c, g, or t
tcagactagcagtacacgaccggtgctcgatttagagtatacatattgggttgtctcctgctggtgcagctcccagatgggtcctgtccctggtgcaactgcaggagtcggcccacgactggtgaggccttcggagaccctgtccctcacctgccgctgtctctggtgcctccatccagtgtggtttcttcgtgggctgggtccgcagctcccgagggaggctggaatacgagtggagtgtctctcgagttaggtggtacggttccctaagttaccgacggttccgtctctaccgaaaggtcgtcgagttccaacctatactctcgnggacncgtccagcaatctacgttttcccagaagtactgtacgttcngtaccgacccgtcccgtntacggtacccgtacggggttcttttaacgtccgngttcgacggagacgacggtnttacgttatgttagttttaggagtttgtttactacgaccgttaccgtagtaccgtcggtacgggtccttaccggtacccggtaggggtacccgtaagggtaaccgttacggttcgggtaccctaacccggttccttacccgttacccggccccgttacccgtaaccccgggtaacccgggttccccctaggttaaccccccgggtttcccccgttacccccggttaccggtacccccgtacccccgttaccccggttaacccgaaccggttccccggttaaccccccgg

SEQ ID NO: 140502 - DNA, 523 bp, Homo sapiens
  misc_feature: GYAE6OF02JBLGL.46.67.G01.1.454.CMB.1.raw
  modified_base (415)..(415): a, c, t, g, unknown or other
  misc_feature (415)..(415): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagtattttagctaacttattactgtacaanagtaattacaattgttttcggacctaagggtacaacgtactaactaaattaaacgaacttagtacggtctgacacctatctgtcttcactccttcccgccatctgtac

SEQ ID NO: 140503 - DNA, 522 bp, Homo sapiens
  misc_feature: GYAE6OF02I1QP8.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccaggacggcccctaagctcctaatctatgctgcatccagtttgcaaagtggggtcccatcgaggttcagtggcagtggatctgggacagattcactctcaccatcagtaatctgcaacgtgaagtattttgctaacttattactgtacaacagaattacaattgttttacggactaagggtacaacgtaactaactaaaattaaacgaaactgtagactagccaacatactgtacttcagttccttcccgccatctgtaac

SEQ ID NO: 140504 - DNA, 505 bp, Homo sapiens
  misc_feature: GYAE6OF02IGJNG.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaatggtatcaacatagaccagggacggcccctaagctcctaatctatgctgcatccagtttgcaaagtgggtcccatcgaggttcagtggcagtggatctgggacagatttcactctcaccatcagtaatctgcaacgtgaagtattttgactaacttattactgtacaacagaattacaatgtttcgaccaaggacacgactacaaattaaacgaactgtagctgacacatctgtcttcacttccttcccgccactctgtaac

SEQ ID NO: 140505 - DNA, 542 bp, Homo sapiens
  misc_feature: GYAE6OF02GAPIA.46.67.G01.1.454.CMB.1.raw
  modified_base (334)..(334): a, c, t, g, unknown or other
  misc_feature (334)..(334): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttcccngaagatgagttctgtgaccgcgctgacacgggtctttatactgtgcgagagacggctattatgtattttggagttggttatttcgactacctagatcgacggggctcggacccgtgggccagggatacgtggtcaccgtctccgttacgcctccaccgaacggcccagtccggtccttccccgtcggcccaccctcctcccagacgcc

SEQ ID NO: 140506 - DNA, 549 bp, Homo sapiens
  misc_feature: GYAE6OF02IM66H.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaatggtatcaacatagaccagggacgcccctaagctcctaatctatgctgcatccagttgcaaagtgggtcccatcgaggttcagtgcagtggatcgtgggacagatttcactctcaccatcagtaatctgcaacgtgaagtattttgactaacttattactagtacaaactagtaacttacaattcgtttacggaccgaagggtacaaccgtaactaaacctaaaagttaaacgaaacttagtagtactacgacgtaacctattcttagtctttacacttccttacccgaccctacttcctagtaac

SEQ ID NO: 140507 - DNA, 540 bp, Homo sapiens
  misc_feature: GYAE6OF02I98YV.46.67.G01.1.454.CMB.1.raw
  modified_base (332)..(332): a, c, t, g, unknown or other
  misc_feature (332)..(332): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctgggctgggtccgcagctcccagggaagggctggaatacattggaagtgtctctcatagtggaggttcctattacagtccgtctctcaagagtcgagtcaccatatctctggacacgtccagcaatcagttttccccngaagtatgagttctgtcgaccgccgctgacacgggtcgtttatacgtgtgcgtagacgacggctatatgtatttttggagttggttatttcgacaccttagcttcggacggggctcggaccctggggcccagggatacgtgtccacgtctcttagcctcgaccgaggcccagtccgtctccccgtggccaccctccaccgtagctccg

SEQ ID NO: 140508 - DNA, 507 bp, Homo sapiens
  misc_feature: GYAE6OF02G5HLB.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagtattttgactaacttattactgtacaacagtaattacaattgtttcggacaagggacacgactaacaaattaaacgaactgtgctagcacatctgtcttcacttctcccgccatctgtac

SEQ ID NO: 140509 - DNA, 500 bp, Homo sapiens
  misc_feature: GYAE6OF02GXB4H.46.67.G01.1.454.CMB.1.raw
  modified_base (406)..(406): a, c, t, g, unknown or other
  misc_feature (406)..(406): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtgatctgggacagatttcactctcaccatcagtaatctgcaacgtgaagatttgctaacttattacttntcaacagaattacaatgtttcgaccaagggacacgactaacaaattaaacgaatgtagctgcacatctgtcttcattcttcccgcactctgtac

SEQ ID NO: 140510 - DNA, 594 bp, Homo sapiens
  misc_feature: GYAE6OF02JX1PH.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgcccctaagctcctaatctatgctgcatccagtttgcaaagtgggtcccatcgaggtcagtgcagtgatcgtgggacagattcactctcaccatcagtaatctgcaacgtgaagtattttgactaacttattaactgttacaaactaagtaaattaactaagtttagtttaccggacctaaaggggtaaccaacggtaaccttaaacgtaaaaactttaaaaccggaaacctttagttacgggaccttacggtaaccaacccgttaattacgttacgttacctttactaacgttccctttaccccggacctaacttctacgttaac

SEQ ID NO: 140511 - DNA, 507 bp, Homo sapiens
  misc_feature: GYAE6OF02GAK7P.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaaattggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagattttgactaacttattactgtacaacagaattacaatgttttcggaccaagggacacgactacaaattaaacgaactgtagctagcacatctgtcttcacttcttcccgcatctgtac

SEQ ID NO: 140512 - DNA, 513 bp, Homo sapiens
  misc_feature: GYAE6OF02HNMIS.46.67.G01.1.454.CMB.1.raw
  modified_base (510)..(510): a, c, t, g, unknown or other
  misc_feature (510)..(510): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctcctaatctatgctgcatccagtttgcaaagtgggtcccatcgagttcagtggcagtggatctgggacagatttcactctcaccatcagtaatctgcaacgtgaagtattttagctaacttattactgtacaacagaattacaattgtttacggaccaagggacaacgactaacaaaattaaacgaactagtagactagcaaccatctgttcttcatcttcccacctatctntac

SEQ ID NO: 140513 - DNA, 694 bp, Homo sapiens
  misc_feature: GYAE6OF02HWY8G.46.67.G01.1.454.CMB.1.raw
  modified_base (106)..(106): a, c, t, g, unknown or other
  misc_feature (106)..(106): n is a, c, g, or t
tcagactagcagtacacgaccggtgctcgatttagagtatacatattggggtttgggggagtctcggtcagggacaccacgcgattggacagtgtagggtccccgngtccagctccgtggggctaccgtagctactctggctcgaggtgccagatgtgactatcgagctagtaaccagtctccatcctccctgtctgcaacgtggaggacagtgtcaccatccgacgttcgccgggacaagtcggaacagttgacacctattaatggtatctactatagacctaggacgacctaagcctccgtaacgtacctaatcgtcgtaggtcagtccgaggttttggactaaacggtcgggtacccagtacgtaggttcgaagttgggctacggtaggtagttcgtgggaacgtaggtacgtttcggaccgttacgttacctaccgtagtccgtaagtaactacgtacgtacgtaaacgtagtaaagtacttttagacctaactttacttaacttacgtaccaaacgtaacgtaaattacgtaaagttacgttttacggaaccgtaaacggtactaacgtaacgttaaacgtaaacgttaaaacggtaacgtttacggtagggtaccgtagtaccgtaaccgtacgttactacggttacgttcgtacgttccgttacccgaccttacgtacctcgtaacc

SEQ ID NO: 140514 - DNA, 543 bp, Homo sapiens
  misc_feature: GYAE6OF02I05S7.46.67.G01.1.454.CMB.1.raw
  modified_base (334)..(334): a, c, t, g, unknown or other
  misc_feature (334)..(334): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttcccngaagatgagttctgtgaccgcgctgacacgggcgttttattactgtgcgagagacggctattatgtatttttggagttggttatttcgactaccctagatcgacggggctcgacccgtgggccagggaatacgtgtcaccgtctccttagcctccgaccgacggcccagtccgtccttccccgtcggccacccgtcctccacgcgtccc

SEQ ID NO: 140515 - DNA, 538 bp, Homo sapiens
  misc_feature: GYAE6OF02HX73D.46.67.G01.1.454.CMB.1.raw
  modified_base (333)..(333): a, c, t, g, unknown or other
  misc_feature (333)..(333): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaagggctggaatacattggaagtgtctctcatagtggaggttcctattacagtccgtctctcaagagtcgagtcaccatatctctggacacgtccagcaatcagttttcccngaagatgagttctgtgaccgcgctgacacgggtcgtttatactgtgcgagagacggctatatgtattttggagtggtttattcgactacctagtatcggacggggctcgacccgtgggccagggaatacgtgtcacgtctccttacgcctccaccgaacggcccatccggtccttccccgtggccaccctcctcctagacgtccg

SEQ ID NO: 140516 - DNA, 510 bp, Homo sapiens
  misc_feature: GYAE6OF02IMCJ6.46.67.G01.1.454.CMB.1.raw
  modified_base (489)..(489): a, c, t, g, unknown or other
  misc_feature (489)..(489): n is a, c, g, or t
  modified_base (499)..(499): a, c, t, g, unknown or other
  misc_feature (499)..(499): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaatggtatcaacatagaccagggacgcccctaagctcctaatctatgctgcatccagtttgcaaagtggggtcccatcgaggttcagtggcagtggatctgggacagatttcactctcaccatcagtaatctgcaacgtgaagtattttgctaacttattactgtacaacataattacaattgtttacggacctaagggtacacgtactaacaaattaaacgaactgtggctagacactatctgtcttnacttctcccnctactctgtac

SEQ ID NO: 140517 - DNA, 506 bp, Homo sapiens
  misc_feature: GYAE6OF02HZBB1.46.67.G01.1.454.CMB.1.raw
  modified_base (408)..(408): a, c, t, g, unknown or other
  misc_feature (408)..(408): n is a, c, g, or t
  modified_base (485)..(485): a, c, t, g, unknown or other
  misc_feature (485)..(485): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagtattttgctaacttattactntacaacagaattacaatgtttcgactaaggacacgactaactaaattaaacgaactagtgctagcacatctgtcttnactcttcccgcctatctgtac

SEQ ID NO: 140518 - DNA, 518 bp, Homo sapiens
  misc_feature: GYAE6OF02GPLE0.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctcctaatctatgctgcatccagtttgcaaagtggggtcccatcgaggttcagtggcagtggatctgggacagatttcactctcaccatcagtaatctgcaacgtgaaagtattttgactaacttattactgtacaacagaattacaagttgttttcggaccaagggacacgtactaacaaattaaacgaactagtaggactgacacactctcgtcttcacttcttcccgccattctgtac

SEQ ID NO: 140519 - DNA, 585 bp, Homo sapiens
  misc_feature: GYAE6OF02H75JB.46.67.G01.1.454.CMB.1.raw
  modified_base (338)..(338): a, c, t, g, unknown or other
  misc_feature (338)..(338): n is a, c, g, or t
  modified_base (342)..(342): a, c, t, g, unknown or other
  misc_feature (342)..(342): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtccctcacctgcgctgtctctggtgcctccatcagtagtggtttcttctggggctggggtccggcagctcccgaggggaaggggctggaatacattggaagtgtctctcatagtggaggttcctattacagtccgtctctcaagagtcgagtcaccatatctctggacacgtccagcaatcagttttcccngaanatgagttctgtgaccgccgctgcgacgggtcgttttattacgtgtgcgagagaccggcttattatgttattttggagtggttatttcgactaccctagatcggacggggctcgaccccgtggggccaaggggaactacgttggtccaccgtccttccgttacgccctccacccgaacgggccctacgtcccggttcctttcccccgtcggcctaccccgttccctacccgaacgacgtacccg

SEQ ID NO: 140520 - DNA, 538 bp, Homo sapiens
  misc_feature: GYAE6OF02G562F.46.67.G01.1.454.CMB.1.raw
tcagactagcagtacacgaccggtgctcgatttagagtatacatattgggtttggtcctcctgctggtggccagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctgggaatacattggaagtgtctctcatagtggaggttcctattacagtccgtctctcaagagtcgagtcaccatatctctggacacgtccagcaatcagttttccctgaagatgagttctgtgaccgcgctgacacgggctttattactgtgcgagagacggctattatgtatttttggagttggttatttcgtactaccctagatcgacggggctcgacccctggggccagggatacgtggtcaccgtctccttagcctccaccgaaggcccatcggtccttcccctggccaccctcctccagagcc

SEQ ID NO: 140521 - DNA, 599 bp, Homo sapiens
  misc_feature: GYAE6OF02INS5H.46.67.G01.1.454.CMB.1.raw
tcagactagcagtacacgaccggtgctcgatttagagtatacatattggggtttggggagtctcggtcaggacacagcatggacatggacgggtccccgctcagctccgtggggctcctgctactctggctccgaggtgccagatgtgacatcgagctgacccagtctccatcctcctgtctgcaaccgtgggagacagtgtccacatcacttggccgggacaaggtcggaactattgaccaccttaatttaaatggtatacaacatagaccgagggaccggaccctaagctacctaatctatgctgcatcctagtttgactaaaggtcgggtacccagtcggtaggttcaggtcggcaggtggatcgtgggacagtattcactctcacatacagtaatctagactaacgtgaagttatttgactaaactttattacttgtacaaactagtaacttaactaagttgtttaccggacgtaaacgggtacaacgtaactaaactaaaacgttaaacgaaacgttgtacgactacgtaccaactaacttcgttacgttaccttacgtaacttccgttacccgacctaacttccgtagtaacc

SEQ ID NO: 140522 - DNA, 534 bp, Homo sapiens
  misc_feature: GYAE6OF02G5QKL.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctcatcagtagtggtttctcgtggggctgggtccggcagctcccgagggaaggggctggaatacattggaagtgtctctcatagtggaggttcctattacagtccgtctctcaagagtcgagtcaccatatctctggacacgtccagcaatcagttttccctgaagatgagttctgtgaccgccgctgacacgggcgtttatactgtgcgagagacggctattatgtatttttggagttggttatttcgactacctagatcggacggggtctcggacccgtgggccagggactacgtggtcaccgtctccttagccctaccg

SEQ ID NO: 140523 - DNA, 532 bp, Homo sapiens
  misc_feature: GYAE6OF02HY6A0.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttccctgaagatgagttctgtgaccgcgctgacacgggcgtttatactgtgcgagagacggctattatgtattttggagttggttatttcgactaccctagatcgacggggctcgaccctggggccagggaatacgtggtcacgtctccttagcctcaccgaaggcccatccgtccttcccctggccaccctcctccagagacc

SEQ ID NO: 140524 - DNA, 542 bp, Homo sapiens
  misc_feature: GYAE6OF02FUITU.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttccctgaagatgagttctgtgaccgccgctgacacgggcgttttattactgtgcgagagacggctattatgtatttttggagttggttatttcgacaccctagatcgacggggctcgaccctggggccagggaatacgtgtcaccgtctcctacgcctcgaccaagggcccagtccggtccttccccgtggcctaccctccctccacgagccc

SEQ ID NO: 140525 - DNA, 533 bp, Homo sapiens
  misc_feature: GYAE6OF02JAWYS.46.67.G01.1.454.CMB.1.raw
  modified_base (372)..(372): a, c, t, g, unknown or other
  misc_feature (372)..(372): n is a, c, g, or t
  modified_base (512)..(512): a, c, t, g, unknown or other
  misc_feature (512)..(512): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccaggaggggctggaatacattggaagtgtctctcatagtggaggttcctattacagtccgtctctcaagagtcgagtcaccatatctctggacacgtccagcaatcagttttcccngaagatgagtttctgtgaccgccgctgacacgggcgtttatactgtgcgagagacggctattatgtagtttttggagttggttatttcgactaccctagatcggacggggtctcggcccgtgggccaggatacgtggtcnccgttctccttagcctacccg

SEQ ID NO: 140526 - DNA, 583 bp, Homo sapiens
  misc_feature: GYAE6OF02HZFFC.46.67.G01.1.454.CMB.1.raw
  modified_base (193)..(193): a, c, t, g, unknown or other
  misc_feature (193)..(193): n is a, c, g, or t
  modified_base (551)..(551): a, c, t, g, unknown or other
  misc_feature (551)..(551): n is a, c, g, or t
tcagactagcagtacacgaccggtgctcgatttagagtatacatattgggtttggggagtctcggtcaggacacagccatggacatgaggggtccccgctcagctcctgggggctcctgctactctggctcgaggtgccagatgtgacatcgagctgacccagtctccatcctccctgtctgcaaccgtgganacagtgtcacgatcacttgccgggcaagtcggaacattgactactattaatggtatcacatagacgaggacgcctaagctactaatctatgctgcatcctagtttgacgtaaaggtcgggtacccagttcggaggttcgaggtcggacaggttggtatcgtgggactagtattcacttcacactatcagtactctagactaacgtagaagttatttcgactaactttattacttacgtacaaacgtagtaaacttactaaatttcgtttaccggaaccgtaagggtaacctacggtaaccttaactaaaacgttaaacgaacgttagtacgtactgtacgactactactcgttacttntacttccgtacccgtactacttccgtataacg

SEQ ID NO: 140527 - DNA, 518 bp, Homo sapiens
  misc_feature: GYAE6OF02HVR84.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgcccctaagctcctaatctatgctgcatccagtttgcaaagtggggtcccatcgaggttcagtggcagtggatctgggacagatttcactctcaccatcagtaatctgacaacgtgaagtattttgactaacttattaactgtacaaacagtaaattacaattgttttacggacctaaagggactaacgaactacaaattaaacgaactgtagctgcacatctgtcttcactcttcccgcctatctgtac

SEQ ID NO: 140528 - DNA, 568 bp, Homo sapiens
  misc_feature: GYAE6OF02JPLSK.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatgtatcaacatagaccaggacgcccctaagctcctaatctatgctgcatccagtttgcaaagtgggtccatcgaggttcagtggcagtggatctgggacagatttcactctcaccatcagtaatctgcaacgtgaagtattttgactaactttatactgtacaaactagtaattactaagttcgttttacggacctaaagggtactaacggtacttaaacgtaaaattaaaccgtaaacttaggtacggtactagtaccgtaacctattactacgttacctttacgacttaccttacccccgtaccgtaacttaccttagtaac

SEQ ID NO: 140529 - DNA, 551 bp, Homo sapiens
  misc_feature: GYAE6OF02I1P4F.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatgtatcaacatagaccagggacggcccctaagctcctaatctatgctgcatccagtttgcaaagtggggtcccatcgaggttcagtgcagtggatctagggacaggatttcactctcacatcagtaatctgacaacgtgaagtattttgactaacttattactagtacaaactagaattacaagttgttttacggacctaaagggaccaacgtaacttaaacaaattaaacgaaacttagtacggacttaggactaacctatacgtcgtactttacacttaccttcccgtactacttcgtagtaacg

SEQ ID NO: 140530 - DNA, 496 bp, Homo sapiens
  misc_feature: GYAE6OF02ILVK8.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccaggacggcccctaagctcctaatctatgctgcatccagtttgcaaagtggggtcccatcgaggttcagtggcagtggatctgggacagatttcactctcaccatcagtaatctgcaacgtgaagattttgctaacttattactgtcaacagaattacaatgtttcgacaaggacacgactacaaattaacgaactgtgctgcacatctgtcttcacttcttcccgccatctgtac

SEQ ID NO: 140531 - DNA, 548 bp, Homo sapiens
  misc_feature: GYAE6OF02IKSX3.46.67.G01.1.454.CMB.1.raw
  modified_base (251)..(251): a, c, t, g, unknown or other
  misc_feature (251)..(251): n is a, c, g, or t
  modified_base (377)..(377): a, c, t, g, unknown or other
  misc_feature (377)..(377): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctggggtccggnagcctcccagggaaggggctggaatacattggaagtgtctctcatagtggaggttcctattacagttccgtctctcaagagtcgagtcaccatatctctggacacgtccagcaatcagttttcccngaacgatgagtttctgtcgaccgccgctgacgacgggtctttattacgtgtgcgagagacggctattatgtagtttttggagttggttatttcgactaccctagatcggacggggctccggacccgtgggccgaggactacgtcggtccaccgtctccttcgccctacccg

SEQ ID NO: 140532 - DNA, 623 bp, Homo sapiens
  misc_feature: GYAE6OF02IMJHK.46.67.G01.1.454.CMB.1.raw
  modified_base (193)..(193): a, c, t, g, unknown or other
  misc_feature (193)..(193): n is a, c, g, or t
  modified_base (218)..(218): a, c, t, g, unknown or other
  misc_feature (218)..(218): n is a, c, g, or t
  modified_base (229)..(229): a, c, t, g, unknown or other
  misc_feature (229)..(229): n is a, c, g, or t
  modified_base (428)..(428): a, c, t, g, unknown or other
  misc_feature (428)..(428): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgacaaccgtggganacagtgtcaccatcacttgccgggnaagtcggaacnttgacactatttaaatgtatcaacatagacaggacggcccctaagctcctaatctatgctgcatccaagtttcacgtaaaggtcggggtcccaagtcgtaggtttcaggtggcaggtggatcgtgggacagtattcactctcacatcagtaatctagacaacgtgaagtatttagactaacttattactagtacctaanaacgtaaattactaaactttgttttaccggaccgtaaacgggtaaccgtaacgtaaccttaaactaaaagtttaaaaccgaaccgttaaggttacggacttaacggaccctaaaccttaacgttccttaacggtttacctttaaccgtactttacccgttaccccgtaacccgtactttccgttaaggttaaccc

SEQ ID NO: 140533 - DNA, 594 bp, Homo sapiens
  misc_feature: GYAE6OF02JTTMR.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatcgtgggacagtatttcactctcaccatcagtaatctagacaacgtagaagtatttagactaacttattactcgtacaacaagtaacttaactaagttagtttttacggaaccgtaacgggtaactaaccggtaaccttaaaccgtaaaattaaaaccggaaacttagtacgggtactacgtaccgtaaccctattacgttacgttacctttacgtactttcccgttaccccgaccttacgttacctagtaacg

SEQ ID NO: 140534 - DNA, 554 bp, Homo sapiens
  misc_feature: GYAE6OF02G6D54.46.67.G01.1.454.CMB.1.raw
  modified_base (288)..(288): a, c, t, g, unknown or other
  misc_feature (288)..(288): n is a, c, g, or t
  modified_base (334)..(334): a, c, t, g, unknown or other
  misc_feature (334)..(334): n is a, c, g, or t
  modified_base (339)..(339): a, c, t, g, unknown or other
  misc_feature (339)..(339): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgagggccttcggagaccctgtccctcacctgcgctgtctctggtgcctccatcagtagtggtttcttctggggctgggtccggcagctccagggaaggggctggaatacattggaagtgtctctcatagtggaggttcctattacagtccgtctctcaagngtcgagtcaccatatctctggacacgtccagcaatcagttttcccngaagntgattctgtgaccgcgctgacacgggtcgtttattactgtgcgagagacggctattatgtattttggagttggtttattcgactaccctagatcggacggggcctcgacccgtggggccagggaactcgtggtccacgtctccttacgcctaccgaccgaacggcccagttccggtccttccccgcgccctacccctcctaccacgacgtacccg

SEQ ID NO: 140535 - DNA, 558 bp, Homo sapiens
  misc_feature: GYAE6OF02HO7X2.46.67.G01.1.454.CMB.1.raw
  modified_base (334)..(334): a, c, t, g, unknown or other
  misc_feature (334)..(334): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttcccngaagatgagttctgtgaccgcgctgacacgggtcgtttattactgtgcgagagacggctattatgtattttggagttggttatttcgactaccctagactcggacggggtcctcgaccccgtggggcccaggggaactacgtgtcaccgtctccttagccctccaccgaacgggcccagtccggtccttcccccgtcggccctaccctccctccacgcgtaccg

SEQ ID NO: 140536 - DNA, 583 bp, Homo sapiens
  misc_feature: GYAE6OF02G6VCZ.46.67.G01.1.454.CMB.1.raw
tcagactagcagtacacgaccggtgctcgatttagagtatacatattgggtttggggagtcgtcggtcaggacacagcatggacatgagggtccccgctcagctccctggggctcctgctacgtctggctccgaggtgccagatgtgacatcgagctgacccagtctccatcctccctgtctgcaaccgtggagacagtgtcaccatcacttgccgggcaagtcggaacattgacacctatttaaagttggtatcaacatagtaccagggacggcccctaagctacctaatctatgcctgcatccagtttgcaagtgggtcccatcgaggttcagtggcgagtggatcgtgggacagatttcactctcgaccatcagtaatctgactaacgtgaagtatttgactaacttattacttgtactaactagtaattacaattgtttaccggacctaacgggacctaacggtaaccttaaacgtaaaacgtttaaaccgaaacttacgtacggtaccttacggacctaacccgtattacgttacgttacctttacaacttccgttcccgacctacttcctagtaacc

SEQ ID NO: 140537 - DNA, 552 bp, Homo sapiens
  misc_feature: GYAE6OF02GFZOY.46.67.G01.1.454.CMB.1.raw
  modified_base (377)..(377): a, c, t, g, unknown or other
  misc_feature (377)..(377): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgagggaaggggctggaatacattggaagtgtctctcatagtggaggttcctattacagtccgtctctcaagagtcgagtcaccatatctctggacacgtccagcaatctagttttcccngaagatgagttctgtgaccgccgctgacacgggtcgtttattactgtgcgagagacggctattatgtagtttttggagttggtttatttcgactaccctagatcggacggggctccggaccccgtggggcccagggaactacgtcggtccgaccgttctccttacgccctacccg

SEQ ID NO: 140538 - DNA, 529 bp, Homo sapiens
  misc_feature: GYAE6OF02IIO10.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggaccctaagctacctaatctatgctgcatccagtttgcaaaggtcggggtacccagtcgaggttcagtggcagtggatcgtgggacagtatttcactctcaccatcagtaatctgcaacgtgaagtatttgactaactttattacttgtacaataagtaattacaattgtttcgaccaagggacaacgactaacaaattaaacgaactagtgactagccaactatctagtcttactactccttacccgctactctagtac

SEQ ID NO: 140539 - DNA, 528 bp, Homo sapiens
  misc_feature: GYAE6OF02HG767.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatctgggacagatttcactctcaccatcagtaatctgcaacgtgaagtattttgactaacttattacttagtcaactagaattacaattagttttcggacctaagggacaacgaacttaacaaattaaacgaactagtaggctagaccaacatctagtcttactacttcttacccgccattctagtaac

SEQ ID NO: 140540 - DNA, 511 bp, Homo sapiens
  misc_feature: GYAE6OF02GEY94.46.67.G01.1.454.CMB.1.raw
  modified_base (508)..(508): a, c, t, g, unknown or other
  misc_feature (508)..(508): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtgatctgggacagatttcactctcaccatcagtaatctgcaacgtgaagtattttgactaacttattactgtacaacagaattactaattgttttacggactaagggactacgaactaacaaaattaaacgaactagtagactgcaacatctgtcttctactctccgcatcntac

SEQ ID NO: 140541 - DNA, 528 bp, Homo sapiens
  misc_feature: GYAE6OF02H6820.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctcctaatctatgctgcatccagtttgcaaagtgggtcccatcgaggttcagtggcagtggatctgggacagatttcactctcaccatcagtaatctgcaacgtgaagattttgactaacttattactgtacaacagtaattacaattgttttacggaccaagggtacaacgactaactaaaacttaaacgaaacttgtaggctagacacctatcctgttcttacacttccttcccgcctattcctagtac

SEQ ID NO: 140542 - DNA, 502 bp, Homo sapiens
  misc_feature: GYAE6OF02JFD2N.46.67.G01.1.454.CMB.1.raw
  modified_base (484)..(484): a, c, t, g, unknown or other
  misc_feature (484)..(484): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagattttgctaacttattactgtacaacagaattacaattgtttcggcctaaggacacgactacaaattaaacgaactgtagctgcaccatctgtcttnatcttcccgcatctgtac

SEQ ID NO: 140543 - DNA, 546 bp, Homo sapiens
  misc_feature: GYAE6OF02JI8I5.46.67.G01.1.454.CMB.1.raw
  modified_base (332)..(332): a, c, t, g, unknown or other
  misc_feature (332)..(332): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctccagggaagggctggaatacattggaagtgtctctcatagtggaggttcctattacagtccgtctctcaagagtcgagtcaccatatctctggacacgtccagcaatcagttttcccngaagatgagttctgtgaccgcgctgacacgggcgtttatactgtgcgtagagacggctattatgtatttttggagttggttatttcgactaccctagatcgacgggggctcgacccgtggggccaggggaatacgtggtcaccgtctccttacgcctcaccgaagggcccagtccggtcttccccgtcggccacccctccgtcccagcgtaccg

SEQ ID NO: 140544 - DNA, 585 bp, Homo sapiens
  misc_feature: GYAE6OF02IOC0A.46.67.G01.1.454.CMB.1.raw
  modified_base (379)..(379): a, c, t, g, unknown or other
  misc_feature (379)..(379): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtgggagacagtgtcaccatcacttggccgggacaaggtcggaacattcgacaccttaatttaaatggtatcaacatagaccagggaccgcccctaagctacctaatctatgctgcatcctagtttgacgaaaggtcggggtacccagttcgtaggttcaggtggacagtggatcgtgggacagtatttcattcncacatacagtaactcgtagacaacgtagaattatttagactaactttattactagtacaactaagtaattactaagttcgtttacggaccgtaagggaactaacggtaactaaacgtaaaattaaaccgaacgtgtacggctacgtaccgacctattccgtagttccttacacgtttccttaccccggactacttccgtagtaacc

SEQ ID NO: 140545 - DNA, 548 bp, Homo sapiens
  misc_feature: GYAE6OF02F33FQ.46.67.G01.1.454.CMB.1.raw
  modified_base (377)..(377): a, c, t, g, unknown or other
  misc_feature (377)..(377): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctggggtccggcagctcccgagggaaggggctgggaatacattggaagtgtctctcatagtggaggttcctattacagtccgtctctcaagagtcgagtcaccatatctctggacacgtccagcaatcagttttcccngaagatgagttctgtgaccgccgctgacacgggtcgtttattactgtgcgagagacggctattatgtatttttggagttggttatttcgactaccctagagtcgacggggctcggaccccgtggggcccgagggaactacgtcggtcacccgtctccgttacgcctacccg

SEQ ID NO: 140546 - DNA, 545 bp, Homo sapiens
  misc_feature: GYAE6OF02HSW0C.46.67.G01.1.454.CMB.1.raw
  modified_base (334)..(334): a, c, t, g, unknown or other
  misc_feature (334)..(334): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttcccngaagatgagttctgtgaccgccgctgacacgggtcgtttattactgtgcgagagacggctattatgtatttttggagttggttatttcgactaccctagtatcgacggggcctcggacccgtggggccagggaatacgtgtcacgtctccttagcctccaccgaacgggcccagtccggtccttccccgtggccaccctcctaccagcgcc

SEQ ID NO: 140547 - DNA, 501 bp, Homo sapiens
  misc_feature: GYAE6OF02GBPFM.46.67.G01.1.454.CMB.1.raw
  modified_base (484)..(484): a, c, t, g, unknown or other
  misc_feature (484)..(484): n is a, c, g, or t
  modified_base (492)..(492): a, c, t, g, unknown or other
  misc_feature (492)..(492): n is a, c, g, or t
  modified_base (498)..(498): a, c, t, g, unknown or other
  misc_feature (498)..(498): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatctgggacagatttcactctcaccatcagtaatctgcaacgtgaagattttgctaacttattactgtcaacagaattacaattgttttcggacctaagggacacgactacaaattaaacgaactgtgactgcacatctgtcttnactctccncatctntac

SEQ ID NO: 140548 - DNA, 544 bp, Homo sapiens
  misc_feature: GYAE6OF02HNVB9.46.67.G01.1.454.CMB.1.raw
  modified_base (331)..(331): a, c, t, g, unknown or other
  misc_feature (331)..(331): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctccagggagggctggaatacattggaagtgtctctcatagtggaggttcctattacagtccgtctctcaagagtcgagtcaccatatctctggacacgtccagcaatcagttttcccngaagatgagttctgtgaccgccgctgacacgggtctttattactgtgcgagagacggctattatgtattttggagttggttatttcgactaccctagactcggacggggctcggacccgtggggccgagggaactacgtgtccaccgtctcctagcctccaccgaacggcccagtccggtccttccccgcggccaccctcctaccacgacgcc

SEQ ID NO: 140549 - DNA, 508 bp, Homo sapiens
  misc_feature: GYAE6OF02F60RJ.46.67.G01.1.454.CMB.1.raw
  modified_base (505)..(505): a, c, t, g, unknown or other
  misc_feature (505)..(505): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacgcccctaagctcctaatctatgctgcatccagtttgcaaagtggggtcccatcgaggttcagtggcagtgatctgggacagatttcactctcacatcagtaatctgacaacgtgaagtattttgactaactttattacttagtactaacagtaattacaattgttttcggactaagggactacgactaacaattaaacgatagtgactgcacatctgtcttcactcttccgctatctntac

SEQ ID NO: 140550 - DNA, 560 bp, Homo sapiens
  misc_feature: GYAE6OF02IZSUW.46.67.G01.1.454.CMB.1.raw
  modified_base (332)..(332): a, c, t, g, unknown or other
  misc_feature (332)..(332): n is a, c, g, or t
  modified_base (338)..(338): a, c, t, g, unknown or other
  misc_feature (338)..(338): n is a, c, g, or t
  modified_base (354)..(354): a, c, t, g, unknown or other
  misc_feature (354)..(354): n is a, c, g, or t
  modified_base (531)..(531): a, c, t, g, unknown or other
  misc_feature (531)..(531): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctgggctgggtccggcagctcccagggaagggctggaatacattggaagtgtctctcatagtggaggttcctattacagtccgtctctcaagagtcgagtcaccatatctctggacacgtccagcaatcagttttcccngaacgntgagttctgtcgaccncgctgacgcggtctttatactgtgcgagagacggctattatgtagttttggagttggtttattcgaactacccttagactcggacggggctccgacccgtgggccagggaactacgtggtcgaccgttctccgttacgccctccaccgtaacgggcccagtccggtcccttccccgnggccctacccgtcctaccacgcgtacccg

SEQ ID NO: 140551 - DNA, 513 bp, Homo sapiens
  misc_feature: GYAE6OF02G1A4Q.46.67.G01.1.454.CMB.1.raw
  modified_base (489)..(489): a, c, t, g, unknown or other
  misc_feature (489)..(489): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaatggtatcaacatagaccagggacggcccctaagctcctaatctatgctgcatccagtttgcaaagtgggtcccatcgagtcagtgcagtggatctgggacagatttcactctcaccatcagtaatctgcaacgtgaagtattttgactaacttattactgtacaacagtaattacaattgtttacggacctaagggacacgactaacaaacttaaacgaactgtgactagacacatctagtcttanacttccttcccgctactctagtac

SEQ ID NO: 140552 - DNA, 543 bp, Homo sapiens
  misc_feature: GYAE6OF02FW7XK.46.67.G01.1.454.CMB.1.raw
  modified_base (375)..(375): a, c, t, g, unknown or other
  misc_feature (375)..(375): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgagggaaggggctggaatacattggaagtgtctctcatagtggaggttcctattacagtccgtctctcaagagtcgagtcaccatatctctggacacgtccagcaatcagttttcccngaagatgagttctgtgaccgcgctgacacgggtctttatactgtgcgagagacggctattatgtatttttggagttggttatttcgactaccctagactcgacggggctccggacccgtggggccagggaactacgtcggtcaccggttctccgttacgccctacccg

SEQ ID NO: 140553 - DNA, 524 bp, Homo sapiens
  misc_feature: GYAE6OF02JF7YP.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccaggacgcccctaagctcctaatctatgctgcatccagtttgcaaagtgggtcccatcgaggttcagtggcagtggatctgggacagatttcactctcaccatcagtaatctgcaacgtgaagtattttgctaacttattaactgtacaacagtaattacaattgttttacggaccaagggacaacgtactaacaaacttaaacgaaactgtaggactgacaccatctagtacttacacttccttacccgctattctagtaac

SEQ ID NO: 140554 - DNA, 585 bp, Homo sapiens
  misc_feature: GYAE6OF02IB5PG.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactattaaatgtatcaacatagaccaggacgcccctaagctcctaatctatgctgcatccagtttgacaaagtgggtcccatcgaggttcagtggcagtggatcgtggacagatttcactctcaccatcagtaatctgacaacgtagaagtattttgactaactttattacttgtacaaactaagtaattaactaattagttttaccggaccgtaaagggaccaacgtaacctaaactaaaagtttaaaaccgtaaacttaggtaggactacggacctaaccctaattaccttacgttacctttaccgtaactttaccctttacccccggtacctaacttaccttaggtaac

SEQ ID NO: 140555 - DNA, 540 bp, Homo sapiens
  misc_feature: GYAE6OF02HCH9E.46.67.G01.1.454.CMB.1.raw
  modified_base (332)..(332): a, c, t, g, unknown or other
  misc_feature (332)..(332): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggagggctggaatacattggaagtgtctctcatagtggaggttcctattacagtccgtctctcaagagtcgagtcaccatatctctggacacgtccagcaatcagttttcccngaagatgagttctgtgaccgcgctgacacgggcgtttatactgtgcgagagacggctattatgtattttggagttggttatttcgactaccctagatcgacggggctcgacccgtggggccagggaatacgtggtcaccgtctccttagcctccaccgaacggcccagtccggtccttccccgtggccaccctcctcccaagacgtcc

SEQ ID NO: 140556 - DNA, 546 bp, Homo sapiens
  misc_feature: GYAE6OF02FPLAX.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttcccctgaagatgagttctgtgaccgccgctgacacgggcgtttattactgtgcgagagacggctattatgatttttggagttggttatttcgacaccctagatcgacggggctcgacccgtggggccagggaatacgtggtcaccgtctccttagcctccaccgaacggccctagtccggtccttcccccgtggccaccctcctcccacgcgtccc

SEQ ID NO: 140557 - DNA, 557 bp, Homo sapiens
  misc_feature: GYAE6OF02IXA34.46.67.G01.1.454.CMB.1.raw
  modified_base (331)..(331): a, c, t, g, unknown or other
  misc_feature (331)..(331): n is a, c, g, or t
  modified_base (335)..(335): a, c, t, g, unknown or other
  misc_feature (335)..(335): n is a, c, g, or t
  modified_base (357)..(357): a, c, t, g, unknown or other
  misc_feature (357)..(357): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctccgagggagggctggaatacattggaagtgtctctcatagtggaggttcctattacagtccgtctctcaagagtcgagtcaccatatctctggacacgtccagcaatctagtttccngaantgattctgtgaccgcgctgacncgggtcttttatacgtgtcgcgagagacggctattagtgttagttttggagttggttatttcgactacctagatcgggacggggctccgacccgtggggccagggaactacgtcgtacaccgttctccgttacgcctaccaaccgaacggcccagtccggtccttcccccgtggcctaccctccctaccgaacgacgccg

SEQ ID NO: 140558 - DNA, 543 bp, Homo sapiens
  misc_feature: GYAE6OF02GT2ZV.46.67.G01.1.454.CMB.1.raw
  modified_base (540)..(540): a, c, t, g, unknown or other
  misc_feature (540)..(540): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttccctgaagatgagttctgtgaccgccgctgacacgggtcgttttattactgtgcgagagacggctattatgtatttttggagttggttatttcgacaccctagatcgacggggctcgacccgtggggccgagggatacgtgtcaccgtctccttagcctccaccgacgggcccacgtccggtccttccccgtcggccaccctcctccagngcc

SEQ ID NO: 140559 - DNA, 551 bp, Homo sapiens
  misc_feature: GYAE6OF02I9D4P.46.67.G01.1.454.CMB.1.raw
  modified_base (372)..(372): a, c, t, g, unknown or other
  misc_feature (372)..(372): n is a, c, g, or t
  modified_base (430)..(430): a, c, t, g, unknown or other
  misc_feature (430)..(430): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgagggaggggctggaatacattggaagtgtctctcatagtggaggttcctattacagtccgtctctcaagagtcgagtcaccatatctctggacacgtcagcatcagttttcccngaagatgagttctgtgaccgccgctgacacgggtcgtttattactgtgcgagagacgntattatgtattttggagttggttatttcgactacccgtagtacgtcggacggggctccggccccgtcggggccgagggaacgtacgtcggtccgtaccgttcctccgttacgccctacccg

SEQ ID NO: 140560 - DNA, 506 bp, Homo sapiens
  misc_feature: GYAE6OF02HDDRY.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccaggacggcccctaagctcctaatctatgctgcatccagtttgcaaagtgggtcccatcgagttcagtggcagtgatctgggacagattcactctcacatcagtaatctgcaacgtgaagtattttagctaacttattactgtacaacagtaattacaattcgtttacggaccaagggacacgaactaacaaattaaacaactgtaggctgacaccatctgtcttcacttctcccgacatctgtac

SEQ ID NO: 140561 - DNA, 506 bp, Homo sapiens
  misc_feature: GYAE6OF02FZ1K5.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatctgggacagatttcactctcaccatcagtaatctgcaacgtgaagattttgactaacttattactgtacaacagtaattacaattgttttacggacctaagggacacgactacaaattaaacgaactgtgctgcaacatctgtcttcacttctccgcatctgtac

SEQ ID NO: 140562 - DNA, 544 bp, Homo sapiens
  misc_feature: GYAE6OF02IWD18.46.67.G01.1.454.CMB.1.raw
  modified_base (332)..(332): a, c, t, g, unknown or other
  misc_feature (332)..(332): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctgggctgggtccggcagctcccagggaagggctggaatacattggaagtgtctctcatagtggaggttcctattacagtccgtctctcaagagtcgagtcaccatatctctggacacgtccagcaatcagttttcccngaagatgagttctgtgaccgccgctgacacgggtctttatactgtgcgagagacggctattatgtattttggagttggttatttcgactaccctagatcgacggggctcgacccgtggggccagggaatacgtggtccaccgtctccttagcctccaccgaacgggcccagtccgtccttcccccgtggcctacccctcctcccagcgaccc

SEQ ID NO: 140563 - DNA, 541 bp, Homo sapiens
  misc_feature: GYAE6OF02HT1XA.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcgaacattgacactatttaaatggtatcaacatagaccagggacggcccctaagctcctaatctatgctgcatccagtttgcaaagtgggtcccatcgaggttcagtggcagtgatctggacagatttcactctcaccatcagtaatctgcaacgtgaagtattttgactaacttattactgtacaactagaattactaattgtttcggacctaagggacacgtactaacgtaaattaaacgtaaacgtagtagcttagaccgactactctacgttacctttacgtacttaccgttcccgtaccgtaacttctgtaaccg

SEQ ID NO: 140564 - DNA, 503 bp, Homo sapiens
  misc_feature: GYAE6OF02GRF3R.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctcctaatctatgctgcatccagtttgcaaagtgggtcccatcgaggttcagtggcagtgatctgggacagatttcactctcaccatcagtaatctgcaacgtgaagattttgctaacttattacttgtcaacagaattacaattgtttacggactaagggacacgactaacaaattaaacgaactgtagctgacacatctgtcttcatcttcccgctatctgtac

SEQ ID NO: 140565 - DNA, 523 bp, Homo sapiens
  misc_feature: GYAE6OF02G0D0W.46.67.G01.1.454.CMB.1.raw
  modified_base (520)..(520): a, c, t, g, unknown or other
  misc_feature (520)..(520): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctcctaatctatgctgcatccagtttgcaaagtgggtcccatcgaggttcagtggcagtggatctgggacagatttcactctcacctatcagtaatctgcaacgtgaagtattttgactaacttattacttgtacaactagaattacaattgttttacggacctaagggacacgaactaacaaattaaacgaactagtagactgacaccatctagttcttacacttccttccgacctactctntac

SEQ ID NO: 140566 - DNA, 536 bp, Homo sapiens
  misc_feature: GYAE6OF02I0RVM.46.67.G01.1.454.CMB.1.raw
  modified_base (330)..(330): a, c, t, g, unknown or other
  misc_feature (330)..(330): n is a, c, g, or t
  modified_base (521)..(521): a, c, t, g, unknown or other
  misc_feature (521)..(521): n is a, c, g, or t
  modified_base (528)..(528): a, c, t, g, unknown or other
  misc_feature (528)..(528): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccgcagctccagggagggctggaatacattggaagtgtctctcatagtggaggttcctattacagtccgtctctcaagagtcgagtcaccatatctctggacacgtccagcaatcagttttcccngaagatgagttctgtgaccgcgctgacacggcgtttattactgtgcgagagacggctattatgtatttttggagttggttatttcggactacccgtagtatcggacggggctccgaccccgtggggccagggaatacgtggtcaccgtctcctagcctccaccgaacggccatccggtcctccccgtgccnccctccnccagcgcc

SEQ ID NO: 140567 - DNA, 537 bp, Homo sapiens
  misc_feature: GYAE6OF02G41V2.46.67.G01.1.454.CMB.1.raw
  modified_base (334)..(334): a, c, t, g, unknown or other
  misc_feature (334)..(334): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttcccngaagatgagttctgtgaccgccgctgacacgggtcttttatactgtgcgagagacggctattatgtattttggagttggttatttcgactaccctagatcgacggggctcgacccgtgggccagggatacgtgtcaccgtctccttacgcctccaccgacgggcccagtccgtcttccgtcctcggccaccctctccagtacg

SEQ ID NO: 140568 - DNA, 535 bp, Homo sapiens
  misc_feature: GYAE6OF02HMZHQ.46.67.G01.1.454.CMB.1.raw
  modified_base (248)..(248): a, c, t, g, unknown or other
  misc_feature (248)..(248): n is a, c, g, or t
  modified_base (372)..(372): a, c, t, g, unknown or other
  misc_feature (372)..(372): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccgnagctccgagggaagggctggaatacattggaagtgtctctcatagtggaggttcctattacagtccgtctctcaagagtcgagtcaccatatctctggacacgtccagcaatctagttttcccngaagatgtagttctgtcgaccgccgctgacgacgggtcgtttattactgtgcgagagacgctattatgtattttggagttggttattcgactacctagtatacgacggggctccggacccgtgggccagggtaatcgtggtactaccgtctctacgcctaccg

SEQ ID NO: 140569 - DNA, 551 bp, Homo sapiens
  misc_feature: GYAE6OF02JWPXX.46.67.G01.1.454.CMB.1.raw
  modified_base (192)..(192): a, c, t, g, unknown or other
  misc_feature (192)..(192): n is a, c, g, or t
  modified_base (372)..(372): a, c, t, g, unknown or other
  misc_feature (372)..(372): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacacctatttaaattggtatcaacatagaccaggacggccctaagctcctaatctatgctgcatccagtttgcaaagtgggtcccatcgagttcagtgcagtgatctgggacagtatttcactctcacatcagtaatctancaacgtgaatatttagactaacttattacttgtacaactagtaacttactaagttgttttacgacgtaaggtacaacgttaactaaactaaacgttaaacaacgttagtacgactagacgtacctattcttacgttacttaccgtacttccgttacccgtacctacttacctagtaacc

SEQ ID NO: 140570 - DNA, 503 bp, Homo sapiens
  misc_feature: GYAE6OF02H7983.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgcccctaagctcctaatctatgctgcatccagtttgcaaagtgggtcccatcgaggttcagtgcagtgatctgggacagattcactctcaccatcagtaatctgcaacgtgaagtatttgctaacttattactgtacaactagaattacaattgtttacggacctaagggacacgactaacaaataaacgaactgtgctgacacatctagtcttcactcttccgccactctgtac

SEQ ID NO: 140571 - DNA, 552 bp, Homo sapiens
  misc_feature: GYAE6OF02H52M0.46.67.G01.1.454.CMB.1.raw
  modified_base (333)..(333): a, c, t, g, unknown or other
  misc_feature (333)..(333): n is a, c, g, or t
tcagactagcagtacacgaccggtgctcgatttagagtatacatattgggtttgtcctcctgctggtggtagctcccagatgggtcctgtccctggtgcaactgcaggagtcgggcccacgactggtgaggccttcggagaccctgtccctcacctgcgctgtctctggtgcctccatcagtagtggtttcttctggggctgggtcctgcagctcccagggaagggctggaatacattggaagtgtctctcatagtggaggttcctattacagtccgtctctcaagagtcgagtcaccatatctctggacacgtccagcaatcagttttcccngaagatgagttctgtgaccgccgctgacacgggtcgtttattactgtgcgagagacggctattatgtattttggagttggtttatttcgactaccctagagtcgacggggtctcgacccgtcggggccagggaatacgtgtcaccgtctccttagcctccaccgaacggcccagtccggttccttcccccgtcggccacccctcctccacgcgtacccg

SEQ ID NO: 140572 - DNA, 508 bp, Homo sapiens
  misc_feature: GYAE6OF02ILZ3C.46.67.G01.1.454.CMB.1.raw
  modified_base (191)..(191): a, c, t, g, unknown or other
  misc_feature (191)..(191): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtggganacagtgtcaccatcacttgccgggcaagtcggaacattgacacctatttaaatggtatcaacatagaccaggacggcccctaagctcctaatctatgctgcatccagtttgcaaagtgggtcccagtcgaggttcagtgcagtggatctgggacagattcactctcacctatcagtaatctgcaacgtgaagtattttgactaacttattactgtactaactagtaattacattgtttacgactaaggactacgactaactaattaaacgactgtagctgacactatctgtcttatactctacccgctatctagtac

SEQ ID NO: 140573 - DNA, 552 bp, Homo sapiens
  misc_feature: GYAE6OF02JVUG4.46.67.G01.1.454.CMB.1.raw
  modified_base (285)..(285): a, c, t, g, unknown or other
  misc_feature (285)..(285): n is a, c, g, or t
  modified_base (354)..(354): a, c, t, g, unknown or other
  misc_feature (354)..(354): n is a, c, g, or t
  modified_base (386)..(386): a, c, t, g, unknown or other
  misc_feature (386)..(386): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccgcagctcccagggagggctggaatacattggaagtgtctctcatagtggaggttcctattacagtccgtctctcaagngtcgagtcaccatatctctggacacgtccagcaatctagtttcccagaagatgagttctgtcgaccgcnctgacacggtctttatactgtgcgagagacgntatatgtattttggagttgttagttcgactaccgtagtacgtcggacgggtctcgacccgtgggacgagggatacgtgtctacgtctcgttacgcctccaccgaacggtcccagtcccggttccttccccgtcggcccaccccgttccgtacccgacgcgtacccg

SEQ ID NO: 140574 - DNA, 502 bp, Homo sapiens
  misc_feature: GYAE6OF02G2F8P.46.67.G01.1.454.CMB.1.raw
  modified_base (338)..(338): a, c, t, g, unknown or other
  misc_feature (338)..(338): n is a, c, g, or t
  modified_base (481)..(481): a, c, t, g, unknown or other
  misc_feature (481)..(481): n is a, c, g, or t
  modified_base (491)..(491): a, c, t, g, unknown or other
  misc_feature (491)..(491): n is a, c, g, or t
  modified_base (498)..(498): a, c, t, g, unknown or other
  misc_feature (498)..(498): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccaggacgcccctaagctcctaatctatgctgcatccagtttgacaaagtgggtcccatcgagttcagtgcagtgatntgggacagattcactctcaccatcagtaatctgacaacgtgaagtatttgactaacttattactgtacaatagaattacaattgtttcggaccaagggacacgactaacaaattaaacaactgtagctagcacatctgtcttnacttcttccnccatctntaac

SEQ ID NO: 140575 - DNA, 562 bp, Homo sapiens
  misc_feature: GYAE6OF02ITLMJ.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctctaatctatgctgcatccagtttgcaaagtgggtcccatcgaggttcagtggcagtggatcgtgggacagtatttcactctcaccatcagtaatctgcaacgtgaagtattttgactaacttattacttgtacaaactagtaaattactaagttgttttaccggaccgtaaagggtaccaacggtaacttaaacgtaaaattaaacggtaaactggtaggacttaggacctaacctaactcttacgttctttacacttccttacccgcctacttactgtaac

SEQ ID NO: 140576 - DNA, 538 bp, Homo sapiens
  misc_feature: GYAE6OF02HIO6P.46.67.G01.1.454.CMB.1.raw
  modified_base (384)..(384): a, c, t, g, unknown or other
  misc_feature (384)..(384): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactattaaatgtatcaacatagacagggacggcccctaagctcctaatctatgctgcatccagtttgcaaagtgggtcccatcgagttcagtggcagtgatcgtgggacagtatttcactctcaccatcagtaatctgacaacgtgaagtnttttgactaacttattactgttacaatagaattacaattcgtttcggactaagggacaacgaactaactaaacttaaacgaacttgtacggacttgactaaccattctacgtcctttacgacttcccttacccgtaccctaattccgtagtaac

SEQ ID NO: 140577 - DNA, 573 bp, Homo sapiens
  misc_feature: GYAE6OF02IOF0D.46.67.G01.1.454.CMB.1.raw
  modified_base (248)..(248): a, c, t, g, unknown or other
  misc_feature (248)..(248): n is a, c, g, or t
  modified_base (347)..(347): a, c, t, g, unknown or other
  misc_feature (347)..(347): n is a, c, g, or t
  modified_base (352)..(352): a, c, t, g, unknown or other
  misc_feature (352)..(352): n is a, c, g, or t
  modified_base (374)..(374): a, c, t, g, unknown or other
  misc_feature (374)..(374): n is a, c, g, or t
  modified_base (378)..(378): a, c, t, g, unknown or other
  misc_feature (378)..(378): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtgtttctcgtggggctgggtccgnagcctcccgagggaagggctggaatacattggaagtgtctctcatagtggaggttcctattacagtccgtctctcaagagtcgagtcacctatatctcnggacncgtccagcaatcagttttcccngaantgtagttctgtgaccgccgctgacgacgggtcgtttaattacgtgtgtaccgagacggacggcttattagtcgttagttttttggagttggtttatttcgtaacctacccttagactacggacggggctccggacccgtggggaccgtagggaactacgtcggtactaccgttcctaccgttacgccgtaccccg

SEQ ID NO: 140578 - DNA, 586 bp, Homo sapiens
  misc_feature: GYAE6OF02I66N4.46.67.G01.1.454.CMB.1.raw
  modified_base (218)..(218): a, c, t, g, unknown or other
  misc_feature (218)..(218): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatccgagctgacccagtctccatcctccctgtctgcaaccgtgggagacagtgtcaccatcacttgccgggnaagtcggaacattgacacctatttaaatgtatcaacatagaccaggacggcccctaagctcctaatctatgctgcatccagtttgcaaagtcgggtcccatcgaggttcagtggcagtggatcgtgggacaggtatttcactctcacctatcagttaactctagaccaacgtgaaagtattttagacttaactttattacttgtacaactagtaaattactaatttacgtttaccggaccaaggggtacctaacgtaacgttaactaaaacgtttaaacgaacgttaggtacggaccttagaccaaccgtacttacgtacgttccttacctactttacccgttccccgaccgtactccgttagtaacc

SEQ ID NO: 140579 - DNA, 596 bp, Homo sapiens
  misc_feature: GYAE6OF02ICIM9.46.67.G01.1.454.CMB.1.raw
  modified_base (224)..(224): a, c, t, g, unknown or other
  misc_feature (224)..(224): n is a, c, g, or t
  modified_base (235)..(235): a, c, t, g, unknown or other
  misc_feature (235)..(235): n is a, c, g, or t
tcagactagcagtacacgaccggtgctcgatttagagtatacatattgggtttgggggagtctcggtcaggacacagcatggacatggtagggtccccgctcagctcctggggctcctcgctactcgtggctccgaggtgccagatgtgacagtccgagctgacccagtctccgatcctcctgtctgcaaccgtgggagacagtgtcaccatcacttgccgggntaagtcggacnttgaccactattaactggtatcgaacatagaccagggacggcccctaagctcctatctatgctgctactcctagtttcgctaaaggtcgggtcccagtcgtaggttcagtgctaggtggatcgtggacagtattcacgttcctacaccatcagtatcgtcgaccacgtgaagtactttcggacttaaacttacttactgtaccaacgtaacgtaacttactaattggtttaccggacgttaagggacctacgtaacttaacgtaaacttaaaccgaacttgtggaccgtacgaccgtaaccgtaggtacctggttaccttacgtacgtttcccgttaccccgtactacttcgtcgtaaccg

SEQ ID NO: 140580 - DNA, 727 bp, Homo sapiens
  misc_feature: GYAE6OF02II4AD.46.67.G01.1.454.CMB.1.raw
  modified_base (183)..(183): a, c, t, g, unknown or other
  misc_feature (183)..(183): n is a, c, g, or t
  modified_base (197)..(197): a, c, t, g, unknown or other
  misc_feature (197)..(197): n is a, c, g, or t
  modified_base (231)..(231): a, c, t, g, unknown or other
  misc_feature (231)..(231): n is a, c, g, or t
  modified_base (245)..(245): a, c, t, g, unknown or other
  misc_feature (245)..(245): n is a, c, g, or t
tcagactagcagtacacgaccggtgctcgatttagagtatacatattgggtttggggtagtctcggtcaggacacagcatggacatgagggtccccgctcagctcctggggctcctgctactctggctccggaggtcgccagatgtgacatcgagctgacccagtctccactcctccctgtcncgctaacggtgganacgtagtgtccaaccatcctacttcggccggganaaggtcggaaactnttcgaccacttaattttaaagtgtataccgtaaacataacgacgaaggaccggtacccctaagcctaccgtaataccttatacgtctagcctactccctagttttcgacaaaagggttccgggtaccattcggtacggtttacaggttcggacaggtcgtagtcggttagggtaaccaggttaatttccgacttacctaccgaccctattccgtaagtaactacctagtaccgtaaacgtcgtaaagttactttacggtaactaactttaacgttacttagttacctaacgtaaactaaagtttaacaacgtttacggttttacggaaccgtaaggggtaacctaaccggtaacttaaaccgaaacgtttaaaacgaacttagttacgggacttacgacctaaacccgtattaccgttaacgttaccgttttaactaccgtttacccgttacccgttaacccgtacttaccgtacttaaccg

SEQ ID NO: 140581 - DNA, 500 bp, Homo sapiens
  misc_feature: GYAE6OF02GWJS7.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagattttgcaactattactgtcaacagaattacaatgttttcgccaaggacacgactacaaattaaacgaactagtgctgacaccatctgtcttctatcttcccgccatctgtac

SEQ ID NO: 140582 - DNA, 561 bp, Homo sapiens
  misc_feature: GYAE6OF02H7TA1.46.67.G01.1.454.CMB.1.raw
  modified_base (251)..(251): a, c, t, g, unknown or other
  misc_feature (251)..(251): n is a, c, g, or t
  modified_base (334)..(334): a, c, t, g, unknown or other
  misc_feature (334)..(334): n is a, c, g, or t
  modified_base (380)..(380): a, c, t, g, unknown or other
  misc_feature (380)..(380): n is a, c, g, or t
  modified_base (449)..(449): a, c, t, g, unknown or other
  misc_feature (449)..(449): n is a, c, g, or t
  modified_base (455)..(455): a, c, t, g, unknown or other
  misc_feature (455)..(455): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggcctttcggagaccctgtccctcacctgcgctgtctctggtgcctccatcagtagtggtttcttctggggctgggtccggnagctcccgaggggaaggggctgggaatacagttggaagtgtctctcatagtggaggttcctattacagttccgtctctcaagngtcgagtcaccatatctctggacacgtcagcaatctagttttcccngaagattgagtttctggtcgaccgccgctgacgacgggtcgtttattactggtcgcgagacggacggtntaattntgtagtttttggagttggttatttcgactacctagacgtcggacggggtctcggacccgtgggccaagggtaatacgtggtccaccgtctcgttacgccctacccg

SEQ ID NO: 140583 - DNA, 546 bp, Homo sapiens
  misc_feature: GYAE6OF02GUGW2.46.67.G01.1.454.CMB.1.raw
  modified_base (288)..(288): a, c, t, g, unknown or other
  misc_feature (288)..(288): n is a, c, g, or t
  modified_base (334)..(334): a, c, t, g, unknown or other
  misc_feature (334)..(334): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctggggtccggcagctcccagggaagggctggaatacattggaagtgtctctcatagtggaggttcctattacagtccgtctctcaagngtcgagtcaccatatctctggacacgtccagcaatcagttttcccngaagatgagttctgtgaccgcgctgacacgggtctttattactgtgcgagagacggctattatgtatttttggagttggttatttcgaactaccctagactcggacggggctcgacccgtggggccagggactacgtgtcacgtctccttagccctccgaccgaacgggcccacgtccgtccttccccgtcgccaccctcctccacgacgcc

SEQ ID NO: 140584 - DNA, 596 bp, Homo sapiens
  misc_feature: GYAE6OF02JMSQ8.46.67.G01.1.454.CMB.1.raw
  modified_base (292)..(292): a, c, t, g, unknown or other
  misc_feature (292)..(292): n is a, c, g, or t
  modified_base (338)..(338): a, c, t, g, unknown or other
  misc_feature (338)..(338): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagcctcccgagggaaggggctggaatacagttggaagtgtctctcatagtggaggttcctattacagtccgtctctcaagngtcgagtcaccatatctctggacacgtccagcaatcagttttcccngaacgatgagttctgtcgaccgccgcgtgacgtacgggtctttatactggtgacgtagaggacggcttattagtgtattttggagttggttattcgactacccgtagtactcggtacggggctccggacccgtacggggccaggggaacttacgtgttccacccggttcttaccgtacgccctacccaccggaacgggtcccacgtccggtcccgttccccgtcggccctaccccgtcctacccgtacgccgtacccg

SEQ ID NO: 140585 - DNA, 534 bp, Homo sapiens
  misc_feature: GYAE6OF02G6UND.46.67.G01.1.454.CMB.1.raw
  modified_base (248)..(248): a, c, t, g, unknown or other
  misc_feature (248)..(248): n is a, c, g, or t
  modified_base (372)..(372): a, c, t, g, unknown or other
  misc_feature (372)..(372): n is a, c, g, or t
  modified_base (512)..(512): a, c, t, g, unknown or other
  misc_feature (512)..(512): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccgnagctcccagggaaggggctggaatacattggaagtgtctctcatagtggaggttcctattacagtccgtctctcaagagtcgagtcaccatatctctggacacgtccagcaatcagttttcccngaagatgagttctgtgaccgccgctgacgacgggtcgtttattacgtgttgcgagagacgctattatgtatttttggagttggttatttcgactacctagatcgacggggctccgcccgtgggccagggactgtcggtcnccgtctccgttagccctacccg

SEQ ID NO: 140586 - DNA, 516 bp, Homo sapiens
  misc_feature: GYAE6OF02IKNXG.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctcctaatctatgctgcatccagtttgcaaagtgggtcccatcgagttcagtggcagtggatctgggacagatttcactctcaccatcagtaatctgcaacgtgaagtattttgctaacttattacttagtacaacagtaattacaattgtttacggaccaaggacacgaactaactaaattaaacgaactgtagactgacaccatcttgtcttcacttccttcccgctactctgtaac

SEQ ID NO: 140587 - DNA, 546 bp, Homo sapiens
  misc_feature: GYAE6OF02ICJJH.46.67.G01.1.454.CMB.1.raw
  modified_base (251)..(251): a, c, t, g, unknown or other
  misc_feature (251)..(251): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggcctttcggagaccctgtccctcacctgcgctgtctctggtgcctccatcagtagtggtttcttctggggctgggtccggnagctcccagggaagggctggaatacattggaagtgtctctcatagtggaggttcctattacagtccgtctctcaagagtcgagtcaccatatctctggacacgtccagcaatcagttttccctgaagatgagttctgtgaccgcgctgacgacgggtcgtttattactgtgcgagagacgctattattgtatttttggagttggttatttcgactacctagatcgacggggctccggacccgtgggccagggaacgtacgtcggtaccgaccgttcctccgttacgccctacccg

SEQ ID NO: 140588 - DNA, 508 bp, Homo sapiens
  misc_feature: GYAE6OF02I32WM.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagtattttgactaacttattactgtacaacagaacttacaattgtttcggacctaagggacacgactaactaaattaaacgaactgtagctgcacatctgtcttcatcttcccgcatctgtac

SEQ ID NO: 140589 - DNA, 510 bp, Homo sapiens
  misc_feature: GYAE6OF02HQUYP.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacgcccctaagctcctaatctatgctgcatccagtttgcaaagtgggtccatcgaggttcagtggcagtggatctgggacagatttcactctcaccatcagtaatctgacaacgtgaagtattttgactaacttattactgtacaactagaaattacaattgtttcggaccaagggacacgtactaactaaattaaacgaatagtgctgacacatctgtcttcactccttcccgctatctagtac

SEQ ID NO: 140590 - DNA, 508 bp, Homo sapiens
  misc_feature: GYAE6OF02H342B.46.67.G01.1.454.CMB.1.raw
  modified_base (483)..(483): a, c, t, g, unknown or other
  misc_feature (483)..(483): n is a, c, g, or t
  modified_base (504)..(504): a, c, t, g, unknown or other
  misc_feature (504)..(504): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccaggacggcccctaagctcctaatctatgctgcatccagtttgcaaagtgggtcccatcgagttcagtgcagtgatcgtgggacagattcactctcaccatcagtaatctgactaacgtgaagtatttagactaacttattactgtacaacagtaaattacaattgttttcgaccaagggacacgaactaacaaattaaacgaactgtagactacacatctntacttcatcttccgccatctnatac

SEQ ID NO: 140591 - DNA, 704 bp, Homo sapiens
  misc_feature: GYAE6OF02HSD8L.46.67.G01.1.454.CMB.1.raw
  modified_base (243)..(243): a, c, t, g, unknown or other
  misc_feature (243)..(243): n is a, c, g, or t
tcagactagcagtacacgaccggtgctcgattttagagtatacataagttaggggtttggggagttactcgggttctaggacacgagcagtggacatgagggtaccccgctcaagctaccgtggggctacctgcttactcctggctccgaggtgcctaggtatgtgacattcgagctgacccagtcgtccatcctccctgtctgcaaccgtcgggagactagtgtcacatcacttgccggganaagtcgaacattcgacaccgtatttaaattggtatcaacatagaccgagggtacgcccctaagcctcctaatactaatgctgcactcccaagttttcgactaaaggtcgggtacccaagtcgaggttcagtggcagtgatcggtcggacgagtactttcacgttctacgtaaccgattccgtaagttaacttcgttacgtacccaaacggtcggtaaaacgttaagtttttacgaacttaaacgttttaacgtttaacgttacgttaacaaacgtaaagtaaactttaactaagtttcggttttacggaaacccttaaagggtacctaaccgtaacttaaacctaaaacgtttaaacgaaacgttttgtacggtaccgttcgaaccgtaacctaacgttccgttacgttaccgttaccgttacttaccgtttaccccgacctttaacgttcctagttaacc

SEQ ID NO: 140592 - DNA, 576 bp, Homo sapiens
  misc_feature: GYAE6OF02JAKPG.46.67.G01.1.454.CMB.1.raw
  modified_base (332)..(332): a, c, t, g, unknown or other
  misc_feature (332)..(332): n is a, c, g, or t
  modified_base (362)..(362): a, c, t, g, unknown or other
  misc_feature (362)..(362): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggagggctggaatacattggaagtgtctctcatagtggaggttcctattacagtccgtctctcaagagtcgagtcaccatatctctggacacgtccagcaatcagttttcccngaagatgagttctgtcgaccgccgctgacncgggtctttattactgtgcgagagacggctattatgtattttggagttggttatttcgacaccctagatcggacggggctcgaccccgtaggggcccgaagggaacttacgtcggtcgtacccgtcttccgttacgccctaccgaccgaacgggccctacgtccggttccttcccccgtcggccctaccccttccctacccgacggacgtaccc

SEQ ID NO: 140593 - DNA, 556 bp, Homo sapiens
  misc_feature: GYAE6OF02GZ9M1.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatgtatcaacatagacagggacggcccctaagctctaatctatgctgcatccagtttgcaagtgggtccatcgagttcagtggcagtgatctggacagatttcactctcaccatcagtaatctgacaacgtgaagtattttagactaacttattacttagtactaaactagaacttaactaattgtttaccggaccgtaaagggtaccaaccgtaacttaaacgaaaattaaacgaaacttaggtacgacttagacctaacctaattacctgttacctttacacttccttacccgtacctacttctacgtaac

SEQ ID NO: 140594 - DNA, 550 bp, Homo sapiens
  misc_feature: GYAE6OF02IFDSL.46.67.G01.1.454.CMB.1.raw
  modified_base (289)..(289): a, c, t, g, unknown or other
  misc_feature (289)..(289): n is a, c, g, or t
  modified_base (335)..(335): a, c, t, g, unknown or other
  misc_feature (335)..(335): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcaccctgcgctgtctctggtgcctccatcagtagtggtttcttctggggctgggtccggcagctcccagggaaggggctggaatacattggaagtgtctctcatagtggaggttcctattacagtccgtctctcaagngtcgagtcaccatatctctggacacgtccagcaatcagttttcccngaagatgagttctgtgacccgccgctggacgacgggtcgttttattactgtgcgagagacggctattatgtattttggagttggttatttcgactacctagatcggacggggctcgacccgtggggccagggaactacgtggtccaccgtctcttacgcctccaccgaacggcccagtccgtccttccccgtggcctaccctccaccacgcaccg

SEQ ID NO: 140595 - DNA, 538 bp, Homo sapiens
  misc_feature: GYAE6OF02GBME5.46.67.G01.1.454.CMB.1.raw
  modified_base (333)..(333): a, c, t, g, unknown or other
  misc_feature (333)..(333): n is a, c, g, or t
  modified_base (536)..(536): a, c, t, g, unknown or other
  misc_feature (536)..(536): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaagggctggaatacattggaagtgtctctcatagtggaggttcctattacagtccgtctctcaagagtcgagtcaccatatctctggacacgtccagcaatcagttttcccngaagatgagttctgtgaccgccgctgacacgggcgtttattactgtgcgagagacggctattatgtatttttggagttggttatttcgactaccctagatcgacggggctcgacccgtggggccagggaatactggtcaccgtctccttagcctccaccgaagggcccagtccgtccttccccgtggccaccctcctccacgncc

SEQ ID NO: 140596 - DNA, 512 bp, Homo sapiens
  misc_feature: GYAE6OF02F70BE.46.67.G01.1.454.CMB.1.raw
  modified_base (487)..(487): a, c, t, g, unknown or other
  misc_feature (487)..(487): n is a, c, g, or t
tcagactagcagtacacgaccggtgctcgatttagagtatacataattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagtattttgactaacttattacttgtcaactagaattacaattgttttcggacctaagggacacgactacaaattaaacgaactgtagctagcaacatctntcttcatcttcccgcctatctgtac

SEQ ID NO: 140597 - DNA, 547 bp, Homo sapiens
  misc_feature: GYAE6OF02I2V2W.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgagttcagtggcagtgatcgtgggacagatttcactctcaccatcagtaatctgcaacgtgaagtattttagctaactttattactgtacaacagtaaatttacaattgttttacggacctaaagggtacctaacgtaacttaactaaattaaacgaactagtacgtactagaccaacctattactgtcctttactacttccttaccccgctacttctagtaaccg

SEQ ID NO: 140598 - DNA, 524 bp, Homo sapiens
  misc_feature: GYAE6OF02IXUBZ.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacacctattaatggtatcaacatagaccagggacggcccctaagctcctaatctatgctgcatccagtttgcaaagtgggtcccatcgaggttcagtggcagtggatcgtgggacagatttcactctcaccatcagtatctgacaacgtgaagtatttgactaacttattactgtacaacagtaattacaattgtttacggaccgaagggtacaacgaactaactaaattaaacgaactgtagactgacacctattctacgttcttcacttccgttcccgcctactctgtaac

SEQ ID NO: 140599 - DNA, 582 bp, Homo sapiens
  misc_feature: GYAE6OF02GMG3F.46.67.G01.1.454.CMB.1.raw
  modified_base (333)..(333): a, c, t, g, unknown or other
  misc_feature (333)..(333): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaagggctggaatacattggaagtgtctctcatagtggaggttcctattacagtccgtctctcaagagtcgagtcaccatatctctggacacgtccagcaatcagttttcccngaagatgagttctgtgaccgccgctgacacgggcgtttattactgtgcgagagacggctattatgtattttggagttggttatttcgactaccctagacgtcgacggggctccggaccccgtggggcccagggaactacgtggtccaccgtctccttagcccttccgaccgaacgggccccaagttcccggttaccctttcccccgtcgggccctaccccgttcccgtacccgtaacggacgtaccccg

SEQ ID NO: 140600 - DNA, 520 bp, Homo sapiens
  misc_feature: GYAE6OF02IQ8EI.46.67.G01.1.454.CMB.1.raw
  modified_base (516)..(516): a, c, t, g, unknown or other
  misc_feature (516)..(516): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgcccctaagctcctaatctatgctgcatccagtttgcaaagtgggtcccatcgaggttcagtgcagtggatctgggacagtatttcactctcacatcagtatctgcaacgtgaagtatttgactaacgttattactagtacaacagtaattactaatgtttcggacgtaacggactaacgactaactaaactaaacgaactgtaggactagactaccatctgtcttactacttccttcccaccattcntaac

SEQ ID NO: 140601 - DNA, 525 bp, Homo sapiens
  misc_feature: GYAE6OF02HZG59.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccaggacggcccctaagctctaatctatgctgcatccagtttgcaaagtgggtccatcgagttcagtgcagtgatctgggacagattcactctcaccatcagtaatctagacaacgtagaagtattttagactaacttattactagtacaaactagtaaattacaagttgtttaccggacctaagggacaacgaactaactaaattaaacgaactagtgactgacaactatctgttcttacacttccttcccgcctatctagtaac

SEQ ID NO: 140602 - DNA, 500 bp, Homo sapiens
  misc_feature: GYAE6OF02GJR94.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagattttgcaacttattactgtcaacagaattacaatgttttacgcaagggacacgactaacaaattaaacgaactgtgctgacacatctgtcttcatcttcccgccatctgtac

SEQ ID NO: 140603 - DNA, 549 bp, Homo sapiens
  misc_feature: GYAE6OF02JTZ1R.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaatggtatcaacatagaccagggacggcccctaagctcctaatctatgctgcatccagtttgacaaagtggggtcccatcgaggttcagtggcagtggatctgggacagattcactctcacatcagtaatctagcaacgtgaagtattttagactaacttatacttagtacaactagtaacttacaattacgtttacggacctaaacgggtacaacggtaactaacgtaaaattaaaccggtaactagtagactagtccaacgtattctagttccttatacttccttacccgtctacttctacgtaac

SEQ ID NO: 140604 - DNA, 522 bp, Homo sapiens
  misc_feature: GYAE6OF02IIWXN.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatgtatcaacatagaccaggacggcccctaagctcctaatctatgctgcatccagtttgcaaagtgggtcccatcgaggttcagtggcagtgatctgggacagatttcactctcaccatcagtaatctgcaacgtgaagtattttgctaaacgttattaactgtacaacagtaattacaattgttttacggacctaagggactacgaactaacaaattaaacgaacgtagtagctagacaccgatctacgtcttcgacttcttcccgccactctgtaac

SEQ ID NO: 140605 - DNA, 510 bp, Homo sapiens
  misc_feature: GYAE6OF02HGP5O.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctcctaatctatgctgcatccagtttgcaaagtgggtcccatcgagttcagtggcagtggatctgggacagatttcactctcaccatcagtaatctgcaacgtgaagtattttgctaacttattactgtcaacagtaaattacaattgttttacggacctaaagggacaacgactaacaaattaaacgaactgtgactgcacatctagtcttcatcttcccgcattctgtaac

SEQ ID NO: 140606 - DNA, 603 bp, Homo sapiens
  misc_feature: GYAE6OF02GM9HQ.46.67.G01.1.454.CMB.1.raw
tcagactagcagtacacgaccggtgctcgatttagagtatacatatttggggttttgggggagtctcggtcaggacacgagcatggacagtgagggtccccgcgtccagctcctggggcctccgtgcctactctggctccgaggtgcccaggatcgtagacatcgagctagacccagtcctccactccctccctcgtctgcaaccgtggagacagtgacaccatccacttgccggcaaggtccggaacattgactaccttatttaacgttggtatcaacatacgaaccaagggaaccgaccccgtaagcctaccgtaactctatcgctgctactccagttacgacgaacgtcgggtaccagtcgaggttcaggtcgactaggtgatcgtagggactagtacttcgactctaccacctatacagtatcgagacaacgtagtaagtattttagacttaacttacttaacttcgtactaacgacgtaaattactaattcggtttacgacgtaagggactaacggactaagaacttaaagacgttagagtacgtagacctacgacttactctacgtactcgttccttcccgactactcctagtaccg

SEQ ID NO: 140607 - DNA, 550 bp, Homo sapiens
  misc_feature: GYAE6OF02IYP3F.46.67.G01.1.454.CMB.1.raw
  modified_base (340)..(340): a, c, t, g, unknown or other
  misc_feature (340)..(340): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtccaccatatctctggacacgtccagcaatcagttttccctgaagntgagttctggtcgaccgccgctgacacggggtcttttattactgtgcgagagacggctattatgtattttggagttggttatttcgactaccctagagtcgacggggtctcggaccctgggcaggatacgtggtcaccgtctccttagcctccaccgacggccctagtccggtcttccccgtcggtcctacccgtcctcccgacgcaccg

SEQ ID NO: 140608 - DNA, 551 bp, Homo sapiens
  misc_feature: GYAE6OF02I0HB0.46.67.G01.1.454.CMB.1.raw
  modified_base (336)..(336): a, c, t, g, unknown or other
  misc_feature (336)..(336): n is a, c, g, or t
  modified_base (510)..(510): a, c, t, g, unknown or other
  misc_feature (510)..(510): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgagggaaggggctgggaatacattggaagtgtctctcatagtggaggttcctattacagtccgtctctcaagagtcgagtcaccatatctctggacacgtccagcaatcagttttcccngaagatgagttctgtcgaccgcgctgacacgggtcgtttatactgtgcgagagacgctattatgtattttggagttgttatttcgactaccctagactcggacggggtctccggaccccgtggggaccgagggtaatacgtggtccaccgtctccttagcctccacgacggccncgtccggtccttccccgtcggccaccctcctccgagcgtcc

SEQ ID NO: 140609 - DNA, 514 bp, Homo sapiens
  misc_feature: GYAE6OF02IN1MD.46.67.G01.1.454.CMB.1.raw
  modified_base (255)..(255): a, c, t, g, unknown or other
  misc_feature (255)..(255): n is a, c, g, or t
  modified_base (495)..(495): a, c, t, g, unknown or other
  misc_feature (495)..(495): n is a, c, g, or t
  modified_base (511)..(511): a, c, t, g, unknown or other
  misc_feature (511)..(511): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaanatagaccagggacggcccctaagctcctaatctatgctgcatccagtttgcaaagtgggtcccatcgaggttcagtggcagtggatctgggacagatttcactctcaccatcagtaatctgacaacgtgaagtattttgactaacttattacttgtacaaacagaattaacaattgttttcggacctaaagggacacgaactaacaaattaaacgaactgtagctgacacatctgtcttnatcttcccgccatctntac

SEQ ID NO: 140610 - DNA, 507 bp, Homo sapiens
  misc_feature: GYAE6OF02GV9QR.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatctgggacagatttcactctcaccatcagtaatctgcaacgtgaagtattttgactaacttattacttgtcaacagaattacaattgtttcggactaagggacacgactaacaaattaaacgaactgtgctgcaccatctgtcttcactccttcccgctatctgtac

SEQ ID NO: 140611 - DNA, 530 bp, Homo sapiens
  misc_feature: GYAE6OF02FOIJZ.46.67.G01.1.454.CMB.1.raw
  modified_base (192)..(192): a, c, t, g, unknown or other
  misc_feature (192)..(192): n is a, c, g, or t
  modified_base (346)..(346): a, c, t, g, unknown or other
  misc_feature (346)..(346): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacacctatttaaatggtatcaacatagaccagggacggcccctaagctcctaatctatgctgcatccagtttgcaaagtgggtcccatcgagttcagtggcagtgatctgggacngattcactctcaccatcagtaatctgcaacgtgaagattttagactaacttattactgtacaacagaattacaattgtttacgacctaagggtacaacgaacttaacaaacttaaacgaactagtagtctagacgtaaccatcgttagtccttacacttccttacccgacctacttcctgtaac

SEQ ID NO: 140612 - DNA, 544 bp, Homo sapiens
  misc_feature: GYAE6OF02GJHBR.46.67.G01.1.454.CMB.1.raw
  modified_base (211)..(211): a, c, t, g, unknown or other
  misc_feature (211)..(211): n is a, c, g, or t
  modified_base (325)..(325): a, c, t, g, unknown or other
  misc_feature (325)..(325): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctcatcagtagtgtttctctggggctgggtccgcagcctcccgagggaagggctggaatacattggaagtgtctctcatagtggaggttcctattacagtccgtctctcaagngtcgagtcaccatatctctggacacgtccagcaatctagttttccctgaacgatgtagtttctgtcgaccgccgctgacgacgggtcgtttatacttgttgcgagagacggctattatgtattttggtagttggttatttcgacacctagatcggcgggctccggacccgtgggaccgagggtatacgtcggtcctaccgtctccttacgccctacccg

SEQ ID NO: 140613 - DNA, 507 bp, Homo sapiens
  misc_feature: GYAE6OF02HLTWL.46.67.G01.1.454.CMB.1.raw
  modified_base (504)..(504): a, c, t, g, unknown or other
  misc_feature (504)..(504): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagtattttgctaacttattactgttacaacagtaattacaattgtttacggctaaggacacgactaacaaattaaacgaactgtaggctgcacatctagtcttcatcttcccgccatctntac

SEQ ID NO: 140614 - DNA, 543 bp, Homo sapiens
  misc_feature: GYAE6OF02ICYSB.46.67.G01.1.454.CMB.1.raw
  modified_base (236)..(236): a, c, t, g, unknown or other
  misc_feature (236)..(236): n is a, c, g, or t
  modified_base (250)..(250): a, c, t, g, unknown or other
  misc_feature (250)..(250): n is a, c, g, or t
  modified_base (375)..(375): a, c, t, g, unknown or other
  misc_feature (375)..(375): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgnggggctgggtccgnagctcccgagggaaggggctggaatacattggaagtgtctctcatagtggagttcctattacagtccgtctctcaagagtcgagtcaccatatctctggacacgtccagcaatctagttttcccngaagatgagttctgtcgaccgccgctgacgacgggtctttatactgtgcgtagagacgtctattagtgtatttttaggagttggtttatttcgaactacctagagtcgacggggtctcggcccgtgggccaggtatacgtgtccaccgttctccgttacgcctacccg

SEQ ID NO: 140615 - DNA, 547 bp, Homo sapiens
  misc_feature: GYAE6OF02GG9A5.46.67.G01.1.454.CMB.1.raw
  modified_base (372)..(372): a, c, t, g, unknown or other
  misc_feature (372)..(372): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccgcagctcccagggaaggggctggaatacattggaagtgtctctcatagtggaggttcctattacagtccgtctctcaagagtcgagtcaccatatctctggacacgtccagcaatcagttttcccngaagatgagttctgtgaccgccgctgacacgggtcgtttattactgtgcgagagacggctattatgtatttttggagttggtttatttcgactaccctagatcggacgggggtctccggaccccgtggggccgagggtaactacgtcggtcaccgttctccgttacgcctacccg

SEQ ID NO: 140616 - DNA, 506 bp, Homo sapiens
  misc_feature: GYAE6OF02H49QG.46.67.G01.1.454.CMB.1.raw
  modified_base (412)..(412): a, c, t, g, unknown or other
  misc_feature (412)..(412): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccaggacggcccctaagctcctaatctatgctgcatccagtttgcaaagtggggtcccatcgagttcagtggcagtggatctgggacagatttcactctcacatcagtatctgcaacgtgaagtattttgactaactttattactgtacaanagtaaattacaattgtttcgacctaagggacacgtactaacaaattaaacgaactgtagctagacacatctgtctcatcctcccgcatctgtac

SEQ ID NO: 140617 - DNA, 543 bp, Homo sapiens
  misc_feature: GYAE6OF02GD5GF.46.67.G01.1.454.CMB.1.raw
  modified_base (334)..(334): a, c, t, g, unknown or other
  misc_feature (334)..(334): n is a, c, g, or t
  modified_base (522)..(522): a, c, t, g, unknown or other
  misc_feature (522)..(522): n is a, c, g, or t
  modified_base (538)..(538): a, c, t, g, unknown or other
  misc_feature (538)..(538): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttcccngaagatgagttctgtgaccgccgctgacacgggtcgttttattactgtgcgagagacggctattatgtatttttggagttggttatttcgactaccctagatcggacggggctccggacccgtggggccagggaactcgtggtcaccgtctcctagcctcaccgacggcccagtccgtccttccccgngccaccctcctccagngcccg

SEQ ID NO: 140618 - DNA, 591 bp, Homo sapiens
  misc_feature: GYAE6OF02JLWVU.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtggaggccttcggagaccctcgtccctcacctgcgctgtctctggtgcctccatcagtagtggtttcttcgtgggcgtgggtccggcgagcctccgagggaggggcgtaggaatactagttaggagtgtctctcagtagtgtacgtacttacttaacgtacgtaccgtccgtctactaacgtaacgtacgtacgtacgtaccactatactcgtacgtacgacgtacgtacgactactacttacgttaccgtttacgtaagtaagtagtagtacgttcgtacgtaccgaccgaccgtacgtacgtacggtacggttacgttacgttacgtgtacgagagacgtacgtactattagttagtttagttaggttaggttagttacgtaccgtaccgtaaccgtacgtacggtaccggtaccggtaccgtacccggtaccggtaccggtacggtacggtacgtacgtacg

SEQ ID NO: 140619 - DNA, 523 bp, Homo sapiens
  misc_feature: GYAE6OF02IC0I6.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaatggtatcaacatagaccaggacgcccctaagctcctaatctatgctgcatccagtttgcaaagtggggtcccatcgaggttcagtggcagtggatcgtgggacagatttcactctcaccatcagtaatctgcaacgtgaagtattttgactaactttattaactgttacaacagtaattacaattgttttacggactaaggacacgactaacaaattaaacgaactagtgctagacaactatctgttccttctacttccttcccgcctacttcctgtaac

SEQ ID NO: 140620 - DNA, 504 bp, Homo sapiens
  misc_feature: GYAE6OF02FNM2F.46.67.G01.1.454.CMB.1.raw
  modified_base (484)..(484): a, c, t, g, unknown or other
  misc_feature (484)..(484): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctcctaatctatgctgcatccagtttgcaaagtgggtcccatcgaggttcagtgcagtggatctgggacagattcactctcaccatcagtaatctgcaacgtgaagattttgactaacttattacttgtcaacagaattacaattgtttcgactaagggacacgaactacaaattaaacgaactagtagctgcaaccatctgtcttnactccttccgccatctgtac

SEQ ID NO: 140621 - DNA, 522 bp, Homo sapiens
  misc_feature: GYAE6OF02IVG52.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctcctaatctatgctgcatccagtttgcaaagtggggtcccatcgaggttcagtggcagtgatctgggacagatttcactctcaccatcagtaatctgacaacgtgaagtattttcgactaactttattactgtactaacagtaattacaattggtttacgcctaagggacacgtactaactaaattaaacgaatgtagtctagacactatctagtcttacgacttccttcccgctatcctgtac

SEQ ID NO: 140622 - DNA, 558 bp, Homo sapiens
  misc_feature: GYAE6OF02GL4E1.46.67.G01.1.454.CMB.1.raw
  modified_base (438)..(438): a, c, t, g, unknown or other
  misc_feature (438)..(438): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatctagttttcccagaagatgagttctgtgaccgccgctggacgacgggtcttttattactgtgcgagagacggcttattagtgttagttttggagttgttatttcgactacctagntcggcgggctccgacccgtgggccgagggactacgtgtcaccgtctccgttacgcctaccaccgaacggcctacgtccgttcccttccccgcggcccacccttcccaccacgcgtacccg

SEQ ID NO: 140623 - DNA, 575 bp, Homo sapiens
  misc_feature: GYAE6OF02F5O9X.46.67.G01.1.454.CMB.1.raw
  modified_base (288)..(288): a, c, t, g, unknown or other
  misc_feature (288)..(288): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaagggctggaatacattgggaagtgtctctcatagtggaggttcctattacagtccgtctctcaagngtcgagtcaccatatctctggacacgtccagcaatcttagttttccctgaagatgagttctgtcgaccgccgctcgacacgggtcgtttactactgtgcgagagacgctattatgtattttggagttggttatttcgactaccttagacgtcggacggggtctcgacccgtaggggccgaagggactacgtggtccaccgttcgtccttacgccctccgaaccgaacgggccacgtcccggttcccttccccgtcgtccctaccctccctacccgacgacgtacccg

SEQ ID NO: 140624 - DNA, 518 bp, Homo sapiens
  misc_feature: GYAE6OF02HV87T.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattgtatcaacatagaccagggacggcccctaagctcctaatctatgctgcatccagtttgcaaagtgggccccatcgaggttcagtggcagtggatctgggacagatttcactctcaccatcagtaatctgcaacgtgaagtattttgactaacttattactgtacaactagtaattactaattgtttacggaccaagggacacgactaactaaattaaacgaactgtgactgacaccattctgttcttcactccttcccgcctacttctgtac

SEQ ID NO: 140625 - DNA, 540 bp, Homo sapiens
  misc_feature: GYAE6OF02FGI5F.46.67.G01.1.454.CMB.1.raw
  modified_base (334)..(334): a, c, t, g, unknown or other
  misc_feature (334)..(334): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttcccngaagatgagttctgtgaccgcgctgacacgggtctttattactgtgcgagagacggctatttatgtatttttggagttggttatttcgacaccctagatcgacggggctcgaccctgggccagggaatacgtggtcaccgtctccttagcctccaccgaacgggcccagtccggtccttcccccgtggccaccctcctccagcgcc

SEQ ID NO: 140626 - DNA, 513 bp, Homo sapiens
  misc_feature: GYAE6OF02HPY49.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgcccctaagctcctaatctatgctgcatccagtttgcaaagtgggtccatcgaggttcagtggcagtggatcgtgggacagatttcactctcacatcagtatctgacaacgtgaagtatttgactaattattactgtacaatagtaatacaattgtttacgaccgaagggacaacgactaacaaattaaacgaactgtacgctacgcaacatctgtacttcacttcctcccgactactctagtac

SEQ ID NO: 140627 - DNA, 513 bp, Homo sapiens
  misc_feature: GYAE6OF02I68GJ.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctcctaatctatgctgcatccagtttgcaaagtgggtcccattgaggttcagtggcagtggatctgggacagatttcactctcaccatcagtaatctgcaacgtgaagattttgctaacttattacttgtacaacagaattacaattgttttacggacctaagggacacgtactaacaaattaaacgaactgtagctgacaccatctgtcttgacttcttcccgctactctgtaac

SEQ ID NO: 140628 - DNA, 544 bp, Homo sapiens
  misc_feature: GYAE6OF02FMFDL.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttcccctgaagatgagttctgtgaccgccgctgacacgggcgtttattactgtgcgagagacggctattatgatttttggagttggttatttcgacaccctagatcgacgggggctcgacccctggggccagggaatacgtggtcaccgtctccttagcctccaccaacggcccatccggtccttcccctcggccacccctcctcccacgagaccc

SEQ ID NO: 140629 - DNA, 506 bp, Homo sapiens
  misc_feature: GYAE6OF02G06X9.46.67.G01.1.454.CMB.1.raw
  modified_base (496)..(496): a, c, t, g, unknown or other
  misc_feature (496)..(496): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagtattttgctaacttattactgtacaacagaattacaattgttttacgaccaagggacacgactaacaaattaaacgaactgtagctgcacatctgtcttcattctcccnctatctgtac

SEQ ID NO: 140630 - DNA, 614 bp, Homo sapiens
  misc_feature: GYAE6OF02HUUOY.46.67.G01.1.454.CMB.1.raw
  modified_base (207)..(207): a, c, t, g, unknown or other
  misc_feature (207)..(207): n is a, c, g, or t
  modified_base (566)..(566): a, c, t, g, unknown or other
  misc_feature (566)..(566): n is a, c, g, or t
tcagactagcagtacacgaccggtgctcgatttagagtatacatattggggtttggggagtctccggtcaggacacagaatggacagtgagggtccccgcgtccagctcctggggcctccgtgcctactctggctccgaggtgcccaggatcgtagacatcgagcctgacccagtcctccatccctccctgtctgcaaccgtggganacgagtgtacaccgattccacttgcccgggtcaacggtccggaaactacttaggacctaccgtattttaaacgttgggtaacttcgaaaccatacgaaccagggaacggacccctaaggcctaccctaagtcctaatgactgactaatcctagttttcacgaaagtcggggtcccatcgagttacagtggcagtgatcgtgggacagtattcgactctcacatacagtaatctcgtacaacgtgaacgtatttcgactaactttagtactgttactaacagtaaattacaattcgtttacgacctaagggaccacgtactaactaaagttaaccgaatagtacgactacggactaccgnttcgtagtaccttacattcccttaccgaccttatacccttgacttacg

SEQ ID NO: 140631 - DNA, 534 bp, Homo sapiens
  misc_feature: GYAE6OF02JC2K4.46.67.G01.1.454.CMB.1.raw
  modified_base (249)..(249): a, c, t, g, unknown or other
  misc_feature (249)..(249): n is a, c, g, or t
  modified_base (373)..(373): a, c, t, g, unknown or other
  misc_feature (373)..(373): n is a, c, g, or t
  modified_base (378)..(378): a, c, t, g, unknown or other
  misc_feature (378)..(378): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccggnagctcccagggaagggctggaatacattggaagtgtctctcatagtggaggttcctattacagtccgtctctcaagagtcgagtcaccatatctctggacacgtccagcaatctagttttcccngaagntgagttctgtcgaccgccgctgacacgggtctttatactgttgcgagagacggtctattatgtattttggagttggttatttcgactacctagatcggacgggctccgcccgtgggccgtaggactacgtggtcaccgtctcgttacgcctacccg

SEQ ID NO: 140632 - DNA, 501 bp, Homo sapiens
  misc_feature: GYAE6OF02HNKJR.46.67.G01.1.454.CMB.1.raw
  modified_base (491)..(491): a, c, t, g, unknown or other
  misc_feature (491)..(491): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgcccctaagctcctaatctatgctgcatccagtttgcaaagtgggtcccatcgaggttcagtgcagtgatctgggacagattcactctcaccatcagtaatctgcaacgtgaagtatttgctaacttattactgtacaacagaattacaattgtttcggacaaggacacgactaacaaattaaacgaactgtagctgacaacatctgtcttcactccttcccnctatctgtac

SEQ ID NO: 140633 - DNA, 547 bp, Homo sapiens
  misc_feature: GYAE6OF02I2F8U.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaagggctggaatacattggaagtgtctctcatagtggaggttcctattacagtccgtctctcaagagtcgagtcaccatatctctggacacgtccagcaatcagttttccctgaagatgagttctgtgaccgcgctgacacgggtctttattactgtgcgagagacggctattatgtattttggagttggttatttcgactacctagatcgacggggctcgacccgtgggccagggatacgtggtcaccgtctccgttacgcctccaccgaacgggcccagtccggtccttcccccgtggccctaccctccctaccacgctacccg

SEQ ID NO: 140634 - DNA, 674 bp, Homo sapiens
  misc_feature: GYAE6OF02HZWGD.46.67.G01.1.454.CMB.1.raw
  modified_base (291)..(291): a, c, t, g, unknown or other
  misc_feature (291)..(291): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgagggaagggctggaatacagttggaagtgtctctcatagtggtaggttcctattacagtccgtctctcaagngtcgagtcaccatatctctgacacgtcagcaatctacgttttccctgaaagtatgtagttctggtcgacccgccgtctacgaccgtacgggtcgttttaattacgtgtcgacgaggaggacggtacttattagttagttagttttaggttaggttaggtttagtttacgttaccgtacccttacgtacgtacggtacgggtccgtccgtacccgtacgggaccgaggtaacccccccccccccccccgtagtcgtccgtaccgtccgttaccgttaccgtcccgtacccgtaccgaaccggacccgtaccgtcccggttaccccgttcccccgttcccggtacccgtaccccgttaccccgtacccgtaccgtaccgtacccg

SEQ ID NO: 140635 - DNA, 515 bp, Homo sapiens
  misc_feature: GYAE6OF02F4FY3.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatctgggacagatttcactctcaccatcagtaatctgcaacgtgaagtattttgctaacttattactgtcaacagaattactaatgttttcggacctaagggacacgactaactaaattaaacgaactagtagctagacgaccatctagtcttcactcttcccgctacttctgtac

SEQ ID NO: 140636 - DNA, 610 bp, Homo sapiens
  misc_feature: GYAE6OF02ISG84.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctcctaatctatgctgcatccagtttgacaagtcggggtcccatcgaggttcagtggcagtggatcgtagggacagtatttcactctcaccatacagtaatctagacaaacgtgtaaagttatttagactaaacgtttattactagtactaaacgtaagtaaatttaacgaatttcggtttaccggaccgaaggggtaaccaacggtaacttaaaccgtaaaacgtttaaacgaaacgttggtacggtaccttaggacctaacccgtaattaccttacgttcctttactaaccgtttcccgtttaccccgaccctactttaccgtgttaaccg

SEQ ID NO: 140637 - DNA, 513 bp, Homo sapiens
  misc_feature: GYAE6OF02JTTU5.46.67.G01.1.454.CMB.1.raw
  modified_base (217)..(217): a, c, t, g, unknown or other
  misc_feature (217)..(217): n is a, c, g, or t
  modified_base (228)..(228): a, c, t, g, unknown or other
  misc_feature (228)..(228): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacnttgacacctattaaatgtatcaacatagaccagggacgcccctaagctcctaatctatgctgcatccagtttgcaaagtcgggtcccagtcgaggttcagtggcagtgatcgtgggacagtattcactctacaccatcagcacgcctagacgcctagaagtatttgctagtttacttactgtcagcagcgtagctaactcgcctctctaccgttcgcccgtggaacctaagtcgatacgtcgaaacgtacgtggtacgtacgtcgacacctattctcgtcttacg

SEQ ID NO: 140638 - DNA, 554 bp, Homo sapiens
  misc_feature: GYAE6OF02GR633.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttcccctgaagatgagttctgtgaccgcgctgacgacgggcgttttatactgtgcgagagacggctattatgtattttggagttggttatttcgactaccctagatcgacggggctcgacccgtcggggccagggaatacgtggtctaccgtctccttacgcctccaccgaacgggcccagtccggtccttccccgtcggccctacccctcctccacgcgtacccg

SEQ ID NO: 140639 - DNA, 505 bp, Homo sapiens
  misc_feature: GYAE6OF02GYAUG.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagtattttgctaacttattactgtcaacagaattacaattgtttacggcaagggacacgactaacaaattaaacgaactgtgctgcacatctgttcttcattcttcccgctactctgtac

SEQ ID NO: 140640 - DNA, 538 bp, Homo sapiens
  misc_feature: GYAE6OF02FIPDT.46.67.G01.1.454.CMB.1.raw
  modified_base (375)..(375): a, c, t, g, unknown or other
  misc_feature (375)..(375): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagtttttcccngaagatgagttctgtgaccgccgctgacacgggcgtttatactgtgcgagagacggctattatgtatttttggagttggttatttcgactaccctagatcgacggggtctcggacccctggggcccagggatacgtggtccaccgtctccttagccctacccg

SEQ ID NO: 140641 - DNA, 529 bp, Homo sapiens
  misc_feature: GYAE6OF02G3DI0.46.67.G01.1.454.CMB.1.raw
  modified_base (516)..(516): a, c, t, g, unknown or other
  misc_feature (516)..(516): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgcccctaagctcctaatctatgctgcatccagtttgcaaagtgggtcccatcgaggttcagtggcagtggatcgtgggacagtatttcactctcaccatctagtaatctgacaacgtagtaagtattttagactaacttattacttgtacaacataattacaattgtttacggacctaagggacacgtaactaactaaattaaacgaatgtagactgacaactatctgtcttactacttccgttaccncctatcctagtac

SEQ ID NO: 140642 - DNA, 541 bp, Homo sapiens
  misc_feature: GYAE6OF02FYHVR.46.67.G01.1.454.CMB.1.raw
  modified_base (376)..(376): a, c, t, g, unknown or other
  misc_feature (376)..(376): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctacaagagtcgagtcaccatatctctggacacgtccagcaatctagttttcccngaagtatgagttctgtgaccgccgctgacacgggtcgtttattactgtgcgagagacggcttattatgtatttttggagttggttatttcgactacctagatcgacggggctcgaccccgtggggccagggaactacgtggtcaccgtctccttacgcctacccg

SEQ ID NO: 140643 - DNA, 570 bp, Homo sapiens
  misc_feature: GYAE6OF02FJXHF.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccaggggaaggggctggaatacattggaagtgtctctcatagtggaggttcctattacagtccgtctctcaagagtcgagtcaccatatctctggacacgtccagcaatctagttttccctgaagatgagttctgtgaccgccgctgacgacgggtcttttattactgtgcgagagacgggtctagttatgtagttttggagttggttatttcgactaccctagacgtcggacggggctcgacccgtggggccgagggatacgtggtcaccgtctccttacgcctccaccgaacgggcccacgtccggtcccttcccccgtcggtcccaccccttccctacccgacgacgtaccc

SEQ ID NO: 140644 - DNA, 519 bp, Homo sapiens
  misc_feature: GYAE6OF02GZYEZ.46.67.G01.1.454.CMB.1.raw
  modified_base (506)..(506): a, c, t, g, unknown or other
  misc_feature (506)..(506): n is a, c, g, or t
  modified_base (512)..(512): a, c, t, g, unknown or other
  misc_feature (512)..(512): n is a, c, g, or t
  modified_base (517)..(517): a, c, t, g, unknown or other
  misc_feature (517)..(517): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttcccctgaagatgagttctgtgaccgcgctgacacgggcgtttatactgtgcgagagacggctattatgatttttggagttgttatttcgactaccctagatcgacggggctcgacccgtgggccagggatactgtcacgtctctagcctcacaggcccatcgtcttcccctcggcncctccnccagncc

SEQ ID NO: 140645 - DNA, 655 bp, Homo sapiens
  misc_feature: GYAE6OF02JF080.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtggagacagtgtcaccatcacttgccgggcaagtcggaacattgacacctatttaaattggtactcaacatagaccgagggaccgaccctaagctactaatctatgactgactactcctagtttcgactaaaggtcggggtacccagtcggtacggttacaggtggctaggtggatcgtaggacagtattcactctacacctatacgtaagtaactcgtacgactaacggtagaaagttattttagactaacttttaacttaacttacgtacctaaacgtaacgtaaacttaactaaagtttacggttttaccggaaccggtaaagggtaacctaaccgtaaccttaaaacttaaaacttaaaaccgtaacgttaggttacggtacttacggaacctaacctaattaccgttacgttaccttaccgttaacttcccgttaccccgaccttaacgttccgttaggttaacc

SEQ ID NO: 140646 - DNA, 553 bp, Homo sapiens
  misc_feature: GYAE6OF02I255K.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaggggctggaatacattggaagtgtctctcatagtggaggttcctattacagtccgtctctcaagagtcgagtcaccatatctctggacacgtccagcaatcagttttccctgaagatgagttctgtgaccgccgctgacacgggctttattactgtgcgagagacggctattatgtattttggagttggttatttcgactacttagatcgacggggctcgaccccgtggggccagggtaactacgtggtcaccgtctccttagcctccaccgaacgggcccagtccgtccttcccccgtcggccctaccccgtcctcccgacgacgtcccg

SEQ ID NO: 140647 - DNA, 500 bp, Homo sapiens
  misc_feature: GYAE6OF02FQA6P.46.67.G01.1.454.CMB.1.raw
  modified_base (476)..(476): a, c, t, g, unknown or other
  misc_feature (476)..(476): n is a, c, g, or t
  modified_base (482)..(482): a, c, t, g, unknown or other
  misc_feature (482)..(482): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtccatcgaggttcagtgcagtggatctggacagatttcactctcaccatcagtaatctgcaacgtgaagattttgctaacttattacttgtcaacagtaattactaattgttttacggccaagggacacgactaacaaataaacgaatgtgctgcacatctntcttcnctcttcccgcatctgtac

SEQ ID NO: 140648 - DNA, 546 bp, Homo sapiens
  misc_feature: GYAE6OF02IKEH2.46.67.G01.1.454.CMB.1.raw
  modified_base (192)..(192): a, c, t, g, unknown or other
  misc_feature (192)..(192): n is a, c, g, or t
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggnaagtcggaacattgacacctatttaaatggtatcaacatagaccagggacggcccctaagctctaatctatgctgcatccagtttgcaaagtgggtcccatcgaggtcagtggcagtgatcgtggacagatttcactctcacatcagtaatctgacaacgtagaagtatttgactaaacttattacttagtacaaactaagtaaacttaacaatttgttttcggaccgtaaagggacaacgtaactaactaaaattaaaccgaaacttgtacgactagactaacctattctcgttcttactacgtcctttcccgacctactctagtaac

SEQ ID NO: 140649 - DNA, 502 bp, Homo sapiens
  misc_feature: GYAE6OF02GJM6J.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagattttgcaacttattactgtcaacagaattacaatgttttcggccaagggacacgactaacaaattaaacgaactgtggctgcaccatctgtcttcatcttcccgccatctgtac

SEQ ID NO: 140650 - DNA, 562 bp, Homo sapiens
  misc_feature: GYAE6OF02J0686.46.67.G01.1.454.CMB.1.raw
  modified_base (332)..(332): a, c, t, g, unknown or other
  misc_feature (332)..(332): n is a, c, g, or t
  modified_base (337)..(337): a, c, t, g, unknown or other
  misc_feature (337)..(337): n is a, c, g, or t
  modified_base (491)..(491): a, c, t, g, unknown or other
  misc_feature (491)..(491): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctccgagggagggctggaatacattggaagtgtctctcatagtggaggttcctattacagtccgtctctcaagagtcgagtcaccatatctctggacacgtccagcaatcagttttcccngaagntgagttctgtgacccgccgctgacgaccgggtcgttttattactgtcgcgtagacgacggcttagttatgttagttttggagttggttattcgactacctagatcggacgggtcgtcgcccgtgggccagggatacgtgtcaccgtctccgtcncctcgaccgaacggtcccacgtccgtacccgttccccgtcggccctacccgtccctaccgacgacgtcccg

SEQ ID NO: 140651 - DNA, 557 bp, Homo sapiens
  misc_feature: GYAE6OF02JA6G4.46.67.G01.1.454.CMB.1.raw
  modified_base (335)..(335): a, c, t, g, unknown or other
  misc_feature (335)..(335): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatctagttttcccngaagatgagttctgtcgaccgcgctgacgacgggtcttttatactgtgcgagagacggctattatgtattttggagttggttatttcgactaccctagtactcggacggggctccgacccgtggggccgagggaatacgtggtcaccgtctcctagccctccgaccgtaacggcccagtccggtccttccccgtcggccctaccctcctccaagcgtacccg

SEQ ID NO: 140652 - DNA, 591 bp, Homo sapiens
  misc_feature: GYAE6OF02IRKR0.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtattcaacatagaccagggacggcccctaagctcctaatctatgctgcatccagtttgcaaagtgggtcccatcgagttcagtggcagtggatcgtgggacagtatttcactctcaccatcagtaatctagcaacgtgtaagtagttttgactaacttattactcgttacaaactaagtaattaactaattgtttttaccggaccgtaaagggtaactaaccggtaacttaaacctaaaattaaaaccgtaaactaggtacggtacttagacccgtaacctaacttcgttacgttacctttacgacttaccgttcccccgtacctaacgttcccttagtaacc

SEQ ID NO: 140653 - DNA, 621 bp, Homo sapiens
  misc_feature: GYAE6OF02F4D9G.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgacaaaggtcgggtcccatcgaggttcagtggcagtggatcgtgggacagtattcactctcacctatcagtaatctgacaacgtgaagtatttagactaacttattactgtactaactaagtaacttaactaagttacggttttaccggaccgtaaacggggtaacctaaccggtaaccttaaacgtaaaaacgtttaaaaccggtaaacgttacggttacggtaccttacggtacctaacccgtaacttaccgttacgtttacctttaccgtaactttccccgtttaccccgaccctacttaccgtacgttaaccg

SEQ ID NO: 140654 - DNA, 524 bp, Homo sapiens
  misc_feature: GYAE6OF02I4K5C.46.67.G01.1.454.CMB.1.raw
  modified_base (504)..(504): a, c, t, g, unknown or other
  misc_feature (504)..(504): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagattttgctaacttatttaactgtacaactagtaaatttaccaaattgttttacggacctaaagggacaacgactaactaaaattaaacgaaactgtagactgacaccatctgtcttnatcttcccgactatctgtac

SEQ ID NO: 140655 - DNA, 539 bp, Homo sapiens
  misc_feature: GYAE6OF02GGRMT.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatctgggacagattcactctcaccatcagtaatctgcaacgtgaagtattttgactaacttattactgtactaacaagtaattactaattcgttttcggacctaagggtacaacgacttaacaaattaaaacgaacttagtagctagactaaccattctagtccttactacgttccttcccgacctacttcctagtaac

SEQ ID NO: 140656 - DNA, 512 bp, Homo sapiens
  misc_feature: GYAE6OF02IC2YF.46.67.G01.1.454.CMB.1.raw
  modified_base (218)..(218): a, c, t, g, unknown or other
  misc_feature (218)..(218): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttgccgggnaagtcgaacattgacactatttaaatggtatcaacatagaccagggacggccactaagctcctaatctatgctgcatccagtttgcaaagtggggtccatcgaggttcagtggcagtggatctgggacagatttcactctcaccatcagtatctgcaacgtgtaagatttgctaactttattacttgtcaactagtaattacaattgtttacggcaagggacacgtaactaactaaattaaacgaactgtaggctgctaccatcctagtcttcactccttacccgctatctacg

SEQ ID NO: 140657 - DNA, 513 bp, Homo sapiens
  misc_feature: GYAE6OF02HGYG1.46.67.G01.1.454.CMB.1.raw
  modified_base (509)..(509): a, c, t, g, unknown or other
  misc_feature (509)..(509): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccaatcgaggttcagtggcagtggatctgggacagatttcactctcaccatcagtaatctgcaacgtgaagtattttgctaacttattacttgtcaaactagaattacaatgttttacgccaagggacacgactacaaattaaacgaactgtagctgacaccatctagtcttacacttcttcccgctatctntaac

SEQ ID NO: 140658 - DNA, 502 bp, Homo sapiens
  misc_feature: GYAE6OF02FPG4V.46.67.G01.1.454.CMB.1.raw
  modified_base (499)..(499): a, c, t, g, unknown or other
  misc_feature (499)..(499): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtgatctgggacagatttcactctcaccatcagtaatctgcaacgtgaagtattttgctaacttattactgtcaacagaattacaattgttttacgcaagggacacgactaacaaattaaacgaatgtagctgcacatctgtcttcatcttcccgctactctntac

SEQ ID NO: 140659 - DNA, 515 bp, Homo sapiens
  misc_feature: GYAE6OF02JE1SL.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatcgtgggacagatttcactctcaccatcagtaatctgcaacgtgaagtattttgactaacttattactgtacaacagaattacaattgtttcggaccaaggaccacgtactaacaaattaaacgaactgtagtctacgcacctatctgtcttcacttctcccgctactctgtac

SEQ ID NO: 140660 - DNA, 567 bp, Homo sapiens
  misc_feature: GYAE6OF02JNXR3.46.67.G01.1.454.CMB.1.raw
tcagactagcagtacacgaccggtgctcgatttagagtatacatattgggtttgggctgatcaggactcctcagttcaccttctcacaatgaggctccctgctcagctcctggggctgctaatgctctgggtccgaggtgccagatgtgacatcgagctgacccagtctccatcctccctgtctgcaacgtggagacagtgtcaccatcacttggccgggacaagtcggaacattgacacctatttaaattggtatcaacatagaccagggacggccctaagctacctaatctatgctgcatcctagtttgctaaaggtcggggtaccagtcggaggttcagtggcgagtggagtctgggaacagtattcactctcaccatacagttaactctgacaacgtagtaagtatttgactaattacttacttagtacaactaagtaacttaactaagttcgtttacggaccgtaagggtaacctaacgaactaacgtaaaacgttaacgtaacgttaggtaggtactagacctacctattcgttacgtccttacacttaccttcccgtacc

SEQ ID NO: 140661 - DNA, 541 bp, Homo sapiens
  misc_feature: GYAE6OF02IRH4J.46.67.G01.1.454.CMB.1.raw
  modified_base (330)..(330): a, c, t, g, unknown or other
  misc_feature (330)..(330): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccgcagctccagggagggctggaatacattggaagtgtctctcatagtggaggttcctattacagtccgtctctcaagagtcgagtcaccatatctctggacacgtccagcaatcagttttcccngaagatgagttctgtgaccgcgctgacacgggctttatactgtgcgagagacggctattatgtattttggagtggttatttcgactaccctagatcgacggggctcgacccgtgggccagggatacgtggtcaccgtctccttagcctccaccgaacgggcccagtccggtccttcccccgtggccctaccccgtcctccaacgacgcccg

SEQ ID NO: 140662 - DNA, 534 bp, Homo sapiens
  misc_feature: GYAE6OF02HBB0F.46.67.G01.1.454.CMB.1.raw
  modified_base (375)..(375): a, c, t, g, unknown or other
  misc_feature (375)..(375): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccggcagctcccgagggaaggggctgggaatacattggaagtgtctctcatagtggaggttcctattacagtccgtctctcaagagtcgagtcaccatatctctggacacgtccagcaatcagttttcccngaagatgagttctgtgaccgcgctgacacgggcgtttattactgtgcgagagacgctattatgtatttttggagttggttatttcgactacctagatcgacggggctacgacccgtgggccagggactacgtggtcaccgtctccgttacgcctacccg

SEQ ID NO: 140663 - DNA, 522 bp, Homo sapiens
  misc_feature: GYAE6OF02GN92R.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgagttcagtggcagtgatcgtgggacagatttcactctcaccatcagtatctgcaacgtgaagtattttgactaacttattacttagtcaacagaattacaattgttttacgacctaagggacaacgtaactaacaaattaaaccgaactagtggtctgctaaccatctgttcttcacttccttcccgtccattctgtac

SEQ ID NO: 140664 - DNA, 584 bp, Homo sapiens
  misc_feature: GYAE6OF02JKOTJ.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacacctatttaaatgtatcaacatagacaggacggcccctaagctacctaatctatgctgcatccagtttgacaaagtcggggtcccagtcgaggttcagtggcagtggatcgtagggacaggtatttcgactctcacatcagtaatctgactaacgtgaatattttgactaaacgtttattactagtacaaactagtaaactttacaaatttcggttttacggaccgtaaagggtaacctacggtaacttaaactaaaacgttaaaccgtaaacgttagtacggtactacgtacctaaccgtaattcgttaacgtctttacaccgttccgacctagttctacgtacttaacg

SEQ ID NO: 140665 - DNA, 506 bp, Homo sapiens
  misc_feature: GYAE6OF02F2ZXQ.46.67.G01.1.454.CMB.1.raw
  modified_base (487)..(487): a, c, t, g, unknown or other
  misc_feature (487)..(487): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagtattttgctaacttattactgtcaactagaattacaattgtttcggacctaaggacacgactaacaaattaaacgaactgtagctgacacatctgtcttnactcttcccgcatctgtac

SEQ ID NO: 140666 - DNA, 620 bp, Homo sapiens
  misc_feature: GYAE6OF02H81AR.46.67.G01.1.454.CMB.1.raw
  modified_base (193)..(193): a, c, t, g, unknown or other
  misc_feature (193)..(193): n is a, c, g, or t
  modified_base (227)..(227): a, c, t, g, unknown or other
  misc_feature (227)..(227): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctcgcaaccgtggganacagtgcaccatcacttgccgggcaagtcgaacnttgacaccttatttaaatgtatcaacatagaccaggacgccctaagctctaatctatgctcgcatcctagtttgacaaaggtgggtaccagtacggacggttcgaggttggacaggttggtactcgtcgggaactagtactttcgaacttcgtaccacctatccaagtaactactacgactaacgtagaagttagtttacgtactaactttaagttacgttagttactaaacgtaagtaaacttactaacttacgttttacggaccgtaacggtacgtaacgtaaccttaacgtaaacttaaacgaacgtacgtacgtacgtacgtaccgacctacgttcgtacgttaccttaccgtacttaccgttcccgtaccctacttaccttagtaacg

SEQ ID NO: 140667 - DNA, 586 bp, Homo sapiens
  misc_feature: GYAE6OF02IVZIR.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgagggaagggctggaatacattggaagtgtctctcatagtggaggttcctattacagtccgtctctcaagagtcgagtcaccatatctctggacacgtccagcaatcagttttccctgaagatgagttctgtgaccgccgctgacacgggcgtttatactgtgcgagagacggctattatgtattttggagttggttatttcgactacccttagacgttcggacggggctcggaccccgtggggacccgaggggaacttacgtggtccgaccgttctccttacgccttcccaaccgaacgggtccccaacgttccggttccctttcccccgtcggtccctaccccttccctaccgaacgacgtacccg

SEQ ID NO: 140668 - DNA, 577 bp, Homo sapiens
  misc_feature: GYAE6OF02JS5C0.46.67.G01.1.454.CMB.1.raw
  modified_base (192)..(192): a, c, t, g, unknown or other
  misc_feature (192)..(192): n is a, c, g, or t
  modified_base (216)..(216): a, c, t, g, unknown or other
  misc_feature (216)..(216): n is a, c, g, or t
  modified_base (225)..(225): a, c, t, g, unknown or other
  misc_feature (225)..(225): n is a, c, g, or t
  modified_base (366)..(366): a, c, t, g, unknown or other
  misc_feature (366)..(366): n is a, c, g, or t
  modified_base (372)..(372): a, c, t, g, unknown or other
  misc_feature (372)..(372): n is a, c, g, or t
  modified_base (397)..(397): a, c, t, g, unknown or other
  misc_feature (397)..(397): n is a, c, g, or t
  modified_base (405)..(405): a, c, t, g, unknown or other
  misc_feature (405)..(405): n is a, c, g, or t
tcagactagcagtacacgaccggtgctcgatttagagtatacatattgggtttggggtagtctcggtcgaggacacagcatggacatgagggtcccgctcagctcctggggctcctgctactctggctccgaggtgccagatgtgacatcgagctgacccagtctccatcctccctgtctgcaaccgtgganacagtgtcaccatcacttgccggnaagtcgacnttgacacctatttaaatgtatcaacatagaccagggaccgaccctaagctcctaatctatgactgacactccagtttcgctaaacgtgggtcccagtcgtaggttcagtggcaggtggatcgtggtacagatttcacttcncacatnagtaactctagctaacgtgaacgtnttttacgnttaacctttatacgttatacaaactagtaaattaccgaaatttcgtttacggaacctaagggtactacgaacttaaacaaatttaaacgacttatacggtactacggtaccgaacttacttacgttacgttaccttagtacgttccttaacccgtctaactttccagttaac

SEQ ID NO: 140669 - DNA, 540 bp, Homo sapiens
  misc_feature: GYAE6OF02IZN1C.46.67.G01.1.454.CMB.1.raw
  modified_base (509)..(509): a, c, t, g, unknown or other
  misc_feature (509)..(509): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgcccctaagctcctaatctatgctgcatccagtttgcaaagtgggtcccagtcgaggttcagtggcagtggatctgggacagtatttcactctcaccatcagtaatctgacaacgtgaagtatttgactaacttattactgtacaatagtaattactaattgtttacggaccgtaaggtacacgtaacttaactaaaacgtttaaacgaacgttagtaggtactcgacctacctattcgtnttcttcacttcctttcccgctactctagtac

SEQ ID NO: 140670 - DNA, 535 bp, Homo sapiens
  misc_feature: GYAE6OF02HNBDF.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatcgtgggacagtatttcactctcaccatcagtaatctgctaacgtgaagtattttgactaacttattacttgtacaactagaattacaattgtttacggacctaagggacacgacttaacaaagttaaacgaacttagtggtactagaccacctatctcgttacttctacttccttacccgacctatcctagtac

SEQ ID NO: 140671 - DNA, 508 bp, Homo sapiens
  misc_feature: GYAE6OF02GPAVJ.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagtattttgactaacttattactgtacaacagtaattacaattgttttacggacctaagggacacgactaacaaattaaacgaactgtgctgcacatctgtctcactcttcccgctatctgtac

SEQ ID NO: 140672 - DNA, 523 bp, Homo sapiens
  misc_feature: GYAE6OF02H8BIA.46.67.G01.1.454.CMB.1.raw
  modified_base (222)..(222): a, c, t, g, unknown or other
  misc_feature (222)..(222): n is a, c, g, or t
  modified_base (262)..(262): a, c, t, g, unknown or other
  misc_feature (262)..(262): n is a, c, g, or t
  modified_base (342)..(342): a, c, t, g, unknown or other
  misc_feature (342)..(342): n is a, c, g, or t
  modified_base (381)..(381): a, c, t, g, unknown or other
  misc_feature (381)..(381): n is a, c, g, or t
  modified_base (416)..(416): a, c, t, g, unknown or other
  misc_feature (416)..(416): n is a, c, g, or t
  modified_base (426)..(426): a, c, t, g, unknown or other
  misc_feature (426)..(426): n is a, c, g, or t
  modified_base (484)..(484): a, c, t, g, unknown or other
  misc_feature (484)..(484): n is a, c, g, or t
  modified_base (490)..(490): a, c, t, g, unknown or other
  misc_feature (490)..(490): n is a, c, g, or t
tcagactagcagtacacgaccggtgctcgatttagagtatacatattgggtttggggtagtcgttcggttcaggacacagcatggacatgagggtccccgctcagctcctggggctcctgctactctggctccgaggtgccagatgtgacatcgagctgacccagtctccatcctccctgtctgccaaccgtgggagacagtgtcaccatcacttgccgggnaagtcggaacattgacactatttaaatggtatcaacatanacaggacgccctaagctctaatctatgctgcatccatttgcaagtgggtccatcgagttcagtggcagtgatcgtggacngagtttcaatctcaccagtcagtaatcctagtcaacgtnaagtacttttagactaacttattacttgtactaanacgtaattanaattgttttacgactaaggacacgactaactaaataaacaactagtgtactgacaacngttacngttctactactcttccctacgacttctataacg

SEQ ID NO: 140673 - DNA, 542 bp, Homo sapiens
  misc_feature: GYAE6OF02HSDD3.46.67.G01.1.454.CMB.1.raw
  modified_base (211)..(211): a, c, t, g, unknown or other
  misc_feature (211)..(211): n is a, c, g, or t
  modified_base (374)..(374): a, c, t, g, unknown or other
  misc_feature (374)..(374): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttcccngagatgagttctgtgaccgcgctgacacgggcgtttattactgtgcgagagacggctattatgtatttttggagttggttatttcgtactaccctagatcggacgggggctccggacccctggggaccaggggaatacgtggtccgaccgttctccttagcctacccg

SEQ ID NO: 140674 - DNA, 533 bp, Homo sapiens
  misc_feature: GYAE6OF02HIZPK.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaatggtatcaacatagaccagggacgcccctaagctcctaatctatgctgcatccagtttgcaagtgggtcccatcgagttcagtggcagtggatcgtgggacagtatttcactctcaccatcagtaatctgacaacgtgaagtattttagactaacttattactagtacaactaagtaattacaattcgtttacggacctaagggacaacgaacttaacaaaattaaacgaactgtacggctagacctaacattactgtacttactacttcctacccgctacttctataac

SEQ ID NO: 140675 - DNA, 504 bp, Homo sapiens
  misc_feature: GYAE6OF02G1NV2.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatgtatcaacatagaccaggacggcccctaagctcctaatctatgctgcatccagtttgcaaagtggggtcccatcgagttcagtggcagtgatctgggacagatttcactctcacatcagtaatctgcaacgtgaagtattttgctaacttattactgtacaactagaattacaattgtttacggacctaagggacacgaactacaaattaaacgaactgtagctgacacatctgtcttcatcttcccgccatctagtac

SEQ ID NO: 140676 - DNA, 585 bp, Homo sapiens
  misc_feature: GYAE6OF02I3RRB.46.67.G01.1.454.CMB.1.raw
  modified_base (334)..(334): a, c, t, g, unknown or other
  misc_feature (334)..(334): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctgggctgggtccggcagctcccagggaaggggctggaatacattgggaagtgtctctcatagtggaggttcctattacagtccgtctctcaagagtcgagtcaccatatctctggacacgtccagcaatcagttttcccngaagatgagttctgtgaccgccgctgacgacgggtctttatacttgtgcgagagacggctattatgtattttgggagttggtttatttcgactacccgttagagtcggacgggggtctccggaccccgtggggaccgagggaactacgttcggtccaccgtcttccgttacgccctccgaccgaacgggcccacgtcccgttccttccccccgtcggtccctaccccttcccgtacccaacgacgtacccg

SEQ ID NO: 140677 - DNA, 512 bp, Homo sapiens
  misc_feature: GYAE6OF02GYQNG.46.67.G01.1.454.CMB.1.raw
  modified_base (485)..(485): a, c, t, g, unknown or other
  misc_feature (485)..(485): n is a, c, g, or t
  modified_base (491)..(491): a, c, t, g, unknown or other
  misc_feature (491)..(491): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatctgggacagatttcactctcaccatcagtaatctgacaacgtgaagtattttgctaacttattactgtacaacagaattacaattgttttacggacaagggacacgacttaacaaattaaacgaactgtacgctgacacattctnttcttnacttcttcccgctatctgtac

SEQ ID NO: 140678 - DNA, 961 bp, Homo sapiens
  misc_feature: GYAE6OF02HD7RC.46.67.G01.1.454.CMB.1.raw
tcagactagcagtacacgaccggtgctcgatttagagtatacatattggggttgggggaagtctcggtcaggtacgaccagcgaactggacgaatccgagggtccccgctcagtcctccttcggggcctcctgtcctactcgtcggtcctccggaggttcgccaggatagtgtacatcgagtctcgacccacgtcctcctactcctccctgtcctgggacgaaccggtgggacgacctacgttcgttccaccagtccacgttcggaccgggggctaacggtacgggaacctagttacgaaccttaaccgttaacttttaaaacgttacggtaattaccgaaacgtacgttacggaacccgtaacgggggtaaccccggtacccccgtaaaggtcccttacccttaactaccttaaagttcgtacgttaacggtcctaccgttcccgtaacgggttttaccgaccgttaaaacggggttccgggggttacccccaaggttacccggttaacggggttttccgaacgggttcggggtcccggtaagggggttcggggtaacggttaccggttaggggggaacccttaacgggtaccttttccgaacccttacccgtacctaaccctacgttaccgaacgtttaacgttccgtaacggaccgttaaaccggtaggaaacgtttacggttttcgaacctttaaaccgtttttagtttacccgttacggttaacctaaaccggtaacttaaacgtttaccaaagtttttaccggttttaaccgggaaccccggttaaacgggtacccgtaacggtaaccgttaaccgtaaaacggtttaaacggaaccgttagggttaccggtacccttaacggaacccgtaaccgtacgttccgttacgtttaccgtacccgttaaccgtttccccgttaccccggttaccctacgtttacccgtagttaacccg

SEQ ID NO: 140679 - DNA, 512 bp, Homo sapiens
  misc_feature: GYAE6OF02H7RLM.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatctgggacagatttcactctcaccatcagtaatctgcaacgtgaaagtattttgactaactttattaactgtacaacagaattacaattgttttacggacctaaggacacgactaacaaattaaacgaactgtagctgacacatctgtcttcatcttcccgccatctgtac

SEQ ID NO: 140680 - DNA, 562 bp, Homo sapiens
  misc_feature: GYAE6OF02H92JF.46.67.G01.1.454.CMB.1.raw
  modified_base (207)..(207): a, c, t, g, unknown or other
  misc_feature (207)..(207): n is a, c, g, or t
  modified_base (249)..(249): a, c, t, g, unknown or other
  misc_feature (249)..(249): n is a, c, g, or t
  modified_base (305)..(305): a, c, t, g, unknown or other
  misc_feature (305)..(305): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctgggctgggtccgnagctcccgagggaaggggctggaatacagttggaagtgtctntcatagtggaggttcctattacagtccgtctctcaagagtcgagtcaccatatctntggacacgtcagcaatctagttttccctagaacgatgagttctgtcgaccgcgctgacacgggtcgtttattactgtgcgagagacggctattatgtatttttggagttggtttattcgactaccagtagtcggacggggcctcgaaccccgtgggccagggaactacgtcgtcgtacgtcctacttacgcctaccgtacccgaacggcccagtccgttccttccccgtcgcctacccttcctacccagacgtaccg

SEQ ID NO: 140681 - DNA, 580 bp, Homo sapiens
  misc_feature: GYAE6OF02HWDXW.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacactatttaaattggtatcaacatagaccagggacgccctaagctcctaatctatgctgcatccagtttgcaaagtgggtcccagtcgaggttcagtggcagtgatctgggacagtattcactctcaccatcagtaatctgacaacgtgaagtattttgactaatttattactagtacaaactagtaaattacaaatttgtttaccggaccgtaacggggtactaaccgtaaccttaacgtaaaacttaaacgtaaacgttggtaacggacttacggacctaacctacttacttcgttacctttccgtaactttcccttaccccggtaccctattacctaggttaacc

SEQ ID NO: 140682 - DNA, 498 bp, Homo sapiens
  misc_feature: GYAE6OF02GLKO1.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgagttcagtggcagtgatctgggacagatttcactctcaccatcagtaatctgcaacgtgaagattttgctaacttattactgtcaacagaattacaatgttttcggaccaagggacacgactaacaaattaaacgaactgtgctgcacatctgtcttcatcttcccgcatctgtac

SEQ ID NO: 140683 - DNA, 516 bp, Homo sapiens
  misc_feature: GYAE6OF02ICZCE.46.67.G01.1.454.CMB.1.raw
  modified_base (416)..(416): a, c, t, g, unknown or other
  misc_feature (416)..(416): n is a, c, g, or t
  modified_base (485)..(485): a, c, t, g, unknown or other
  misc_feature (485)..(485): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaattgtatcaacatagaccagggacgcccctaagctcctaatctatgctgcatccagtttgcaaagtggggtcccatcgaggttcagtggcagtggatcgtgggacagatttcactctcaccatcagtaatctgactaacgtgtaagtattttgactaacttattactgtacaanagtaattacaattgtttacgacaaggacacgactaacaaattaaacgaactagtgactgacaacatctnttcttctactccttccgtccacttctataac

SEQ ID NO: 140684 - DNA, 516 bp, Homo sapiens
  misc_feature: GYAE6OF02HXSI9.46.67.G01.1.454.CMB.1.raw
  modified_base (192)..(192): a, c, t, g, unknown or other
  misc_feature (192)..(192): n is a, c, g, or t
  modified_base (492)..(492): a, c, t, g, unknown or other
  misc_feature (492)..(492): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacacctatttaaattggtatcaacatagaccagggacggcccctaagctcctaatctatgctgcatccatttgcaaagtggggtcccagtcgaggttcagtggcagtggatcgtgggacagatttcactctcaccatcataatctgctaacgtgaagtattttgactaactttattactgtacaacagtaaattacaattgttttcggacctaagggacacgactaacaaactaaacgaactgtgtactgacacctatctnttactcatcctcctcatctagtac

SEQ ID NO: 140685 - DNA, 549 bp, Homo sapiens
  misc_feature: GYAE6OF02G6K62.46.67.G01.1.454.CMB.1.raw
  modified_base (212)..(212): a, c, t, g, unknown or other
  misc_feature (212)..(212): n is a, c, g, or t
  modified_base (326)..(326): a, c, t, g, unknown or other
  misc_feature (326)..(326): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcgggagaccctgtccctcacctgcgctgtctctggtncctccatcagtgtggtttctctggggctgggtccggcagctcccgagggaagggctggaatacattggaagtgtctctcatagtggagttcctattacagtccgtctctcaagngtcgagtcaccatatctctggacacgtcagcaatctacgttttcccagaagtatgtagttctgtcgaccgcgctagacgacgggtctttatctgtgcgtagagacgctattatgtattttggagttgtttattcgactacctagtagtcggacgggctccggacccggtgggaccgaggtaacgtacgtcggtccgtaccgtccgtccgttacgccctacccg

SEQ ID NO: 140686 - DNA, 529 bp, Homo sapiens
  misc_feature: GYAE6OF02HMLFL.46.67.G01.1.454.CMB.1.raw
  modified_base (377)..(377): a, c, t, g, unknown or other
  misc_feature (377)..(377): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgcccctaagctcctaatctatgctgcatccagtttgcaaagtgggtcccatcgaggttcagtggcagtggatcgtgggacagtatttcactctcacctatcagtatctncaacgtgaagtattttgactaacttattacttgtacaactagtaattacaattcgtttacggacctaagggactaacgtaactaactaaattaaacgaactgtagactgactaacatctacgtcttactacttcctccgccacttctagtac

SEQ ID NO: 140687 - DNA, 520 bp, Homo sapiens
  misc_feature: GYAE6OF02H9ZQU.46.67.G01.1.454.CMB.1.raw
  modified_base (302)..(302): a, c, t, g, unknown or other
  misc_feature (302)..(302): n is a, c, g, or t
  modified_base (415)..(415): a, c, t, g, unknown or other
  misc_feature (415)..(415): n is a, c, g, or t
  modified_base (498)..(498): a, c, t, g, unknown or other
  misc_feature (498)..(498): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaattgtatcaacatagaccaggacggcccctaagctcctaatctatgctgcatccagtttncaaagtggggtcccatcgaggttcagtggcagtggatcgtgggacaggatttcaactctcaccatcagtaatctgcaacgtgaagtattttgactaacttatacttgtacaanagtaattacaattgttttacggactaagggtacacgaactaacaaattaaacgaactagtgactagacgactatactgttctntactctccctctactctagtac

SEQ ID NO: 140688 - DNA, 557 bp, Homo sapiens
  misc_feature: GYAE6OF02JJESU.46.67.G01.1.454.CMB.1.raw
  modified_base (333)..(333): a, c, t, g, unknown or other
  misc_feature (333)..(333): n is a, c, g, or t
  modified_base (346)..(346): a, c, t, g, unknown or other
  misc_feature (346)..(346): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggtccttcggagaccctgttccctcacctgcgtctgtctctggtgcctcatcagtagtggttcttctggggctgggtccgcagctccgagggagggctggaatacattggaagtgtctctcatagtggaggttcctattacagtccgtctctcaagagtcgagtcaccatatctcgtggacacgtccagcaatctagttttccngaagatgagttcngtgaccgcgctgacgacggtcgtttatacgtgtcgcgagagacggctattatgtattttaggagttagttattacgactaccgtagactcggacggggctcggacccgtgggccgagggaactacgtggtctaccgtctccttacgctaccgaccgacgggaccagtccgtccttccccgcggtccacccgtccgtccgacgacgtacccg

SEQ ID NO: 140689 - DNA, 545 bp, Homo sapiens
  misc_feature: GYAE6OF02HPBNI.46.67.G01.1.454.CMB.1.raw
  modified_base (334)..(334): a, c, t, g, unknown or other
  misc_feature (334)..(334): n is a, c, g, or t
  modified_base (362)..(362): a, c, t, g, unknown or other
  misc_feature (362)..(362): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttcccngaagatgagttctgtgaccgcgctgacncgggctttatactgtgcgagagacggctattatgtattttggagttggttatttcgacaccctagtactcggacggggtctcggaccccgtggggccaggggaatacgtggtcaccgtctccttagcctccaccgaacggcccagtccggtccttccccgtggcccaccctcctccagcgccc

SEQ ID NO: 140690 - DNA, 550 bp, Homo sapiens
  misc_feature: GYAE6OF02F6965.46.67.G01.1.454.CMB.1.raw
  modified_base (368)..(368): a, c, t, g, unknown or other
  misc_feature (368)..(368): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccgcagctcccagggagggctggatacattggaagtgtctctcatagtggaggttcctattacagtccgtctctcaagagtcgagtcaccatatctctgacacgtcagcaatcagttttcccngaagatgagttctgtgaccgccgctgacgacgggtcgtttatactgtgcgagagacggctagttatgtatttttggagttggtttatttcgactacccgtagacttcggacggggctccggaccccgtgggacccgagggtaactacgtcggtcctacccgtctcccgttagcccttacccg

SEQ ID NO: 140691 - DNA, 542 bp, Homo sapiens
  misc_feature: GYAE6OF02H7HWF.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccagtcgaggttcagtggcagtggatcgtgggacagatttcactctcacatcagtaatctgacaacgtgaagtattttgactaactttattactgtacaacagtaattacaagttgttttacggacctaaagggtacaaccgtaacgttaaactaaagttaaacgaaacgttgtagctagaccacctatctgttcttcacttccttcccgcctattccgtgtaac

SEQ ID NO: 140692 - DNA, 639 bp, Homo sapiens
  misc_feature: GYAE6OF02H61GS.46.67.G01.1.454.CMB.1.raw
  modified_base (362)..(362): a, c, t, g, unknown or other
  misc_feature (362)..(362): n is a, c, g, or t
tcagactagcagtacacgaccggtgctcgatttagagtatacatattggggttttggtcctcctgctggtggcgacgctcccagatcgggtccgtgtccctggtgcaactgcgaggacgtcggggcccacgactggtgaggcctttccggaagtaccctcgtccctcaccctgccgcctggtctctggtgcctcagtcagtagtggtttctctgggctgggtccggcgagctccagggacgggctggaatacattggaagtgtctctcatagtggaacggttcgtagttacacgtccgtctctcaagcgtcgagtcaccatactctctggaccacgtccgacgctaactcgtagttttccgnggaaacgatgaacgttctggtcggacccgcgtacttacgacctacgggtctttaattactgtacgcgagacgacggctagtactgtagttttggagtgttatttcgactaccgtagatcggacgggtctaccggacccgtggggccgaaggggtaactacggtgggtaccaaccggttcaccgttacgacccgttaccaccggtaacgggtcccacggtccggttaccctccccgttggaccctaccccttaccctacctaaccggtccgtaccccg

SEQ ID NO: 140693 - DNA, 524 bp, Homo sapiens
  misc_feature: GYAE6OF02HBPXN.46.67.G01.1.454.CMB.1.raw
  modified_base (360)..(360): a, c, t, g, unknown or other
  misc_feature (360)..(360): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtgcagtggatcgtgggacagatttcactcncaccatcagtaatctgacaacgtgaagtatttgactaacttatacttgtacaacagtaattacaattgtttacggactaagggacacgtaactaacgtaaattaaacgaactgtgactgacaacctatctgttcttactacttccttcccgcctacttctgtac

SEQ ID NO: 140694 - DNA, 555 bp, Homo sapiens
  misc_feature: GYAE6OF02F8X63.46.67.G01.1.454.CMB.1.raw
  modified_base (285)..(285): a, c, t, g, unknown or other
  misc_feature (285)..(285): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctccagggaagggctggaatcattggaagtgtctctcatagtggaggttcctattacagtccgtctctcaagngtcgagtcaccatatctctggacacgtccagcaatcagttttccctgaacgatgagttctgtcgaccgccgctgacacgggtcgttttatactgtgcgagagacggctattatgtattttggagttggttatttcgacacctagactcggacggggctcggaccctggggccgagggaactacgtggtcaccgtctccttacgcctccaccgaacgggcccagttccggtccttccccgtcggccctacccctccctcccacgcgtaccc

SEQ ID NO: 140695 - DNA, 533 bp, Homo sapiens
  misc_feature: GYAE6OF02JIN0H.46.67.G01.1.454.CMB.1.raw
  modified_base (211)..(211): a, c, t, g, unknown or other
  misc_feature (211)..(211): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttctctggggctgggtccgcagctccgagggaggggctggaatacattggaagtgtctctcatagtggaggttcctattacagtccgtctctcaagagtcgagtcaccatatctctggacacgtcagcaatctagttttcccagaagtatgtagttctgtgaccgccgctgacgacgggtctttatactgtgcgagagacgctattatgtattttggagttggttatttcgactaccgtagatcggacgggctacggcccgtgggaccagggatacgtggtaccaccgtctccttagccctaccg

SEQ ID NO: 140696 - DNA, 506 bp, Homo sapiens
  misc_feature: GYAE6OF02JELCR.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagtattttgactaacttattactgtacaacagaattacaattgtttacggactaaggacaacgtactacaaattaaacgaatagtgctgcactatctgtcttcactcttcccgcatctgtac

SEQ ID NO: 140697 - DNA, 576 bp, Homo sapiens
  misc_feature: GYAE6OF02JKIFC.46.67.G01.1.454.CMB.1.raw
  modified_base (323)..(323): a, c, t, g, unknown or other
  misc_feature (323)..(323): n is a, c, g, or t
  modified_base (341)..(341): a, c, t, g, unknown or other
  misc_feature (341)..(341): n is a, c, g, or t
  modified_base (368)..(368): a, c, t, g, unknown or other
  misc_feature (368)..(368): n is a, c, g, or t
  modified_base (395)..(395): a, c, t, g, unknown or other
  misc_feature (395)..(395): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccagactggtgaggccttcggagaccctgtccctcacctgcgctgtctctggtgcctcatcagtagtgtttctctggggctgggtccgcagcctcccgaggaagggctggaatacattggaagtgtctctcatagtggaggttcctattacagtccgtctctcaagngtcgagtcaccatatctntggacacgtccagcatcagttttcccngaacgtatgagttctgtagaccgccgntacgactacgggtcttttattacgtacgtgtccgagtagacgtacttattacgtgtagtttttggagttggtttatttcggactacccgttagtagtcggtacgggcgtccggtaacccggttgggccgtaagggacttaccggtggtccgtaccgtccgtccttacgtcccgtaaccccg

SEQ ID NO: 140698 - DNA, 510 bp, Homo sapiens
  misc_feature: GYAE6OF02HJL5S.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctcctaatctatgctgcatccagtttgcaaagtgggtcccatcgaggttcagtggcagtggatcgtgggacagtatttcactctcaccatcagtaatctgcaacgtgaagtattttgactaacttattacttgtacaacagtaattacaattgtttacggaccaagggacacgactaacaaattaaacgaactgtgctgcacatctgtcttcacttcttccgcctatctgtac

SEQ ID NO: 140699 - DNA, 536 bp, Homo sapiens
  misc_feature: GYAE6OF02JCKDQ.46.67.G01.1.454.CMB.1.raw
  modified_base (374)..(374): a, c, t, g, unknown or other
  misc_feature (374)..(374): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagcccgtctctcaagagtcgagtcaccatatctctggacacgtccaacaatcagttttcccngaagatgagttctgtgaccgccgctgacacgggcgtttattactgtgcgagagacggctattatgtattttggagttggttatttcgactaccctagatcgacggggctcggacccgtgggccagggaactacgtggtcaccgtctcctacgcctccaaccg

SEQ ID NO: 140700 - DNA, 558 bp, Homo sapiens
  misc_feature: GYAE6OF02JGTYF.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctacctaatctatgctgcatccagtttgacaaagtcgggtcccatcgaggttcagtgcagtgatcgtgggacagatttcactctacaccatcagtaatcctgacaacgtgtaagtattttcgactaactttattacttagttacaaactagtaattacaatttggtttaccggaccaaagggtacctaacggtaactaaacgtaaattaaaccgaaattgtaggtactagaccaactaattctagttccttacacttcccttacccgactatctagtaac

SEQ ID NO: 140701 - DNA, 548 bp, Homo sapiens
  misc_feature: GYAE6OF02I820N.46.67.G01.1.454.CMB.1.raw
  modified_base (335)..(335): a, c, t, g, unknown or other
  misc_feature (335)..(335): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttcccngaagatgagttctgtcgaccgccgctgacacgggtcgtttattacgtgtgcgagagacggctattatgtatttttggagttggttatttcgactaccctagactcgacggggctcgacccgtgggccgagggaatcgtgtcgaccgtctccttagcctccaccgaacggcccagtccgtccttccccgtggcccaccctcctccagcgtaccc

SEQ ID NO: 140702 - DNA, 529 bp, Homo sapiens
  misc_feature: GYAE6OF02F9XKN.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatctgggacagattcactctcaccatcagtaatctgcaacgtgaagtattttgactaacttattactgtacaacagtaattacaaattcgttttacggaccgtaagggacaacgaacttaacaaaattaaacgaactagtaggactgacctaaccatctgtcttactactccttcccgcctatctgtac

SEQ ID NO: 140703 - DNA, 558 bp, Homo sapiens
  misc_feature: GYAE6OF02JTGTV.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacacctatttaaatgtatcaacatagacagggacggcccctaagctcctaatctatgctgcatccagtttgcaaagtggggtcccatcgaggttcagtggcagtggatctgggacagattcactctcaccatcagtaatctgcaacgtgaagtattttgactaactttattacttagtacaactagtaattaactaagttgttttacggacctaagggtactaacggtactaacaaaattaaaccgaaacttagtacggtactaggtacaacctattacttacgttactttacaacgttccttaccccgctaacttcctagtaaccg

SEQ ID NO: 140704 - DNA, 564 bp, Homo sapiens
  misc_feature: GYAE6OF02G1W2H.46.67.G01.1.454.CMB.1.raw
  modified_base (557)..(557): a, c, t, g, unknown or other
  misc_feature (557)..(557): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagcctcccgaggggaaggggctggaatacagttggaagtgtctctcatagtggaggttcctattacagtccgtctctcaagagtcgagtcaccatatctctggacacgtccagcaatcagttttcccagaagatgagttctgtgaccgcgctgacacgggtctttatactgtgcgagagacggctaattagtgtagttttggagttggttatttcgactaccctagatcggacgggtctcgacccgtgggccagggactacgtcgtcaccgtctccgttacgcctccgacgaacgggcccacgtccggtccttccccgcggtcccaccccgttccctaccgaacgngtacccg

SEQ ID NO: 140705 - DNA, 568 bp, Homo sapiens
  misc_feature: GYAE6OF02HQTH0.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatctgggacagatttcactctcaccatcagtaatctgacaacgtgaagtattttagctaactttattacttgttcaaactagaaattactaattgttttaccggacctaacgggaactacgtaacttaacgaaaactttaaaacgaaacttggtacggtacgtgacctaaccaacttacctagttccttctacttccgtttaccccgcccgtaacttccgtgtaaccg

SEQ ID NO: 140706 - DNA, 584 bp, Homo sapiens
  misc_feature: GYAE6OF02IGQ7U.46.67.G01.1.454.CMB.1.raw
  modified_base (398)..(398): a, c, t, g, unknown or other
  misc_feature (398)..(398): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggcctttcggagaccctgtccctcacctgcgctgtctctggtgcctccatcagtagtggtttcttctggggctgggtccggcagctccagggagggctggaatacattggaagtgtctctcatagtggaggttcctattacagtccgtctctcaagagtcgagtcaccatatctctggacacgtccagcaatctagttttcccctgaagtatgtagttctgtgaccgccgctcgacgacgggtcgttttatacgtgtgcgagagacggntattatgtagttttggtagttgttagtttcgtactaccctagtacgtcggacggggccgtcgacccgtcgggccgagggaactacgtggtccgacgtcctccgttacgcctccaccgaacggccctacgttccggtccctttcccccgtcggtccctacccgttcccctaccgacgtacgtacccg

SEQ ID NO: 140707 - DNA, 502 bp, Homo sapiens
  misc_feature: GYAE6OF02GQF2W.46.67.G01.1.454.CMB.1.raw
  modified_base (449)..(449): a, c, t, g, unknown or other
  misc_feature (449)..(449): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtgatctgggacagattcactctcaccatcagtaatctgcaacgtgaagtattttgactaacttattacttgtcaacagaattacaattcgtttcgaccaagggacagactanaaattaacgaactgtgctgcacatctgtcttcacttcttcccgcactctgtac

SEQ ID NO: 140708 - DNA, 532 bp, Homo sapiens
  misc_feature: GYAE6OF02G2484.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctgggctgggtccggcagctccagggagggctggaatacattggaagtgtctctcatagtggaggttcctattacagtccgtctctcaagagtcgagtcaccatatctctggacacgtccagcaatcagttttccctgaagatgagttctgtgaccgcgctgacacgggtctttatactgtgcgagagacggctatatgtattttggagtgttattcgactacctagatcgacgggctcgacccgtgggccagggaatacgtgtcaccgtctcctagcctccaccgaacggcccacgtccggtccttcccctggaccaccctcctcctagacgtacccg

SEQ ID NO: 140709 - DNA, 732 bp, Homo sapiens
  misc_feature: GYAE6OF02FFAXQ.46.67.G01.1.454.CMB.1.raw
  modified_base (161)..(161): a, c, t, g, unknown or other
  misc_feature (161)..(161): n is a, c, g, or t
tcagactagcagtacacgaccggtgctcgatttagagtatacatattgggtttggggagtctcggtcaggacacagcatggacatgacgggtcccgctcagctccgtggggctcctgctactctggctcgaggtgccagatgagacatcgacgctcgaccngtcctcctactcctcctgtctacgacgtacggtggacactagtctacacctatccgtacgtcggacggtactacggacgactagttactacttaacgttaattaacggtatacacaagtagtaccgacggacggtaccctacgtatcctaagtctctacgtcgtcactacgtacgttacgtaggttacggaacgggttccgggacgttactacgggtacggtacggtagcgggtacgtcgttacggacgtcgttacgggtactacttaactttccacctactacccaatacctaacgtaacggtacttacgtacgtaaagttacggttaacgttacggtttaattaccttaaacggttaaaccttaacgttaaccgttaacggtaaacctaaacgttaacgttaaccgtttaacgttaaccgggtttaccgtttaacgggtaaacgaaccggtaaccgtaaacgttaaactaacgttaaacgtacttaacggtcggttaactacgtcaacgttctaacgtctacccgttactccttactacccgtactacctacgtacgtactacgtacgg

SEQ ID NO: 140710 - DNA, 536 bp, Homo sapiens
  misc_feature: GYAE6OF02GW3CQ.46.67.G01.1.454.CMB.1.raw
  modified_base (517)..(517): a, c, t, g, unknown or other
  misc_feature (517)..(517): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagacagggacggccctaagctcctaatctatgctgcatccagtttgactaaagtgggtcccagtcgaggttcagtggcagtggatcgtgggactagatttacacttctcaccatcagtatctgacaacgtgaaagtattttcgacttaacgttattactacgttacaaatagtaaattactaagttcgtttacggaccgtaaagggtaccaacgtaactaactaaattaaacgaacgtgtagctagacactatctgtctnacttctccgctatctgtac

SEQ ID NO: 140711 - DNA, 558 bp, Homo sapiens
  misc_feature: GYAE6OF02HTJ3O.46.67.G01.1.454.CMB.1.raw
  modified_base (213)..(213): a, c, t, g, unknown or other
  misc_feature (213)..(213): n is a, c, g, or t
  modified_base (377)..(377): a, c, t, g, unknown or other
  misc_feature (377)..(377): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggcctttcggagaccctgtcccctcacctgcgctgtctctggtncctccatcagtagtggtttcttctggggctgggtccgcagctcccgagggaggggctggaatacattggaagtgtctctcatagtggaggtttcctattacagtccgtctctcagagtcgagtcacatatctctggacacgtccagcaaatctacgttttcccngaagtatgtagtttctgtcgacccgccgctgacacgggtcttttattacgtgtgcgagagacgctattatgtattttggagttggttatttcgactacctagagtcggacggggctcggaccccgtggggacccagggtaactacgttcggtccacccgttcttccgttacgccctacccg

SEQ ID NO: 140712 - DNA, 572 bp, Homo sapiens
  misc_feature: GYAE6OF02GWFXV.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaagggggctgggaatacattggaagtgtctctcatagtggaggttcctattacagtccgtctctcaagagtcgagtcaccatatctctggacacgtccagcaatcagttttccctgaagatgagttctgtgaccgccgctggacacgggtcgtttattactgtgcgagagacggctattatgtatttttggagttggttatttcgactaccctagacgtcggacggggtctccggaccccgtggggaccgagggaatacgtggttcaccgttctccttacgcctccaccgaacgggcccatccggttccttccccgtcggccctacccctccctacccgacgacgtacccg

SEQ ID NO: 140713 - DNA, 530 bp, Homo sapiens
  misc_feature: GYAE6OF02IURXC.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccaggacggcccctaagctcctaatctatgctgcatccagtttgcaaagtgggtcccatcgaggttcagtggcagtggatctgggacagattcactctcaccatcagtaatctgcaacgtgaagtattttgctaacttattactgtacaacagaattacaattgtttacggcctaagggacacgtactaacaaaattaaacgaactgttaggctagaccacctaacttcgtagttccttctaacttccttccccgacctactctagtaac

SEQ ID NO: 140714 - DNA, 787 bp, Homo sapiens
  misc_feature: GYAE6OF02F2UIG.46.67.G01.1.454.CMB.1.raw
tcagactagcagtacacgaccggtgctcgatttagagtatacatattgggtttgggaggtctcggtcaggacgacacgtcactgggacactaggacgggttccccgcttcgagctcctgggggcctccctgctactctggcgtccgaggtcgccaggaattgggtgacatcgtaggttccttgtacccagttcttccagtcctccctgtctgcgacgtggagacaggtggtcaccaggtcactttggcccgggacaacggtcggggaacctagttaggacctaccttacttttaaagttgggtactacaacctattaggacctacggggaccggtacccccgtaaagtcttaccgtaaattcgttaagttcgggtcctcggacgtacttcccgtaggttttagggaaccggtaaaacgggttcggggggtaccctagggttccgggacggtttaccaggttagggacgtaaggtggtagtacggtaggggaacaagttactttacacgttcgtaccacctagtacgaaggtaactacgtacgacctaacgttacgtaacgtaacgttttacggaacctaaacgttacttaacgttacgttacctaaacgtaagttaaactttaactaaagttacggttttaaccgaccggtaacgggtacgtaaccggaaccgtaaacgtaaaacgttaaaccgaacgttagttacggtactacgtactaaccgtagttacggtaacggttccttacgtacgttccgttacccgacctacggttcgtacgtaaccgg

SEQ ID NO: 140715 - DNA, 553 bp, Homo sapiens
  misc_feature: GYAE6OF02F998W.46.67.G01.1.454.CMB.1.raw
  modified_base (210)..(210): a, c, t, g, unknown or other
  misc_feature (210)..(210): n is a, c, g, or t
  modified_base (333)..(333): a, c, t, g, unknown or other
  misc_feature (333)..(333): n is a, c, g, or t
  modified_base (529)..(529): a, c, t, g, unknown or other
  misc_feature (529)..(529): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggnagctcccagggaagggctggaatacattggaagtgtctctcatagtggaggttcctattacagtccgtctctcaagagtcgagtcaccatatctctggacacgtccagcaatcagttttcccngaagatgagttctgtcgaccgccgctgacacgggtctttattactgtgcgagagacggctattatgtattttggagttggttatttcgacaccctagacgtcggacggggctccggaccccgtggggcccgagggtaagtacgtggtacaccgttctccttagcctccaccgaacggcccagtccgtcttccccgnggcccaccctcctccacgagaccc

SEQ ID NO: 140716 - DNA, 542 bp, Homo sapiens
  misc_feature: GYAE6OF02HAEM9.46.67.G01.1.454.CMB.1.raw
  modified_base (373)..(373): a, c, t, g, unknown or other
  misc_feature (373)..(373): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccggcagctcccagggaaggggctggaatacattggaagtgtctctcatagtggaggttcctattacagtccgtctctcaagagtcgagtcaccatatctctggacacgtccagcaatcagttttcccngaagatgagttctgtgaccgccgctgacacgggtcgtttattactgtgcgagagacggctattatgtatttttggagttggttatttcgactaccctagactcggacggggtctcggaccccgtggggccagggaactacgtggtcaccgtctccgttacgcctacccg

SEQ ID NO: 140717 - DNA, 535 bp, Homo sapiens
  misc_feature: GYAE6OF02IBU5K.46.67.G01.1.454.CMB.1.raw
  modified_base (531)..(531): a, c, t, g, unknown or other
  misc_feature (531)..(531): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccgcagctccagggagggctggaatacattggaagtgtctctcatagtggaggttcctattacagtccgtctctcaagagtcgagtcacccatatctctggacacgtccagcaatcagtttttccctgaagatgagttctgtgaccgccgctgacacggcgttttattactgtgcgagagacggctattatgtattttggagttggttatttcgactacccttagatcgacggggctcgacccgtggggccagggatacgtgtcacgtctcctagcctccgaccgacggcccagtccggtcctccccgtgccaccctcctccacgntccg

SEQ ID NO: 140718 - DNA, 554 bp, Homo sapiens
  misc_feature: GYAE6OF02IDM6F.46.67.G01.1.454.CMB.1.raw
  modified_base (337)..(337): a, c, t, g, unknown or other
  misc_feature (337)..(337): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggcctttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcacccatatctctggacacgtccagcaatctagttttcccngaagatgagttctgtgacccgcgctgacacgggtcgttttattactgtgcgagagacggctatatgtattttggagttggtttattcgactaccctagatcgacggggctcgcccctggggccgagggaatacgtcggtcaccgtctccttacgcctccaccgaacggcccagtccgtccttccccgtcggcctaccctccctccacgacgtacccg

SEQ ID NO: 140719 - DNA, 527 bp, Homo sapiens
  misc_feature: GYAE6OF02IM8PZ.46.67.G01.1.454.CMB.1.raw
  modified_base (196)..(196): a, c, t, g, unknown or other
  misc_feature (196)..(196): n is a, c, g, or t
  modified_base (263)..(263): a, c, t, g, unknown or other
  misc_feature (263)..(263): n is a, c, g, or t
  modified_base (365)..(365): a, c, t, g, unknown or other
  misc_feature (365)..(365): n is a, c, g, or t
tcagactagcagtacacgaccggtgctcgatttagagtatacatattgggtttggggtagtctcggtcaggacacagcatggacatgaggtccccgctcagctcctggggctcctgctactctggctccgaggtgccagatgtgacatcgagctgacccagtctccatcctccctgtctgccaaccgtgggagacngtgtcaaccatcacgttgaccggctaagtcggaacattgactacctatttaaagtgtatcaacatanacaggacgcccctaagctacctaatcgtactgcctgcatccgatttagcaaagttcgggcctagtcgaggttcagtggacaggtaggatcgtgggacaagtntttcactctcacagttcaataatctagacacgtgaatatttagcctaattattaactggtacaacgtaaacttagatgtttcgactagacacgactaacaaattaaacgacttagggtactgacaaccatcctagacttcatccttaccgctactctggtac

SEQ ID NO: 140720 - DNA, 502 bp, Homo sapiens
  misc_feature: GYAE6OF02FPXKU.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtgatctgggacagattcactctcaccatcagtatctgcaacgtgaagtattttagctaacttattacttgtacaacagtaattacaattgttttacgacctaaggacacgactaacaaattaaacgaactgtgctgactacatctgtctcatctccgcatctgtac

SEQ ID NO: 140721 - DNA, 508 bp, Homo sapiens
  misc_feature: GYAE6OF02HB7ED.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactattaaatggtatcaacatagaccaggacggcccctaagctctaatctatgctgcatccagtttgcaaagtgggtcccatcgaggtcagtgcagtggatctggacagatttcacgtctcaccatcagtaatctgactaacgtgaagtatttagctaacttattactgtacaacagaattacaattgtttacggacctaagggactacgactaacaaacttaaacgaatgtagactgacgactatctagtcttcatccttccgcctatcagtac

SEQ ID NO: 140722 - DNA, 530 bp, Homo sapiens
  misc_feature: GYAE6OF02H95Q5.46.67.G01.1.454.CMB.1.raw
  modified_base (97)..(97): a, c, t, g, unknown or other
  misc_feature (97)..(97): n is a, c, g, or t
  modified_base (339)..(339): a, c, t, g, unknown or other
  misc_feature (339)..(339): n is a, c, g, or t
  modified_base (350)..(350): a, c, t, g, unknown or other
  misc_feature (350)..(350): n is a, c, g, or t
  modified_base (357)..(357): a, c, t, g, unknown or other
  misc_feature (357)..(357): n is a, c, g, or t
  modified_base (425)..(425): a, c, t, g, unknown or other
  misc_feature (425)..(425): n is a, c, g, or t
tcagactagcagtacacgaccggtgctcgatttagagtatacatattgggtttggggagtctcggtcaggacacagcatggacatgagggtccccgntcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaatgtatcaacatagacaggacggcccctaagctcctaatctatgctgcatccagtttcgctaaagtcgggtccaatcgagtcagtggcagtgatcgnggacagattanattctanacatacgagtaatctagactaaacgtgtaagtatttgactaactttataactgtacaactagaattanattcgtttcgacaaggctaagactaaataaattaaacgaactgtacgacttacgactaacattctagttcctactacgttcctacccggtacacttcgtagtaac

SEQ ID NO: 140723 - DNA, 543 bp, Homo sapiens
  misc_feature: GYAE6OF02JCFWQ.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaatggtatcaacatagaccaggacgcccctaagctctaatctatgctgcatccagtttgcaaagtgggtcccatcgaggttcagtggcagtgatcgtgggacagatttcactctcaccatcagttaatctagcaacgtgaagtattttgactaacttacttaactcgtactaaacagtaattactaattagtttacggacctaaggacaacgtactaactaaacgttaaacgaatagtaggtactagacactaatcgtagttcttactacgttacctcccgtaccgtacttccgtagtaacg

SEQ ID NO: 140724 - DNA, 559 bp, Homo sapiens
  misc_feature: GYAE6OF02H8R32.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtccatcgaggttcagtggcagtgatctgggacagatttcactctcaccatcagtaatctgacaacgtgaagtatttgactaacttattactgttacaactagtaaattacaattgttttaccggaccgtaaggacaacgtaacttaactaaaacgttaaacgaacttagtaggtactaggtaccacctaacttctacgtttacttaccgtacttccgttccccgaccctatttacccgtgtaac

SEQ ID NO: 140725 - DNA, 563 bp, Homo sapiens
  misc_feature: GYAE6OF02I2G76.46.67.G01.1.454.CMB.1.raw
  modified_base (373)..(373): a, c, t, g, unknown or other
  misc_feature (373)..(373): n is a, c, g, or t
  modified_base (379)..(379): a, c, t, g, unknown or other
  misc_feature (379)..(379): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccgcagctccagggaaggggctggaatacattggaagtgtctctcatagtggaggttcctattacagtccgtctctcaagagtcgagtcaccatatctctggacacgtccagcaaatcagttttcccngaaagntgagtttctgtcgaccgccgctgacacgggtctttattactgtgcgagagacggtctattatgtatttttggagttggttatttcgtacacccgttagactcggacggggtctccggaccccgttggggcccgaagggtaacgtacgtacggtccaccggttcctaccgtttacgccctacccg

SEQ ID NO: 140726 - DNA, 552 bp, Homo sapiens
  misc_feature: GYAE6OF02JFECA.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtgatctgggacagatttcactctcaccatcagtaatctgcaacgtgaagtattttgactaacttattactgtaccaactagaattacaattgttttcggacctaagggactaccggaactaacctaaagttaaaccgaaacttgtacggtactcgactaaccaattctcgttctttaccgaactttcccgttaccccgcctaacttcctagtaacg

SEQ ID NO: 140727 - DNA, 512 bp, Homo sapiens
  misc_feature: GYAE6OF02F18GW.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccccctaagctcctaatctatgctgcatccagtttgcaaagtggggtcccatcgaggttcagtggcagtggatctgggacagatttcactctcaccatcagtaatctgcaacgtgaagattttgctaacttattacttgtacaacagaattactaattgttttacgacaagggacacgtactacaaattaaacgtaactagtggctggacaccatctgtcttcatcttcccgctatctgtac

SEQ ID NO: 140728 - DNA, 615 bp, Homo sapiens
  misc_feature: GYAE6OF02G6D5L.46.67.G01.1.454.CMB.1.raw
  modified_base (334)..(334): a, c, t, g, unknown or other
  misc_feature (334)..(334): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgagggaagggctggaatacattggaagtgtctctcatagtggaggttcctattacagtccgtctctcaagagtcgagtcaccatatctctggacacgtccagcaatcagttttcccngaagatgagttctagtcgaccgcgctgacacggtcgtttatactgtgtcgagagacggctattatgtattttggagttggtttattcgactacccgtagagtcggtacggggctaccgtaccccgtggggacccaggggtaactacgttcggtccgtaccgttccttcccgttacgccccttaccgaacccggtaaacgggtcccctaacgttcccggttccccgtttaccccccgtcggtaccctacccccgttccctacccgttaacggccgtaccccg

SEQ ID NO: 140729 - DNA, 505 bp, Homo sapiens
  misc_feature: GYAE6OF02FZX2R.46.67.G01.1.454.CMB.1.raw
  modified_base (479)..(479): a, c, t, g, unknown or other
  misc_feature (479)..(479): n is a, c, g, or t
  modified_base (485)..(485): a, c, t, g, unknown or other
  misc_feature (485)..(485): n is a, c, g, or t
  modified_base (502)..(502): a, c, t, g, unknown or other
  misc_feature (502)..(502): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaagtgggtccatcgaggttcagtgcagtgatctgggacagattcactctcacatcagtaatctgcaagtgaagtattttagactaacttattacttgtacaacagaattactaatgtttcgacctaaggacacgactaactaaattaaacgaactgtagctgacacctatctntcttanactcctccgctactctntac

SEQ ID NO: 140730 - DNA, 521 bp, Homo sapiens
  misc_feature: GYAE6OF02JIC4D.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatgtatcaacatagaccagggacggcccctaagctcctaatctatgctgcatccagtttgcaaagtgggtcccatcgaggttcagtgcagtgatctgggacagatttcactctcaccatcagtaatctgcaacgtgaagtattttgctaaacttattactgtactaacagtaaatttaacaattcgttttacggacctaagggacacgtaactacgaaattaaacgaactgtagactgactacacttctgtacttcattccttcccgctatcctgtac

SEQ ID NO: 140731 - DNA, 531 bp, Homo sapiens
  misc_feature: GYAE6OF02G889O.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacacctatttaaattggtatcaacatagaccagggacggcccctaagctcctaatctatgctgcatccagtttgacaaagtgggtcccatcgaggttcagtggcagtgatcgtgggacagtatttcactctcacctatcagtaactctagctaacgtgaagtattttagactaacttattactgtacaacagtaattacaattgtttcggacctaagggacacgtaactaactaaattaaacgaactgtcgactgactacatctagtccttactactccttacccgactacgtctagtac

SEQ ID NO: 140732 - DNA, 560 bp, Homo sapiens
  misc_feature: GYAE6OF02FL2WN.46.67.G01.1.454.CMB.1.raw
  modified_base (289)..(289): a, c, t, g, unknown or other
  misc_feature (289)..(289): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccaggggaaggggctggaatacattggaagtgtctctcatagtggaggttcctattacagtccgtctctcaagngtcgagtcaccatatctctggacacgtccagcaaatcagttttcccctgaacgatgagttctgtcgaccgccgctgacacgggtctttattactgtgcgagagacggctattatgtatttttgggagttggttatttcgactacccttagatcggacggggctcggacccgtggggccaggggaactacgtggtcaccgtctccttagccctccaccgaacggcccagtccggtccttcccccgtggcccaccctcctaccacgacgtccg

SEQ ID NO: 140733 - DNA, 576 bp, Homo sapiens
  misc_feature: GYAE6OF02J0N50.46.67.G01.1.454.CMB.1.raw
  modified_base (333)..(333): a, c, t, g, unknown or other
  misc_feature (333)..(333): n is a, c, g, or t
  modified_base (362)..(362): a, c, t, g, unknown or other
  misc_feature (362)..(362): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaagggctggaatacattggaagtgtctctcatagtggaggttcctattacagtccgtctctcaagagtcgagtcaccatatctctggacacgtccagcaatcagttttcccngaagatgagttctgtgaccgccgctgacncgggtctttattactgtgcgagagacggctattatgtattttggagttggttattcgactaccctagatcgacggggtctcgacccgtgggccgagggaactacgttcggtcctaccgtcttccgttacgtccctaccacccgaacggcccctaagtcccggttccgttcccccgtcggtccctaccccgttcctacccgtaacgccgtacccg

SEQ ID NO: 140734 - DNA, 614 bp, Homo sapiens
  misc_feature: GYAE6OF02JZZGC.46.67.G01.1.454.CMB.1.raw
  modified_base (218)..(218): a, c, t, g, unknown or other
  misc_feature (218)..(218): n is a, c, g, or t
  modified_base (608)..(608): a, c, t, g, unknown or other
  misc_feature (608)..(608): n is a, c, g, or t
tcagactagcagtacacgaccggtgctcgatttagagtatacatattgggtttggggtagtctcggtcaggacacagcatggacatgagggtccccgctcagctcctggggctcctgctactctggctcgaggtgccagatgtgacatcgagctgacccagtctccatcctccctgtctgcaaccgtgggagacagtgtcaccatcacttgcccgggnaagtcggaacattgacacctattaaattggtatcaacatagacaggacggcccctaagctcctaatctaatgctgcatccagtttgactaaagtcggggtaccctagtccgtaagggttctaaggtggaccgtaggtggaatcggtagggacgaaggtatttcgactcttacacctattcaagttaactctagcgtaacgtgtaaaggtattttagacctaatttaattcgttaacgttacaaactaacgtaaattaccgtaaatttggtttaccggaactaacgggtactaacggtaactaaacctaaagtttaaacgaacgttagtaggactacggacaactaagttctagttccttacgtacttccgttacccgtccaagtttaccnttaacg

SEQ ID NO: 140735 - DNA, 518 bp, Homo sapiens
  misc_feature: GYAE6OF02HJPVQ.46.67.G01.1.454.CMB.1.raw
  modified_base (407)..(407): a, c, t, g, unknown or other
  misc_feature (407)..(407): n is a, c, g, or t
  modified_base (495)..(495): a, c, t, g, unknown or other
  misc_feature (495)..(495): n is a, c, g, or t
  modified_base (507)..(507): a, c, t, g, unknown or other
  misc_feature (507)..(507): n is a, c, g, or t
  modified_base (515)..(515): a, c, t, g, unknown or other
  misc_feature (515)..(515): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgcccctaagctcctaatctatgctgcatccagtttgcaaagtgggtcccatcgaggttcagtggcagtggatctgggacagatttcactctcaccatcagtaatctgcaacgtgaatattttagactaacttatacttntacaacagtaattacaattgtttcggacctaagggacacgtactaactaaattaaacgaactgtagctagacctaccatctgttcttnacttccgtcccnctactctntac

SEQ ID NO: 140736 - DNA, 509 bp, Homo sapiens
  misc_feature: GYAE6OF02HMOH8.46.67.G01.1.454.CMB.1.raw
  modified_base (360)..(360): a, c, t, g, unknown or other
  misc_feature (360)..(360): n is a, c, g, or t
  modified_base (506)..(506): a, c, t, g, unknown or other
  misc_feature (506)..(506): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaaattggtatcaacatagaccagggacggcccctaagctcctaatctatgctgcatccagtttgcaaagtgggtcccatcgaggttcagtggcagtgatctgggacagatttcactcncacatcagtatctgacaacgtgaagtattttgactaacttattactgtacaacagtaattacaattgtttacgaccaagggacacgactaacaaattaaacgaactgtagactgacacatctgtcttctactcctccgacactctntac

SEQ ID NO: 140737 - DNA, 528 bp, Homo sapiens
  misc_feature: GYAE6OF02G1UUG.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgcccctaagctcctaatctatgctgcatccagtttgcaaagtgggtcccatcgaggttcagtggcagtggatctgggacagatttcactctcaccatcagtaatctagctaacgtgaagtattttgactaacttattacttgtacaaacagtaatttacaattgttttacggaccgtaagggacaacgtaactaactaaaattaaacgaaactagtgactgacactatctgttcttcacttcttcccgcctattctatac

SEQ ID NO: 140738 - DNA, 585 bp, Homo sapiens
  misc_feature: GYAE6OF02HT049.46.67.G01.1.454.CMB.1.raw
  modified_base (216)..(216): a, c, t, g, unknown or other
  misc_feature (216)..(216): n is a, c, g, or t
tcagactagcagtacacgaccggtgctcgatttagagtatacatattgggtttggggagtctcggtcaggacacagcatggacatgaggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacacctatttaaattggtatcaacatagaccagggacgcccctaagctcctaatctatgctgcatccagtttgcaaagtcgggtcccatcgaggttcagtggcagtggatctgggacagtatttcactctacaccatcaagtaatctgactaacgtagaagtatttagactaacttattactgtacaacagtaaattactaattgttttacggaccgtaagggaacaacgtaacttaactaaaacgttaaaaccgaaacgttacgtaggtacttacgtaccgtaaccctacttaccgttacgttacctttaccgtacttcccgtttaccccgtaccctaacttccgtagtaaccg

SEQ ID NO: 140739 - DNA, 533 bp, Homo sapiens
  misc_feature: GYAE6OF02GACJT.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatcgtgggacaggatttcacttctcaccatcagtaatctgcaacgtgaagtattttagctaacttattactgtacaacagaattacaattgttttcggacctaagggacaacgaactaacaaaacttaaacgaactgtagactagacgaacctatccgtagtacttctacttccttacccgcacttctagtac

SEQ ID NO: 140740 - DNA, 515 bp, Homo sapiens
  misc_feature: GYAE6OF02GAD10.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccaggacggcccctaagctcctaatctatgctgcatccagtttgcaaagtggggtcccatcgaggttcagtggcagtggatcgtgggacaggatttcactctcaccatcagtaatctgcaacgtgaagtatttgctaacttattactgtacaacagaattacaattgttttcgacaagggtacacgtaactacaaattaaacgaactagtgctgacacatctgttcttactactccttcccgcacttcctagtac

SEQ ID NO: 140741 - DNA, 513 bp, Homo sapiens
  misc_feature: GYAE6OF02IBJK7.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgcccctaagctctaatctatgctgcatccagtttgcaaagtgggtcccagtcgaggttcagtggcagtggatcgtgggacagatttcactctcaccatcagtaatctgacaacgtgaagtattttgactaacttattactgtacaacagtaattacaattgtttcgactaaggacaacgactaactaaattaaacgaactgtgctgacgaaccatctgttcttcacttctcccgcacttctgtac

SEQ ID NO: 140742 - DNA, 569 bp, Homo sapiens
  misc_feature: GYAE6OF02IBDCO.46.67.G01.1.454.CMB.1.raw
  modified_base (563)..(563): a, c, t, g, unknown or other
  misc_feature (563)..(563): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaatggtatcaacatagaccagggacgcccctaagctacctaatctatgctgcatcctagtttgcgtaaaggtgggtacccagtcgaggttcagtggcagtggatcgtggacagtatttcacttctacaccatcagtaatctagacaacgtgaagtatttgactaacttattactgtacaaactataattactaatttcgtttacggaacctaagggaacaacgtaacttaaactaaaacgttaaacgtaacgttagtacggtactacgactaccacttactcgttacctttactacttccgttccccgtacctacttacctntaaccg

SEQ ID NO: 140743 - DNA, 529 bp, Homo sapiens
  misc_feature: GYAE6OF02H0R2C.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaatggtatcaacatagaccagggacgcccctaagctcctaatctatgctgcatccagtttgcaaagtgggtcccatcgaggttcagtggcagtggatcgtgggacagatttcactctcaccatcagtaatctagcaacgtgaagtatttgactaacttattacttgtacaacagtaattacaattgttttacggacctaagggacacgacttaacaaattaaacgaactgtagctgtacaaccattctacgttcttacgtacttccttacccgcctacttcctgtaac

SEQ ID NO: 140744 - DNA, 498 bp, Homo sapiens
  misc_feature: GYAE6OF02GHCKL.46.67.G01.1.454.CMB.1.raw
  modified_base (481)..(481): a, c, t, g, unknown or other
  misc_feature (481)..(481): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatctgggacagatttcactctcacatcagtaatctgcaacgtgaagattttgcaacttattactgtcaacagtaattacaattgtttcggccaagggacacgactaacaaattaaacgaactgtgctgcacatctgtcttnatcttccgcatctgtac

SEQ ID NO: 140745 - DNA, 632 bp, Homo sapiens
  misc_feature: GYAE6OF02I3D6B.46.67.G01.1.454.CMB.1.raw
  modified_base (203)..(203): a, c, t, g, unknown or other
  misc_feature (203)..(203): n is a, c, g, or t
  modified_base (235)..(235): a, c, t, g, unknown or other
  misc_feature (235)..(235): n is a, c, g, or t
  modified_base (246)..(246): a, c, t, g, unknown or other
  misc_feature (246)..(246): n is a, c, g, or t
tcagactagcagtacacgaccggtgctcgatttagagtatacatattgggtttggggagtacgtccggtacaggaccacaggcatcggacatgaggtcccgctcagctcctggggctcctgctactctggtctccggaggtgccagatgtgacatccgagcctgacccagtctccatccgtccctggtctgcaaccgtggganacagtgtccaccgattcacgttggaccgggtnaagtccggaanttgacacctatttaaatgtatctaacatagacagggacgtccctaagctactaatcctatgctgctagtcctaggttgcgaaagtgggtaccccagtaccgaaggttaccaggtgctaaggtggaattccgtagggacgtaggatttacaacgttctacaacctaagtccgaagtaactctacgaccaacggtagaacgtattttcgaactaacttatactgtactaacagtaactacaattcggtttacgaccgtaaggaccgtacgtaaccgttaataaacgttaaacgaacgtaggtacgtacgttagtaccgtaaccgtataccggttacgttccgttacgtaaccttccgttaacccgtcgtaactttccggtagtaaccg

SEQ ID NO: 140746 - DNA, 511 bp, Homo sapiens
  misc_feature: GYAE6OF02FO7SK.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgagttcagtggcagtggatctgggacagattcactctcaccatcagtaatctgcaacgtgaagtatttgactaacttattactagtacaacagtaattacaattgtttacggacaaggtacacgactaacaaattaaacgaactagtagactgactacattctgttcttcactcttcccgctatctgtac

SEQ ID NO: 140747 - DNA, 528 bp, Homo sapiens
  misc_feature: GYAE6OF02HOXWD.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctcctaatctatgctgcatccagtttgcaaagtgggtcccatcgaggttcagtggcagtggatctgggacagatttcactctcaccatcagtaatctgcaacgtgaagtattttagctaaacttattacttagtcaaactagaattactaattgttttacggacctaagggacaacgtactaacaaattaaacgaactagtgactagaccaacactctgtcttcacttccttaccgcctacttctagtaac

SEQ ID NO: 140748 - DNA, 512 bp, Homo sapiens
  misc_feature: GYAE6OF02GC9RP.46.67.G01.1.454.CMB.1.raw
  modified_base (417)..(417): a, c, t, g, unknown or other
  misc_feature (417)..(417): n is a, c, g, or t
  modified_base (486)..(486): a, c, t, g, unknown or other
  misc_feature (486)..(486): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaattggtatcaacatagaccaggacggcccctaagctcctaatctatgctgcatccagtttgactaaagtgggtcccagtcgaggttcagtgcagtggatcgtgggacagattcactctcaccatcagttaatctgactaacgtgaagttattttagtaacttattactgtacaanagtaattacaattgtttcgacaagggacacgactaacaaattaaacgaacttgtagctgctacgatctntcttcatccttccgcatctatatacg

SEQ ID NO: 140749 - DNA, 554 bp, Homo sapiens
  misc_feature: GYAE6OF02GGODC.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgcccctaagctcctaatctatgctgcatccagtttgacaaagtggggtcccatcgaggttcagtggcagtggatcgtgggacagatttcactctcacatcagtaatctgcaacgtgaagtatttagtaacttatactgtacaactagtaattactaattcgttttacggacctaagggacaacgtaactaactaaaagttaaacgaaacttggtagaccgtagacctaccgtattacctacgttacttactacgttccttcccgtacctactactacgtacttacg

SEQ ID NO: 140750 - DNA, 515 bp, Homo sapiens
  misc_feature: GYAE6OF02FS56E.46.67.G01.1.454.CMB.1.raw
  modified_base (505)..(505): a, c, t, g, unknown or other
  misc_feature (505)..(505): n is a, c, g, or t
  modified_base (512)..(512): a, c, t, g, unknown or other
  misc_feature (512)..(512): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccagtcgaggttcagtggcagtggatctgggacagatttcactctcaccatcagtaatctgcaacgtgaagtattttgactaacttattactgtacaacagtaattacaattgtttacgaccgtaagggacaacgacttaacaaattaaacgaactagtgactgactacatctgtcttcatcttcccncactctntac

SEQ ID NO: 140751 - DNA, 551 bp, Homo sapiens
  misc_feature: GYAE6OF02H9D3A.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaattggtatcaacatagaccagggacgccctaagctcctaatctatgctgcatccagtttgcaaagtggggtcccatcgaggttcagtggcagtggatcgtgggacagatttcactctcaccatcagtaatctgacaacgtagtaagtatttagactaactttattaacttgtacaaacagtaaattactaattgttttacggaccgtaagggaacaacgtaactaaactaaaacttaaacgaactagtagactacgacaaccattacgtcgttacttacgtacttccttacccgacctacttctagtac

SEQ ID NO: 140752 - DNA, 510 bp, Homo sapiens
  misc_feature: GYAE6OF02JEITA.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatcgtgggacagatttcacgtctcaccatcagtaatctgcaacgtgaagtatttgctaacttattactgtcaacagaattactaatgtttacggctaaggacacgactaacaaattaaacgaactgtagctgcacatctcgtcttcacttccttccgcctactctgtaac

SEQ ID NO: 140753 - DNA, 549 bp, Homo sapiens
  misc_feature: GYAE6OF02H0G3L.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtccccatcgaggttcagtggcagtggatcgtggggacagatttcactctcaccatcagtaatctgcaacgtgaagtatttgctaacttattactgtcaaactagtaatactaattgttttacggaccgtaagggactaacgaacttaaacaaaattaaacgaacttagtaggtactgaccaaccgtattcgtgttaccgttactacttccgttacccgaccctaattctgtaac

SEQ ID NO: 140754 - DNA, 578 bp, Homo sapiens
  misc_feature: GYAE6OF02IWWRO.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacgcccctaagctcctaatctatgctgcatccagtttgcaagtgggtccatcgagttcagtgcagtgatcgtgggacagatttcactctcacatcagtatctgctacgtgagtatttgctaacttattactagtacaactagtaacttactaattgttttacggaccgtaaacgggtactaacggtaaccttaaactaaaatttaaaaccgtaaactacggttaggtacgtacgtaccaacctaacttacctacggttacctttaccgtaactttcccgtttaccccgtaccctaacttccgttacgtaaccg

SEQ ID NO: 140755 - DNA, 560 bp, Homo sapiens
  misc_feature: GYAE6OF02GL5WP.46.67.G01.1.454.CMB.1.raw
  modified_base (331)..(331): a, c, t, g, unknown or other
  misc_feature (331)..(331): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggagggctggaatacattggaagtgtctctcatagtggaggttcctattacagtccgtctctcaagagtcgagtcaccatatctctggacacgtcagcaatcagttttcccngaagatgagttctgtgaccgccgctgacacgggtcgtttattactgtgcgagagacggctattactgtatttttggagttggttatttcgactacccgttagatcggacggggtctcgacccgtggggcccaggggaactacgtggtctaccgtctccgttagcctccgaccgaacgggcccacgtccgtccttccccgtggccctacccgtcctccgacgagtacccg

SEQ ID NO: 140756 - DNA, 503 bp, Homo sapiens
  misc_feature: GYAE6OF02FKHHR.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagattttgctaacttattactgtcaacagaattacaattgtttacggccaagggacacgactaacaaattaaacgaactgtgctgcacatctgtcttcatcttcccgacactctgtac

SEQ ID NO: 140757 - DNA, 560 bp, Homo sapiens
  misc_feature: GYAE6OF02IAP0J.46.67.G01.1.454.CMB.1.raw
  modified_base (555)..(555): a, c, t, g, unknown or other
  misc_feature (555)..(555): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggccttcggagaccctgtccctcaccgtgcgctgtctctggtgcctccatcagtagtggtttcttctggggctgggtccggcagctcccagggaaggggctgggaatacattggaagtgtctctcatagtggaggttcctattacagtccgtctctcaagagtcgagtcacccatatctctggacacgtccagcaatcagttttcccctgaagatgagttctgtgaccgccgctgacacgggcgtttattactgtgcgagagacggctattatgtattttggagtggttatttcgactacccttagatcgacggggctcgaccccgtggggcccaggggaatactaggtcaccgtcctccttagccctcctaccaacgggcccaatccggttcttccccctggtccaccccgtcctccctaacgngtccc

SEQ ID NO: 140758 - DNA, 557 bp, Homo sapiens
  misc_feature: GYAE6OF02H0YUG.46.67.G01.1.454.CMB.1.raw
  modified_base (332)..(332): a, c, t, g, unknown or other
  misc_feature (332)..(332): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctccagggaggggctggaatacattggaagtgtctctcatagtggaggttcctattacagtccgtctctcaagagtcgagtcaccatatctctggacacgtccagcaatcagttttcccngaagatgagttctgtgaccgcgctgactacgggcttttattactgtgcgtagagacggctattatgtatttttggagtggttatttcgactaccctagtatcgacggggctcgaccccgtggggcccaggggaactacgtggtcaccggtctccttacgcccttccaccgaacgggccctagtccgtccttccccgtggcccaccctccctaccacgacgtaccc

SEQ ID NO: 140759 - DNA, 563 bp, Homo sapiens
  misc_feature: GYAE6OF02GGBHX.46.67.G01.1.454.CMB.1.raw
  modified_base (334)..(334): a, c, t, g, unknown or other
  misc_feature (334)..(334): n is a, c, g, or t
  modified_base (347)..(347): a, c, t, g, unknown or other
  misc_feature (347)..(347): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctaacctgcgctgtctctggtgcctccatcagtagtggtttcttctggggctgggtccggcagctcccagggaaggggctggaatacattgggaagtgtctctcatagtggaggttcctattacagtccgtctctcaagagtcgagtcaccatatctctggacacgtccagcaatcagttttccngaagatgagttcngtcgaccgccgctgacgacgggtcgttttaattactgtgcgagagacggctattatgtattttggagttggttatttcgactacctagatcggacggggctccgacccgtgggcctagggaatacgtggtccaccgtctccgttacgcctaccaccgtaacggccctagtccggtcccttccccgtggcccaccctcctaccacgtacgctacccg

SEQ ID NO: 140760 - DNA, 590 bp, Homo sapiens
  misc_feature: GYAE6OF02IDEQJ.46.67.G01.1.454.CMB.1.raw
  modified_base (285)..(285): a, c, t, g, unknown or other
  misc_feature (285)..(285): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgcaccatcacttgccggcaagtcggaaccattgacactatttaaattggtatcaacatagaccaggacgccctaagctctaatctatnctgcatccagtttgacaaagtgggtacccatacggtaggttcagtggcagtgatcgtaggacagtacgtttcactctacaccatcagtaactctacggactaacgtgaacgtattttacgactaactttattacttagtacaactacgtaattacaatttagtttaccggactaaacgggtacaaccggtactaactaaaacgttaaactaaccgttagtacggtacttggaaccctactaacgttccttaaggttaccttacttacgttcccgttaccccgttccctaacttccgtagttaacc

SEQ ID NO: 140761 - DNA, 558 bp, Homo sapiens
  misc_feature: GYAE6OF02GIM94.46.67.G01.1.454.CMB.1.raw
  modified_base (334)..(334): a, c, t, g, unknown or other
  misc_feature (334)..(334): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccaggggaagggctggaatacattggaagtgtctctcatagtggaggttcctattacagtccgtctctcaagagtcgagtcaccatatctctggacacgtccagcaatcagttttcccngaagatgagttctgtgaccgccgctgacacgggtctttattactgtgcgagagacggctattatgtattttggagttgttattcgactacccgtagatcgacggggctccgacccgtgggaccagggaagtactggtcaccgtctccttacgcctccgacgaacgggccctagtccggttccttccccgtcggcctaccccgtccctaccgaacgacgtacccg

SEQ ID NO: 140762 - DNA, 574 bp, Homo sapiens
  misc_feature: GYAE6OF02GSV9G.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatcgtgggacagatttcactctcaccatcagtaatctagcaacgtgaagtattttgactaactttattaacttgtacaacagtaaattacaattgtttaccggacctaaagggacaacggaacttaactaaaattaaacgaacttagtacggtacttaggacctaacctaacgttcttacggttacctttactaactttccctttaccccggtccctaactttccgtagtaaccg

SEQ ID NO: 140763 - DNA, 553 bp, Homo sapiens
  misc_feature: GYAE6OF02G2O0Q.46.67.G01.1.454.CMB.1.raw
  modified_base (334)..(334): a, c, t, g, unknown or other
  misc_feature (334)..(334): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttcccngaagatgagttctgtgaccgcgctgacacgggcgttttattactgtgcgagagacggctattatgtatttttggagttggttatttcgactaccctagatcgacggggtctcgacccgtggggccagggaatacgtgtccaccgtctccttacgcctccaccgaacgggcccagtccggtccttcccccgtggccacccctcctcccaacgcgtacccg

SEQ ID NO: 140764 - DNA, 560 bp, Homo sapiens
  misc_feature: GYAE6OF02IZLCR.46.67.G01.1.454.CMB.1.raw
  modified_base (331)..(331): a, c, t, g, unknown or other
  misc_feature (331)..(331): n is a, c, g, or t
  modified_base (335)..(335): a, c, t, g, unknown or other
  misc_feature (335)..(335): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtgggctgggtccggcagctccagggagggctggaatacattggaagtgtctctcatagtggaggttcctattacagtccgtctctcaagagtcgagtcaccatatctctggacacgtccagcaatcagttttcccngaanatgagttctgtgaccgcgctgacacgggtctttatactgtgcgagagacggctattatgtatttttggagttggttatttcgactaccctagagtcggaccggggtctccgacccgtgggccgagggtaactacgtcggtccaccgttctccgttagccctccgaccgacggccctagtccggtcccttccccgtcgccctaccctcctacccgagtaccgcccg

SEQ ID NO: 140765 - DNA, 524 bp, Homo sapiens
  misc_feature: GYAE6OF02I6XPD.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgcccctaagctcctaatctatgctgcatccagtttgcaaagtggggtcccagtcgaggttcagtggcagtggatctgggacagtatttcactctcaccatcagtaatctgacaacgtgaagtattttgactaacttattactgtacaactagtaattacaattcgtttacgacctaagggacacgtaactaacaaagttaaacgaactgtagctagcaccatctagtcttcgtactccttcccgctacttctgtac

SEQ ID NO: 140766 - DNA, 576 bp, Homo sapiens
  misc_feature: GYAE6OF02HJPB2.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaattggtatcaacatggaccagggacggcccctaagctcctaatctatgctgcatccagtttgcaaagtgggtcccagtcgaggttcagtggcagtggatcgtgggacagtactttcactctcaccatcagtatctgacaacgtgaagtatttgactaacttattactagtacaactaagtaaattactaatttgttttaccggaccgaagggacctaacgtaaccttaaactaaaagttaaacgaacgttaggtacgacttagacctaacctaacttcgttacgttcctttacctacttacccgttacccgtacctaaccttcgttacgtaacg

SEQ ID NO: 140767 - DNA, 501 bp, Homo sapiens
  misc_feature: GYAE6OF02HOC7E.46.67.G01.1.454.CMB.1.raw
  modified_base (484)..(484): a, c, t, g, unknown or other
  misc_feature (484)..(484): n is a, c, g, or t
  modified_base (491)..(491): a, c, t, g, unknown or other
  misc_feature (491)..(491): n is a, c, g, or t
  modified_base (498)..(498): a, c, t, g, unknown or other
  misc_feature (498)..(498): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaaagctcctaatctatgctgcatccagtttgcaaagtgggtcccatcgaggttcagtggcagtggatctgggacagatttcactctcaccatcagtaatctgcaacgtgaagtattttagctaacttatacttgtacaactagaattacaattgtttcggacaagggacacgactacaaattaaacgaatgtgctgcacatctgtcttnatctccncactctntac

SEQ ID NO: 140768 - DNA, 516 bp, Homo sapiens
  misc_feature: GYAE6OF02I0WF8.46.67.G01.1.454.CMB.1.raw
tcagactagcagtacacgaccggtgctcgatttagagtatacatattgggtttgggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgagttcagtggcagtggatctgggacagatttcactctcaccatcagtaatctgcaacgtgaagattttgcaacttattactgtcaacagaattactaactgttttcggcctaacgggacacgaactacaaattaaacgaaactagtggctagctaaccatctgtcttcgacttcttccccgtccactcttgtaac

SEQ ID NO: 140769 - DNA, 548 bp, Homo sapiens
  misc_feature: GYAE6OF02IJHQY.46.67.G01.1.454.CMB.1.raw
  modified_base (218)..(218): a, c, t, g, unknown or other
  misc_feature (218)..(218): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacacctatttaaattggtatcaacatagaccagggacggcccctaagctcctaatctatgctgcatccagtttgcaaaggtgggtcccatcgaggttcagtggcagtggatcgtgggacagtattcactctacaccatcagtaatctgcaacgtgaagtattttgactaacttattacttagtacaactaagtaattaacaattgtttaccggacgtaagggacaacgtaactaactaaaacttaaacgaacgttgtagactacgacaacctattctagttccttactactcctttcccgacctactctagtaacg

SEQ ID NO: 140770 - DNA, 512 bp, Homo sapiens
  misc_feature: GYAE6OF02G7LFK.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatctgggacagatttcactctcaccatcagtaatctgcaacgtgaagtattttagtaacttattacttgtcaacagtaattactaattgttttacgacctaagggacaacgactaactaaattaaaccgaactgtgactgacaccatctgtctcatcttcccgctatctgatc

SEQ ID NO: 140771 - DNA, 527 bp, Homo sapiens
  misc_feature: GYAE6OF02FX074.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctcctaatctatgctgcatccagtttgcaaagtggggtcccatcgaggttcagtggcagtggatctgggacagattcactctcaccatcagtaatctgacaacgtgaagtattttgactaacttattacttgtacaacaagtaattactaattgttttaccgggacctaagggacaacgtactaactaaattaaacgatagtgctgacaccattactgttccttacacttcctcccgctacttctgtaac

SEQ ID NO: 140772 - DNA, 575 bp, Homo sapiens
  misc_feature: GYAE6OF02HHWF6.46.67.G01.1.454.CMB.1.raw
  modified_base (334)..(334): a, c, t, g, unknown or other
  misc_feature (334)..(334): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctccgagggaggggctggaatacattggaagtgtctctcatagtggaggttcctattacagtccgtctctcaagagtcgagtcaccatatctctggacacgtccagcaatctagttttcccngaagtatgtagttctgtgaccgccgctgacacgggtctttattactgtgcgagagacgcttattatgtattttggagttggttatttcgactaccctagactcggacggggctccggacccgtcggggaccgaggggaactacgtcggtccgaccgtcttccttacgtccctcccaccgaacggccctagtccggttcccttccccgtcggccctaccccgtccctaccacgacgtacccg

SEQ ID NO: 140773 - DNA, 535 bp, Homo sapiens
  misc_feature: GYAE6OF02F2Z8H.46.67.G01.1.454.CMB.1.raw
  modified_base (532)..(532): a, c, t, g, unknown or other
  misc_feature (532)..(532): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattgtatcaacatagaccagggacggcccctaagctcctaatctatgctgcatccagtttgcaaagtgggtcccatcgaggttcagtggcagtggatcgtgggacagtattcactctcacatcagtatctgacaacgtgaagtattttgactaacttattacttgtacaactaagtaattaactaattgttttacggaccgtaagggacaacgtaacttaacaaaacttaaacgaactagtacgctagactactattctgttacttctacttccgttcccgctactctntac

SEQ ID NO: 140774 - DNA, 536 bp, Homo sapiens
  misc_feature: GYAE6OF02HSML1.46.67.G01.1.454.CMB.1.raw
  modified_base (375)..(375): a, c, t, g, unknown or other
  misc_feature (375)..(375): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtgtttcttctggggctgggtccggcagctccgagggaaggggctggaatacattggaagtgtctctcatagtggaggttcctattacagtccgtctctcaagagtcgagtcaccatatctctggacacgtcagcaatcagttttcccaganatgtagttctgtgaccgcgctgacgcgggctttattactgtgcgagagacgtctattatgtatttttggagttgttatttcgactacctagagtcggacggggtctccggacccgtgggccaagggactacgtcggtcaccgtcctcttacgccctacccg

SEQ ID NO: 140775 - DNA, 743 bp, Homo sapiens
  misc_feature: GYAE6OF02JKRUD.46.67.G01.1.454.CMB.1.raw
tcagactagcagtacacgaccggtgctcgatttagagtatacatattggggtttcgggggaccgtcctgtgcaagaacatgaagcacctcgtggtttgtcctcctggcctgggtggcaggctcccagactcgggtcctgtccctgggtgcaactcgacaggagggtcgggtccacgactggtcgacggtccgttcggagaccctgtccctcaccgtgcgcctgtcctctggtcgtcctcatacagttacgtcggtttctcggtcgggctcgggtccgcacgtcgtccgacgggaagggctcggaactactacgttacggagttcgtacgtctactagtacgtggggtacggtttccctaagttaccgaggttccggtacttccgtacgaacgtacggtaccgtagttccaaccgtacttaacgtccttactacgggtaacctaccggttaccgaaggtacctaaaggttccgttaaacgggtttttccccgtaaggttaaacggtacgtttacgggtacggttttccgtacgggttaccggtaaccggtcccgtaccgtacggtaaccgtacgggtacgttacgtacgtcgtacgtcgagtacgacgtctagttcgtcgtacgtttcggagttcggttacttcgactaccgtagtacgtcggacgggtcgtccggaccggtgggaccgtagggtaacttacggtcggtaccgtaccgttactcccggttacgcccgtaacccg

SEQ ID NO: 140776 - DNA, 551 bp, Homo sapiens
  misc_feature: GYAE6OF02H539J.46.67.G01.1.454.CMB.1.raw
  modified_base (211)..(211): a, c, t, g, unknown or other
  misc_feature (211)..(211): n is a, c, g, or t
  modified_base (248)..(248): a, c, t, g, unknown or other
  misc_feature (248)..(248): n is a, c, g, or t
  modified_base (375)..(375): a, c, t, g, unknown or other
  misc_feature (375)..(375): n is a, c, g, or t
  modified_base (388)..(388): a, c, t, g, unknown or other
  misc_feature (388)..(388): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctcatcagtagtggtttctgtggggctggggtccgnagtctccgagggaaggggctggaatacattggaagtgtctctcatagtggaggttcctattacagtccgtctctcaagagtcgagtcaccatatctctggacacgtccagcaaatcaagttttcccngaagatgagttcngtgaccgcgctgacacgggcgtttattactgttgacgagagacggcaattatgtaattttggaagttcggttaagttttcgaacgtaccctaagatcggacggggtctcggaccccgtggggccaagggaactagtcggtacaccgtctcttacgcctacccg

SEQ ID NO: 140777 - DNA, 806 bp, Homo sapiens
  misc_feature: GYAE6OF02H1TSY.46.67.G01.1.454.CMB.1.raw
tcagactagcagtacacgaccggtgctcgatttagagtatacatattggggttggggaagtctcggtcaggtacgaccagcgaactggacgaatccgagggtccccgctcagtctcctcggggtctcctcgctactcgtcggcctacgaggttcgaccaggatagtgttacgagtcgagtctcgaccacgtcctccactcctccgtgtcctggacgaacggtgggacgacctagtcgtcgaccagtcacgttcggaccggggactaacggtacggaacagttacgaacttaccgtactttaaagttacggtaatacgaaacgtacgttacggaccgaggggtaccgaccccgtaagcctacctaatactaatcgtactacgcctactcccgtaggtttcgaccgtaaaacggggttccgggttaccccaaggttccggtaacgggtttccgaagggttcggggaccggtaggggttcggtaacggtacggttaggggtaacccggttactttaccgtaccgttacctacctaacctacgtacgtaacgttaacgtccgtaggaccgtaaacggttcgaaaggttaacgttttcgacgtaaactttagttttaactcgttacgtaaactagtaacttaactaattcgttttaccggaccgtaacgggtaccctaaccggtaacgttaaccgttaaacgttaacccggaaagttcggttacggaccgttacgtaacctaaccgtacgttaccgttacggtacctttacgaccttccgtacccgtctaacgttcttacgtacttacccg

SEQ ID NO: 140778 - DNA, 549 bp, Homo sapiens
  misc_feature: GYAE6OF02F8QFB.46.67.G01.1.454.CMB.1.raw
  modified_base (211)..(211): a, c, t, g, unknown or other
  misc_feature (211)..(211): n is a, c, g, or t
  modified_base (372)..(372): a, c, t, g, unknown or other
  misc_feature (372)..(372): n is a, c, g, or t
  modified_base (429)..(429): a, c, t, g, unknown or other
  misc_feature (429)..(429): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttctctggggctgggtccgcagctcccagggaaggggctggaatacattggaagtgtctctcatagtggaggttcctattacagtccgtctctcaagagtcgagtcaccatatctctggacacgtccagcaatcagttttcccngaagatgagttctgtgaccgcgctgacgacgggtctttattactgtgcgagagacgntattatgtattttggagttggttatttcgactacctagatcggacggggtctccggacccgtggggacccgagggtaactacgttcggtcctacccggttctcccgttacgccctacccg

SEQ ID NO: 140779 - DNA, 537 bp, Homo sapiens
  misc_feature: GYAE6OF02GPWJL.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatcgtgggacagatttcactctcacatcagtatctgcaagtgaagtatttgactaacttattacttgtacaactagtaattacaattcgtttacggacctaagggacctaacgaacttaacaaattaaaccgaattaggtagctagacctaacctattcctagttccttacacttccttcccgcctattcctgtaac

SEQ ID NO: 140780 - DNA, 504 bp, Homo sapiens
  misc_feature: GYAE6OF02FHB54.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctcctaatctatgctgcatccagtttgcaaagtggggtcccatcgaggttcagtggcagtggatctgggacagtattcactctcaccatcagtaatctgcaacgtgaagattttgactaacttattactgtacaacagaattacattgtttcggcaagggacacgactaacaaattaaacgaactgtaggctgcaaccatctgtcttcactcttcccgcatctgtac

SEQ ID NO: 140781 - DNA, 605 bp, Homo sapiens
  misc_feature: GYAE6OF02HBBZT.46.67.G01.1.454.CMB.1.raw
tcagactagcagtacacgaccggtgctcgatttagagtatacatattgggtttggggagtctcggtcaggacacagcattggacatgagggtccccgctcagctcctggggctcctgctactctggctccgaggtgccagatggtgacatcgagcttgacccagtctccatcctccctgtctgcaaccggtgggagacgagtgtcaccatccacgttcgccgggacaagtcggaacattgacacctatttaaattggtatcaactatagacaggtacggcccctaagctcctaatctatgctgcgatccagtttgacaagtgggtccatcgagttcagtggcagtgatcgtgggacagtatttcgactctcgacctatacagttaactccgtaggacctaaacgtacgaaagtattttacgacttaaacttacttacttgtaacaataagtaaatttacgaatttcgtttacggaccgaaagggtacaacgtaacctaactaaacgttaaacgtaacttaggtaggtacgtacggacctaaccgtacttaccgttacgttacctttacacctttcccttacccgtaccttacttcctagtaaccg

SEQ ID NO: 140782 - DNA, 545 bp, Homo sapiens
  misc_feature: GYAE6OF02HGOSV.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggagggctggaatacattggaagtgtctctcatagtggaggttcctattacagtccgtctctcaagagtcgagtcaccatatctctggacacgtccagcaatcagttttcccctgaagatgagttctgtgaccgccgctgacacgggctttattactgtgcgagagacggctattatgtattttggagttggttatttcgactacctagatcggacggggctcgacccgtggggccagggaatacgtggtcaccgtctccttagccctccaccgaacgggcccagtccggtccttccccgtggccaccctcctccacgcgtacccg

SEQ ID NO: 140783 - DNA, 559 bp, Homo sapiens
  misc_feature: GYAE6OF02GS6A7.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttcccctgaagatgagttctgtgaccgcgctgacacgggtctttattactgtgcgagagacggctattatgtatttttggagttggttatttcgactaccctagatcggacggggctcgacccgtggggccagggaatacgtggtcaccgtctccttacgcctccaccgaacgggcccacgtccggtccttccccgtcggtccctaccccgtcctcccaacgacgtacccg

SEQ ID NO: 140784 - DNA, 599 bp, Homo sapiens
  misc_feature: GYAE6OF02G715O.46.67.G01.1.454.CMB.1.raw
  modified_base (302)..(302): a, c, t, g, unknown or other
  misc_feature (302)..(302): n is a, c, g, or t
  modified_base (358)..(358): a, c, t, g, unknown or other
  misc_feature (358)..(358): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttggccggcaagtcggaacattgacactattaaattggtatcaacatagaccagggacggccctaagctcctaatctatgctgcatccagtttncaaagtgggtccatcgaggttcagtgcagtgatctgggacagatttcactctcacntcagtaatctgcgaacgtgaagtattttcgactaactttattacttagtacaaactaagtaaacttaacaaatttcggttttacggaccgtaaagggtaaccaaccgtaacttaaactaaaaacgttaaaacgaaaccgttaggtacggtaccgttaggacctaaacccgatttacctaacggttttcccttacgtaacttccccgttttaccccggaccccttacttccttagttaaccg

SEQ ID NO: 140785 - DNA, 514 bp, Homo sapiens
  misc_feature: GYAE6OF02JETXQ.46.67.G01.1.454.CMB.1.raw
  modified_base (228)..(228): a, c, t, g, unknown or other
  misc_feature (228)..(228): n is a, c, g, or t
  modified_base (511)..(511): a, c, t, g, unknown or other
  misc_feature (511)..(511): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacnttgacacctatttaaatggtatcaacatagaccaggacgcccctaagctcctaatctatgctgcatccagtttgcaaagtggggtcccatcgaggttcagtgcagtggatcgtgggacagatttcactctcaccatcagtaatctagcaacgtgaatattttgactaacttattactgtacaacagtaattacaattgtttacggcctaaggacacgaactacaaattaaacgaactagtacgctgacacctatctagtcttacattcttacccgctactctntac

SEQ ID NO: 140786 - DNA, 542 bp, Homo sapiens
  misc_feature: GYAE6OF02GBD0C.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccaggaaggggctggaatacattggaagtgtctctcatagtggaggttcctattacagtccgtctctcaagagtcgagtcaccatatctctggacacgtccagcaatcagttttccctgaagatgagtttctgtgaccgccgctgacacggggtcgtttattactgtgcgagagacgctattatgatttttggagttggttatttcgactaccctagatcggacggggctcggaaccccgtggggcccagggaactacgtggtcaccgttctccttacgcctacccg

SEQ ID NO: 140787 - DNA, 563 bp, Homo sapiens
  misc_feature: GYAE6OF02I5MG2.46.67.G01.1.454.CMB.1.raw
  modified_base (433)..(433): a, c, t, g, unknown or other
  misc_feature (433)..(433): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaattgtatcaacatagaccgagggacgcccctaagctcctaatctatgctgcatccagtttgactaaagtcggggtcccagtcgtaggttcagtggcagtggatcgtgggacagtattcactctcactatcagtatctgactaacgtgaatagtttacgactaacttattactagtactaacagtaacttanaagttgtttacggacgtaagggacctacgtaactaactaaagttaaacgaacttagtagactagacctaaccacttcgttcgttacctttactacttcccgttaccccgtacctacttccgtagtaaccg

SEQ ID NO: 140788 - DNA, 578 bp, Homo sapiens
  misc_feature: GYAE6OF02F54Z5.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctccagggaaggggctggaatacattggaagtgtctctcatagtggaggttcctattacagtccgtctctcaagagtcgagtcaccatatctctggacacgtccagcaatcagttttccctgaagatgagttctgtgaccgccgctgacacgggtctttatactgtgcgagagacggtctattatgtagttttggtaggttggttatttcgactaccctagtactcggacggggtctccggacccgtggggccgagggaatacgtggtccaccgtctccttacgcctccgaccgaacgggccctacgtcccggttccttaccccccgtcgggccctaccccgttccctacccgtacgacgtacccg

SEQ ID NO: 140789 - DNA, 534 bp, Homo sapiens
  misc_feature: GYAE6OF02IW7BJ.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacacctattaaatgtatcaacatagaccagggacgcccctaagctcctaatctatgctgcatccagtttgcaaagtgggtcccatcgaggttcagtggcagtggatcgtgggacagtatttcactctcaccatcagtaatctgctaacgtgaagtattttgactaacttattactgtacaacgtagtaattactaattgttttacggaccgtaagggaccaacgtactaaactaaaattaaacgaactagtacggctagacaactatctacgttcttcacttccttacccacctactctgtac

SEQ ID NO: 140790 - DNA, 518 bp, Homo sapiens
  misc_feature: GYAE6OF02GUKJP.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgactcagtctccatcctccctgtctgcaaccgtggganacagtgtcaccatcacttgccgggcaagtcggaacattgacacctatttaaattggtatcaacatagaccaggacggcccctaagctcctaatctatgctgcatccagtttgcaaagtggggtccagtcgaggttcagtggcagtggatcgtgggacagatttcactctcaccatcagtaatctgcaacgtgaagtatttgactaacttattactgtacaacagtaattacaattgttttacggacctaagggactaacgactaacaaattaaacgaactgtagctaggcactatctagtcttacacttccttcccgctatctacg

SEQ ID NO: 140791 - DNA, 544 bp, Homo sapiens
  misc_feature: GYAE6OF02I9E73.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttcccctgaagatgagttctgtgaccgccgctgacacgggtcgtttattactgtgcgagagacggctattatgtattttggagttggttatttcgactacctagatcggacggggctcgacccgtgggccagggatacgtgtcaccgtctccttagcctccaccgaacggcccagtccggtccttccccgtcggcctaccctcctccacgacgccc

SEQ ID NO: 140792 - DNA, 560 bp, Homo sapiens
  misc_feature: GYAE6OF02F426P.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgaggggaaggggctggaatacattggaagtgtctctcatagtggaggttcctattacagtccgtctctcaagagtcgagtcaccatatctctggacacgtccagcaatcagttttcccagaagatgagttctgtgaccgcgctgacgacgggtctttattactgtgcgagagacgctattatgtattttggagttggttatttcgacaccgtagacgtcgacggggctccggacccgtggggccgagggaactcgtgtcaccgttcctccgttacgcctccgaccgacgggcccacgtccggtcccttccccgtcggccctaccctccctccacgacgacccg

SEQ ID NO: 140793 - DNA, 521 bp, Homo sapiens
  misc_feature: GYAE6OF02HT8IF.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaatggtatcaacatagaccagggacggcccctaagctcctaatctatgctgcatccagtttgcaaagtgggtcccatcgaggttcagtggcagtggatcgtgggacagatttcactctcaccatcagtaatctgacaacgtgaagtattttagctaacttattactagtacaatagaattactaattgtttacggacaagggacaacgtactaaactaaattaaacgaacgttgtagtctagacaacctatctgtctactactctcccgctatctagtac

SEQ ID NO: 140794 - DNA, 565 bp, Homo sapiens
  misc_feature: GYAE6OF02IGQ2P.46.67.G01.1.454.CMB.1.raw
  modified_base (284)..(284): a, c, t, g, unknown or other
  misc_feature (284)..(284): n is a, c, g, or t
  modified_base (341)..(341): a, c, t, g, unknown or other
  misc_feature (341)..(341): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtctccatcctccctgtctgcaaccgtgggagacagtgtcaccatcacttgccgggcaagtcggaacattgacactatttaaatggtatcaacatagaccaggacgccctaagctctatctangctgcatccagtttcgcaaaggtcgggtaccatcgaggttcagtggcagtggatcgngggacagattcactctcaccatcaagtaatctgacaacgtgaaagtatttgactaacttattactgttacaactagtaattacaatttggtttacgacgtaaagggaccaacgtaactaactaaaacgttaaacgtaaacttagtacggtctacgacctaacgtacttccgttagttaccttacttaacgttacccttaccccgtacctaacgttcctagtaac

SEQ ID NO: 140795 - DNA, 541 bp, Homo sapiens
  misc_feature: GYAE6OF02GRYC3.46.67.G01.1.454.CMB.1.raw
  modified_base (334)..(334): a, c, t, g, unknown or other
  misc_feature (334)..(334): n is a, c, g, or t
  modified_base (338)..(338): a, c, t, g, unknown or other
  misc_feature (338)..(338): n is a, c, g, or t
  modified_base (362)..(362): a, c, t, g, unknown or other
  misc_feature (362)..(362): n is a, c, g, or t
  modified_base (535)..(535): a, c, t, g, unknown or other
  misc_feature (535)..(535): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttcccngaanatgagttctgtgaccgcgctgacncgggtctttatactgtgcgagagacgctattatgtattttggagttgttatttcgactaccctagatcgacggggctcgcccgtgggccagggactacgtggtcaccgtctcctagcctccgaccgaacgggccctagtccgtccttcccctcggccaccctccctaccacgntacccg

SEQ ID NO: 140796 - DNA, 550 bp, Homo sapiens
  misc_feature: GYAE6OF02IR7RO.46.67.G01.1.454.CMB.1.raw
  modified_base (249)..(249): a, c, t, g, unknown or other
  misc_feature (249)..(249): n is a, c, g, or t
  modified_base (380)..(380): a, c, t, g, unknown or other
  misc_feature (380)..(380): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccgnagctcccgagggaaggggctggaatacattggaagtgtctctcatagtggaggttcctattacagtccgtctctcaagagtcgagtcaccatatctctggacacgtccagcaatctagttttccctgaagntagtagttctgtcgaccgccgctcgacgacgggtcgtttacttacgtgtgcgagagacggctattatgtattttggagttggtttatttcgactaccgtagagtcggacggggctccggacccgtgggaccgaggacgtacgtggtcgaccgtctccttacgcctacccg

SEQ ID NO: 140797 - DNA, 543 bp, Homo sapiens
  misc_feature: GYAE6OF02F0GWH.46.67.G01.1.454.CMB.1.raw
  modified_base (526)..(526): a, c, t, g, unknown or other
  misc_feature (526)..(526): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctccgaggaaggggctggaatacattggaagtgtctctcatagtggaggttcctattacagtccgtctctcaagagtcgagtcaccatatctctggacacgtcagcaatcagttttccctgaagatgagttctgtcgaccgccgctgacacgggtcgtttatactgtgcgagagacggctattatgtattttggagttggtttatttcgactaccctagactcggacggggtctaccggcccgtggggcctagggtaatacgtggtcacccgtntcccttacgcctacccg

SEQ ID NO: 140798 - DNA, 527 bp, Homo sapiens
  misc_feature: GYAE6OF02GAD2I.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgacaaagtgggtcccatcgaggttcagtggcagtgatctgggacagatttcactctcaccatcagtaatctgacaacgtgaagtattttgactaacttattactgtacaactagtaaattacaattcgtttacgaccgtaagggacacgtaactaactaaattaaacgaactagtagtctgactacctattctgtcttcacttccttcccgctacttctgtac

SEQ ID NO: 140799 - DNA, 530 bp, Homo sapiens
  misc_feature: GYAE6OF02GS29L.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacacctatttaaattggtatcaacatagaccagggacgcccctaagctcctaatctatgctgcatccagtttgacaaaggtcggggtcccatcgaggttcagtggcagtggatcgtgggacagtattcactctcaccatcagtaatctgacaacgtgaagtatttgactaacttattactgtacaacagtaattacaattgtttacgacctaagggacacgactaacgaaattaaacgaactagaggtctagacacctatcgtacgttcttacacttccttcccgactacttctgtaac

SEQ ID NO: 140800 - DNA, 554 bp, Homo sapiens
  misc_feature: GYAE6OF02IVZ37.46.67.G01.1.454.CMB.1.raw
  modified_base (437)..(437): a, c, t, g, unknown or other
  misc_feature (437)..(437): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgaggggaaggggctggaatacattggaagtgtctctcatagtggaggttcctattacagtccgtctctcaagagtcgagtcaccatatctctggacacgtccagcaatctagttttcccagaagatgagttctgtcgaccgccgctgacacgggtcgtttattactgtgcgagagacggctattatgtattttggagttggttatttcgactaccctagntcggacgggctcgacccgtgggccagggatcgtgtcaccgtctccttacgcctccaccgacggcccacgtccggtcccttccccgtcggccaccctccctacccgtacgcgtacccg

SEQ ID NO: 140801 - DNA, 517 bp, Homo sapiens
  misc_feature: GYAE6OF02H695D.46.67.G01.1.454.CMB.1.raw
  modified_base (409)..(409): a, c, t, g, unknown or other
  misc_feature (409)..(409): n is a, c, g, or t
  modified_base (514)..(514): a, c, t, g, unknown or other
  misc_feature (514)..(514): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtccatcgaggttcagtggcagtggatctgggacagatttcactctcaccatcagtaatctgcaacgtgaagtatttgctaattattactgtcaanagtaattacaattgttttacggactaaggacacgaacttaacaaattaaacgaactagtagactagaccacatactgttcttctatccttcccgtccacttcctntac

SEQ ID NO: 140802 - DNA, 559 bp, Homo sapiens
  misc_feature: GYAE6OF02FFJ04.46.67.G01.1.454.CMB.1.raw
  modified_base (335)..(335): a, c, t, g, unknown or other
  misc_feature (335)..(335): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccaggggaagggctggaatacattggaagtgtctctcatagtggaggttcctattacagtccgtctctcaagagtcgagtcaccatatctctggacacgtccagcaatcagttttccccngaagatgagttctgtgaccgccgctgacacgggcgttttattactgtgcgagagacggctattatgtatttttggagtggttatttcgacaccctagatcgacggggctcggacccagtcggggccagggaattacgtggtcaccgtctccttagccctccgaccgacgggcccaagttccggtaccttcccccgtggccctacccctccctacccaagtaccg

SEQ ID NO: 140803 - DNA, 595 bp, Homo sapiens
  misc_feature: GYAE6OF02IV7U1.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatcgtgggacagatttcactctcaccatcagtaatctgcaacgtgaagtattttgactaactttattactagttacaaactagtaaatttacaattgttttacggacctaaagggaccaacggtaacttaacgaaatttaaaaccgaaacttagtacggaccttacggacctaacccgtaattccgttacggttaccttttacctaacctttcccgtttacccccggacccttacgtttacccttagttaacccg

SEQ ID NO: 140804 - DNA, 547 bp, Homo sapiens
  misc_feature: GYAE6OF02GTZOC.46.67.G01.1.454.CMB.1.raw
  modified_base (373)..(373): a, c, t, g, unknown or other
  misc_feature (373)..(373): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctcatcagtagtggtttctctggggctgggtccggcagctcccgagggaaggggctggaatacattggaagtgtctctcatagtggaggttcctattacagtccgtctctcaagagtcgagtcaccatatctctggacacgtccagcaatcagttttcccngaagatgagttctgtgaccgccgctgacacgggtcgtttattactgtgcgagagacggctattatgtatttttggagttggttatttcgactaccctagtactcggacggggtctcggaccccgtggggccgtaagggactacgtcggtcaccgtcgtccttacgccctacccg

SEQ ID NO: 140805 - DNA, 510 bp, Homo sapiens
  misc_feature: GYAE6OF02GDBKA.46.67.G01.1.454.CMB.1.raw
  modified_base (507)..(507): a, c, t, g, unknown or other
  misc_feature (507)..(507): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccccctaagctcctaatctatgctgcatccagtttgcaaagtggggtcccatcgaggttcagtggcagtggatctgggacagatttcactctcaccatcagtaatctgcaacgtgaagattttgctaaacttattactgtcaacagaattacaatgttttcggacctaagggacaacgactaacaaataaacgaactagtgctgcaccattctgtcttctatccttcccgccatctntac

SEQ ID NO: 140806 - DNA, 527 bp, Homo sapiens
  misc_feature: GYAE6OF02FT3QX.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccggcaagtcggaacattgacacctatttaaatgtatcaacatagaccaggacggcccctaagctcctaatctatgctgcatccagtttgctaaagtgggtcccatcgaggttcagtggcagtgatctgggacagattcactctcacatcagtatctgcaacgtgaagtatttgactaacttattactgtacaacagtaattacaattgttttacggactaaggacacgtactaacaaacttaaacgaactgtagtactagacgtaacctatactcgttacttactactaccttcccgacctacttactagtaacg

SEQ ID NO: 140807 - DNA, 560 bp, Homo sapiens
  misc_feature: GYAE6OF02II39K.46.67.G01.1.454.CMB.1.raw
  modified_base (298)..(298): a, c, t, g, unknown or other
  misc_feature (298)..(298): n is a, c, g, or t
tcagactagcagtacacgaccggtgctcgatttagagtatacatattgggtttggggtagtctcggtcaggacacagcatggacatgagggtccccgctcagctcctggggctcctgctactctggctccgaggtgccagatgtgacatcgagctgacccagtctccatcctccctgtcctgccaaccgtggagacagtgtcaccatcattgccgggcaagtcggaacattgacactatttaaatgtatcaacatagacaggacgcctaagctctaatctatgctgcatccagtttcncgtaaaggtcgggtacccagttcgacggtttcagttggactaggttgatcgtgggactaggtatttcacgtctacacaatcaagtactctagcaacgtgaagtacttttgactaacttattactgtactaacagtaacttaactaagtttgtttaccgacgaaagggacaacgtactaaaccgtaaataaaacgaactagtagccgtagtccaacctattcgtaacgttcttactctacccttcccgcctaatcctagtaac

SEQ ID NO: 140808 - DNA, 514 bp, Homo sapiens
  misc_feature: GYAE6OF02G0ME3.46.67.G01.1.454.CMB.1.raw
  modified_base (489)..(489): a, c, t, g, unknown or other
  misc_feature (489)..(489): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatctgggacagatttcactctcaccatcagtaatctgctaacgtgaagtattttgactaacttattactgttacaacagtaattaacaattagtttcggacctaagggacaacgactaacaaattaaacgaactagtgctgcacatactntcttcactctcccgccatctagtac

SEQ ID NO: 140809 - DNA, 535 bp, Homo sapiens
  misc_feature: GYAE6OF02G6FVY.46.67.G01.1.454.CMB.1.raw
  modified_base (304)..(304): a, c, t, g, unknown or other
  misc_feature (304)..(304): n is a, c, g, or t
  modified_base (374)..(374): a, c, t, g, unknown or other
  misc_feature (374)..(374): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgcccctaagctcctaatctatgctgcatccagtttncaaagtgggtcccatcgagttcagtggcagtggatctgggacagatttcactctcaccatcagtaatctncaacgtgaagtatttgactaacttattactgtacaacagtaattaactaattagttttcggacctaagggacaacgtaactaactaaaattaaacgaacttagtagtctagacaactactctcgttactttcgacttccttcccgacctacttctagtaac

SEQ ID NO: 140810 - DNA, 520 bp, Homo sapiens
  misc_feature: GYAE6OF02I9O5Z.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatctgggacagatttcactctcaccatcagtaatctgcaacgtgaagtattttgactaacttattactgtacaacagtaattacaattgtttcggaccaagggacacgtactaacaaattaaacgaactagtagctagcacctattctagttcttacacttccttacccgcctatctgtac

SEQ ID NO: 140811 - DNA, 553 bp, Homo sapiens
  misc_feature: GYAE6OF02HIZWS.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgcccctaagctcctaatctatgctgcatccagtttgcaaagtgggtcccatcgaggttcagtggcagtgatctgggacagatttcactctcaccatcaagtatctgacaacgtagaagtattttgactaacttattacttgtacaactagtaaattactaattgtttacggaccgtaagggtactaacgaacttaaactaaattaaacgaacttagtagtactagacctaacctatcttgttaccttactactttcccttaccccgtacctacttacctagtaac

SEQ ID NO: 140812 - DNA, 524 bp, Homo sapiens
  misc_feature: GYAE6OF02IEVE7.46.67.G01.1.454.CMB.1.raw
  modified_base (334)..(334): a, c, t, g, unknown or other
  misc_feature (334)..(334): n is a, c, g, or t
  modified_base (465)..(465): a, c, t, g, unknown or other
  misc_feature (465)..(465): n is a, c, g, or t
  modified_base (469)..(469): a, c, t, g, unknown or other
  misc_feature (469)..(469): n is a, c, g, or t
  modified_base (477)..(477): a, c, t, g, unknown or other
  misc_feature (477)..(477): n is a, c, g, or t
  modified_base (506)..(506): a, c, t, g, unknown or other
  misc_feature (506)..(506): n is a, c, g, or t
  modified_base (517)..(517): a, c, t, g, unknown or other
  misc_feature (517)..(517): n is a, c, g, or t
  modified_base (522)..(522): a, c, t, g, unknown or other
  misc_feature (522)..(522): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttcccngaacgatgagttctgtgaccgccgctgacacgggcgtttattactgtgcgagagacgctatatgtattttggagttggttatttcgactacctagatcggacgggctccgacccgtgggccagggatacgngtcncgtctctncctccacgacggcccatccgtcctccccncgcaccctccncacgncc

SEQ ID NO: 140813 - DNA, 510 bp, Homo sapiens
  misc_feature: GYAE6OF02IW14X.46.67.G01.1.454.CMB.1.raw
  modified_base (490)..(490): a, c, t, g, unknown or other
  misc_feature (490)..(490): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccaggacggcccctaagctcctaatctatgctgcatccagtttgcaaagtgggtcccatcgagttcagtggcagtggatctgggacagattcactctcacatcagtaatctgcaacgtgaagtattttgactaacttattactgtactaacagtaattacaattgtttacggacctaagggacaacgactaacaaattaaacgaactgtaggctgcaacatctgtacttnactcttcccgccatctgtac

SEQ ID NO: 140814 - DNA, 539 bp, Homo sapiens
  misc_feature: GYAE6OF02IPNEI.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgcccctaagctcctaatctatgctgcatccagtttgcaaagtgggtcccatcgaggttcagtggcagtggatcgtgggacagtatttcactctcaccatcagtaatctgcaacgtgaagtatttgactaacttattactgtacaactagtaacttacaagttgtttacggacctaagggacctaacgtaacttaactaaacttaaacgaaacgttgtaggctagacctaacctatctagttcttctacttccttccccgctactctagtac

SEQ ID NO: 140815 - DNA, 625 bp, Homo sapiens
  misc_feature: GYAE6OF02JLKDU.46.67.G01.1.454.CMB.1.raw
  modified_base (216)..(216): a, c, t, g, unknown or other
  misc_feature (216)..(216): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggagacagtgtcaccatcacttgccgggnaagtcggaacattgacacctattaaatgtatcaacatagaccaggacggcccctaagctcctaatctatgctgcatccagtttgctaaagtcgggtacccagtcgaggttcagtggcagtggatcgtgggacagtatttcactctcacatacagtaatctgcaacgtgaagtatttgactaacgttattactgtactaacagtaaacttactaattcggttttaccgacctaacgggtaacctaacggtaaccttaaactaaaacgtttaaaaccgtaacgttacggttaccggtacgttacggtacccgtaacccgttaattacccgtttaccggttaccgttttacctaaccgttttaccccgtttaccccccggtaccctttaacgttacccgttacgttaaaccg

SEQ ID NO: 140816 - DNA, 562 bp, Homo sapiens
  misc_feature: GYAE6OF02IAZJ8.46.67.G01.1.454.CMB.1.raw
  modified_base (331)..(331): a, c, t, g, unknown or other
  misc_feature (331)..(331): n is a, c, g, or t
  modified_base (378)..(378): a, c, t, g, unknown or other
  misc_feature (378)..(378): n is a, c, g, or t
  modified_base (384)..(384): a, c, t, g, unknown or other
  misc_feature (384)..(384): n is a, c, g, or t
  modified_base (440)..(440): a, c, t, g, unknown or other
  misc_feature (440)..(440): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgagggaaggggctggaatacagttggaagtgtctctcatagtggaggttcctattacagttccgtctctcaagngtcgagtcaccatatctctggacacgtccagcaatctagttttcccngaagtntgagtttctgtcgaccgccgctgacgacgggtcgtttattactgtgcgagagacgntattatgtatttttggagttggttatttcgacctacctagtactcggacggggtcctaccggaccccggtgggaccagggtaactacgtcggtcctaccgttcctccgttaccgcctacccg

SEQ ID NO: 140817 - DNA, 594 bp, Homo sapiens
  misc_feature: GYAE6OF02IET38.46.67.G01.1.454.CMB.1.raw
  modified_base (192)..(192): a, c, t, g, unknown or other
  misc_feature (192)..(192): n is a, c, g, or t
  modified_base (217)..(217): a, c, t, g, unknown or other
  misc_feature (217)..(217): n is a, c, g, or t
  modified_base (305)..(305): a, c, t, g, unknown or other
  misc_feature (305)..(305): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggnaagtcggaacattgacaccttatttaaattggtatcaacatagaccagggacgcccctaagctcctaatctatgctgcatccagtttncaaaggtcgggtcccagtcgtaggttcaggtgcgagtggatcgtgggactagtattcacgttctcacatcaagtaatctagctaacgtagaagttatttacgacttaattattactagtactaacgaagtaattaactaagttcgtttaccggactaacgggtaccaaccggtaacttaaactaaacttaaacgtaacttacggtaggtactacgacctaacctacttcgtacgtttaccttaccgtacgtttcccgttaccccgtaccttacgttccgtaggttaacc

SEQ ID NO: 140818 - DNA, 621 bp, Homo sapiens
  misc_feature: GYAE6OF02HC5NG.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacacctatttaaatggtatcaacatagaccagggacgcccctaagcctcctaatctatgctgcatccagtttgactaaagtcgggtcccagtcgaggttcagtggcagtggatcgtgggacagtactttcgactctcaacctatacaagtaatctacgacaacgtgaagtattttgactaaacgtttattaacttagtactaaacagtaaatttaactaacgttagttttaccgggaaccgtaaacgggtaacctaaccggtaaccttaaacgtaaaacgtttaaaaccggtaaacgttacggttaacggtaccttacgtaccgtaacctaacgttcttacgttactttacctactttacccttccccggacctacttccgttacgtaac

SEQ ID NO: 140819 - DNA, 517 bp, Homo sapiens
  misc_feature: GYAE6OF02H1UY4.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctcctaatctatgctgcatccagtttgcaaagtgggtcccatcgaggttcagtgcagtggatctgggacagatttcactctcacatcagtaatctgcaacgtgaagtattttgactaacttattacttgtacaacagtaaattacaaattgttttacggacaaggacaacgactaacaaattaaacgaactagtgctagcaaccatctgtcttcacttccttcccgacctactctgtaac

SEQ ID NO: 140820 - DNA, 560 bp, Homo sapiens
  misc_feature: GYAE6OF02IDK1T.46.67.G01.1.454.CMB.1.raw
  modified_base (214)..(214): a, c, t, g, unknown or other
  misc_feature (214)..(214): n is a, c, g, or t
  modified_base (290)..(290): a, c, t, g, unknown or other
  misc_feature (290)..(290): n is a, c, g, or t
  modified_base (298)..(298): a, c, t, g, unknown or other
  misc_feature (298)..(298): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgcaccatcattgccggnaagtcggaacattgacactatttaaatgtatcaacatagaccaggacggcccctaagctcctaatctatgctgcancctatttnacaaagtgggtccagtcgagttcagtggacagtgatctgggactagatttcactctcacatcagtaatctagacaacgtagaagtattttcgactaattacttaactgttacaaactagaaattaacaattgttttaccggacctaaagggactaacggtaactaaacgtaaattaaaaaccggaacttaggtacggtactacgtacgaacctaacttcgcgtttacttactactcgtttaccccgctactcgtagtaaccg

SEQ ID NO: 140821 - DNA, 535 bp, Homo sapiens
  misc_feature: GYAE6OF02FUQAA.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagacagggacggcccctaagctcctaatctatgctgcatccagtttgcaaagtggggtcccatcgaggttcagtggcagtggatctgggacaggatttcactctcaccatcagtaatctgcaacgtgaagtattttgctaacttattactgtacaacagtaattacaattgttttcggacctaagggacacgtaactaactaaattaaacgtaaactagtaggtactagacaaccatctagttcttactacttccttaccccgtcctacttctagtac

SEQ ID NO: 140822 - DNA, 510 bp, Homo sapiens
  misc_feature: GYAE6OF02GF699.46.67.G01.1.454.CMB.1.raw
  modified_base (480)..(480): a, c, t, g, unknown or other
  misc_feature (480)..(480): n is a, c, g, or t
  modified_base (507)..(507): a, c, t, g, unknown or other
  misc_feature (507)..(507): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgcccctaagctcctaatctatgctgcatccagtttgcaaagtgggtcccatcgaggttcagtggcagtgatctgggacagatttcactctcaccatcagtaatctgcaacgtgaagtattttgactaacttattacttgtacaacagaattacaattgtttcgacaagggacacgactaacaaattaaacgaactgtagctgacaccatctnttcttcacttccttcccgctacttctntac

SEQ ID NO: 140823 - DNA, 519 bp, Homo sapiens
  misc_feature: GYAE6OF02GKI6J.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaatggtatcaacatagacagggacgcccctaagctcctaatctatgctgcatccagtttgcaaagtgggtcccatcgagttcagtgcagtggatcgtgggacagattcactctcaccatcagtaatctgcaacgtgaagtattttgactaacttattactagtactaaacagtaaattacaattagttttcggacctaagggacacgaactaactaaaattaaacgaatagtagtactgacaacatactgtacttcgactccttcccgccatctgtac

SEQ ID NO: 140824 - DNA, 579 bp, Homo sapiens
  misc_feature: GYAE6OF02FJMV0.46.67.G01.1.454.CMB.1.raw
  modified_base (393)..(393): a, c, t, g, unknown or other
  misc_feature (393)..(393): n is a, c, g, or t
  modified_base (411)..(411): a, c, t, g, unknown or other
  misc_feature (411)..(411): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggcccttcggagaccctgtccctcacctgcgctgtctctggtgcctccatcagtagtggtttcttctggggctgggtccggcagctcccagggagggctggaatacattggaagtgtctctcatagtggaggttcctattacagtccgtctctcaagagtcgagtcaccatatctctggacacgtccagcaatcagtttttcccctgaacgatgagttctgtgaccgcgctgacagtgggtctttatctgtgcgagacggacgnttattatgttagtttggngttgtttattcgacctaccgtagagtcgggacgggtctccggtacccggtcgggaccgagggtaacttacgtcgtaccgaccgttcgtaccttacgccctaccgaaccgacggaccctagttcccgttcccttccccgcggtcccctacccgtccctacgagtacccg

SEQ ID NO: 140825 - DNA, 570 bp, Homo sapiens
  misc_feature: GYAE6OF02IOYVH.46.67.G01.1.454.CMB.1.raw
  modified_base (305)..(305): a, c, t, g, unknown or other
  misc_feature (305)..(305): n is a, c, g, or t
  modified_base (332)..(332): a, c, t, g, unknown or other
  misc_feature (332)..(332): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctccagggaagggctggaatacattggaagtgtctctcatagtggaggttcctattacagtccgtctctcaagagtcgagtcaccatatctcnggacacgtcagcaatctagttttcccngaagatgagttctgtcgaccgcgctgacacgggtcgtttattactgtgcgagagacggctattatgtattttggagttggttattcgactaccctagactcgacggggctcgaccccgtggggccgagggaacttacgtcggtccaccggtctcccttagccctccacccgaacgggtccccaagttcccggtcctttcccccgtcggacctacccctccctacccacgtacgtcccg

SEQ ID NO: 140826 - DNA, 546 bp, Homo sapiens
  misc_feature: GYAE6OF02GRS0Y.46.67.G01.1.454.CMB.1.raw
  modified_base (334)..(334): a, c, t, g, unknown or other
  misc_feature (334)..(334): n is a, c, g, or t
  modified_base (542)..(542): a, c, t, g, unknown or other
  misc_feature (542)..(542): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttcccngaagatgagttctgtgaccgccgctgacacggggcgttttattactgtgcgagagacgggctattatgtatttttggagttggttatttcgacaccctagatcgacgggggctcgaccccgtggggccagggaatactggtcaccgtctccttacgcctccgaccaagggcccatccggtccttccccctggccaccctcctccacgngccc

SEQ ID NO: 140827 - DNA, 550 bp, Homo sapiens
  misc_feature: GYAE6OF02FZ16S.46.67.G01.1.454.CMB.1.raw
  modified_base (333)..(333): a, c, t, g, unknown or other
  misc_feature (333)..(333): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaagggctggaatacattggaagtgtctctcatagtggaggttcctattacagtccgtctctcaagagtcgagtcaccatatctctggacacgtccagcaatcagttttcccngaagatgagttctgtgaccgccgctgacacgggtcttttattactgtgcgagagacggctattatgtatttttggagttggttatttcgacacccttagatcgacggggctcgacccgtggggccagggaatacgtggtcaccgtctccttagccctccaccgaacggcccagtccggtccttccccgtcggcctaccctccctaccacgacgcccg

SEQ ID NO: 140828 - DNA, 512 bp, Homo sapiens
  misc_feature: GYAE6OF02G5K8R.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagtattttgctaacttattactgtacaacagaattacaattgttttacggacctaagggacacgactaacaaattaaacgaactgtagctgcacatctgtcttctacttcttcccgcctatctgtac

SEQ ID NO: 140829 - DNA, 551 bp, Homo sapiens
  misc_feature: GYAE6OF02FUBPJ.46.67.G01.1.454.CMB.1.raw
  modified_base (330)..(330): a, c, t, g, unknown or other
  misc_feature (330)..(330): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccgcagctccagggagggctggaatacattggaagtgtctctcatagtggaggttcctattacagtccgtctctcaagagtcgagtcaccatatctctggacacgtccagcaatcagttttcccngaagatgagttctgtgaccgccgctgacacgggtcgtttatactgtgcgagagacggctattatgtatttttggagttggttatttcgacacccttagatcggacggggtctcgacccgtgggccagggatcgtgtcaccgtctccgttacgcctccaccgacggcccacgtccggttccttcccccgtggcccaccccgtccctaccgacgacgtacccg

SEQ ID NO: 140830 - DNA, 567 bp, Homo sapiens
  misc_feature: GYAE6OF02GHBAL.46.67.G01.1.454.CMB.1.raw
  modified_base (334)..(334): a, c, t, g, unknown or other
  misc_feature (334)..(334): n is a, c, g, or t
  modified_base (394)..(394): a, c, t, g, unknown or other
  misc_feature (394)..(394): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttcccngaagatgagttctgtgaccgccgctgacacgggtcgttttattactgtgcgagagacggntattatgtatttttggagttggttattcgtacacccttagatcggacggggctccgacccgtggggccagggaatacgtgtccaccgtctccttagccctccgaccgaacgggccctacgtccggttcccttcccccgtcggtccctaccccttcctcccaacgccgtacccg

SEQ ID NO: 140831 - DNA, 521 bp, Homo sapiens
  misc_feature: GYAE6OF02HJ126.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattgtatcaacatagaccaggacgcccctaagctcctaatctatgctgcatccagtttgcaaagtgggtcccatcgaggttcagtggcagtggatcgtgggacagatttcactctcaccatcagtaatctgacaacgtgaagtattttgactaacttattactgtacaactagaaattacaattgttttacgacgtaaggacacgtactaacaaattaaacgaactgtagctagaccaacatctagtcttacacttccttcccgaccattctagtaac

SEQ ID NO: 140832 - DNA, 526 bp, Homo sapiens
  misc_feature: GYAE6OF02GLPFH.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccaggacggcccctaagctcctaatctatgctgcatccagtttgcaaagtggggtcccatcgaggttcagtggcagtggatcgtgggacagtattcactctcaccatcagtaatctgacaacgtgaatattttgactaaacttattacttgtacaacagtaaattactaattgttttaccgacctaagggacaacgtactaacaaaattaaacgaactgtagactcgcaacattctcttcttacattccttcccgcctatctgtaac

SEQ ID NO: 140833 - DNA, 533 bp, Homo sapiens
  misc_feature: GYAE6OF02GJXSU.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctcctaatctatgctgcatccagtttgcaaagtgggtcccatcgaggttcagtggcagtggatctgggacagatttcactctcaccatcagtaatctgcaacgtgaagtattttgactaacttattacttgtactaacagtaattactaattcgttttacggaccgtaagggacacgtaactaacaaacttaaacgaacttgtagtactgactacctatctgtacttacacttccgttcccgactacttctgtaac

SEQ ID NO: 140834 - DNA, 506 bp, Homo sapiens
  misc_feature: GYAE6OF02I3RB8.46.67.G01.1.454.CMB.1.raw
  modified_base (503)..(503): a, c, t, g, unknown or other
  misc_feature (503)..(503): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattgtatcaacatagaccaggacggcccctaagctcctaatctatgctgcatccagtttgcaaagtggggtcccagtcgaggttcagtggcagtggatctgggacagatttcactctcaccatcagtaatctgcaacgtgaagtatttgctaacttattactgtacaactagtaattactaattgtttcgaccaaggacacgactaactaaataaacgaactagtgtactgacacatctgtctcactcttccgcactctntac

SEQ ID NO: 140835 - DNA, 506 bp, Homo sapiens
  misc_feature: GYAE6OF02JFKL7.46.67.G01.1.454.CMB.1.raw
  modified_base (503)..(503): a, c, t, g, unknown or other
  misc_feature (503)..(503): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtatccatcctccctgtctgcaaccgtgggagacagtgtcaccatcacttgccgggcaagtcggaacattgacacctatttaaatggtatcaacatagaccaggacgcccctaagctcctaatctatgctgcatccagtttgcaagtgggtcccatcgaggttcagtgcagtgatctgggacagatttcactctcaccatcagtaatctgacaacgtgaagtatttgactaacttattactgtactaacagtaattacaattgttttacgacctaagggacacgactactaaattaaacgaactgtgctagactacatctgtcttcactcttccgctactctntac

SEQ ID NO: 140836 - DNA, 581 bp, Homo sapiens
  misc_feature: GYAE6OF02HWQOF.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggcctttcggagacccctgtccctcacctgcgctgtctctggtgcctccatcagtagtggtttcttctggggctgggtccggcagctcccgagggagggctggaatacattggaagtgtctctcatagtggaggttcctattacagtccgtctctcaagagtcgagtcaccatatctctggacacgtccagcaatctacgttttccctgaagtatgagttctgtgaccgccgctgacgtacgggtctttattactgtgcgagagacgtctatatgtattttggagttggtttattcgactaccgtagtacgtcggtacggggcctcggaccccggtcggggccgaagggtaacgtacgtggttccacgtctccttacgtcctacctaccgaacggccctacgtccggttcccttccccgtcggccctaccctcccgtaccacgacgtacccg

SEQ ID NO: 140837 - DNA, 525 bp, Homo sapiens
  misc_feature: GYAE6OF02JKECL.46.67.G01.1.454.CMB.1.raw
  modified_base (217)..(217): a, c, t, g, unknown or other
  misc_feature (217)..(217): n is a, c, g, or t
  modified_base (334)..(334): a, c, t, g, unknown or other
  misc_feature (334)..(334): n is a, c, g, or t
  modified_base (359)..(359): a, c, t, g, unknown or other
  misc_feature (359)..(359): n is a, c, g, or t
tcagactagcagtacacgaccggtgctcgatttagagtatacatattgggtttggggtagtctcggtcaggacacagcatggacatgagggtccccgctcagctcctggggctcctgctactctggctccgaggtgccagatgtgacatcgagctgacccagtctccatcctccctgtctgcaaccgtggagacagtgtcaccatcacttgccgggnaagtcggaacattgacacctatttaaatgtatcaacatagaccaggacgcccctaagctcctaatctatgctgcatcagtttgcaagtgggtccatcgagttcagtgcagtggatcngggacaggatttcactctcacctancagtaactctagcaacgtgaagtattttgactaacgttattactagttccaactagaatttacaatttgtttacgacctaagggtacacggtactaacaaattaaacgaatagtagactgactaccatacctgtaccttgacttcctttcccgccttatctgtaac

SEQ ID NO: 140838 - DNA, 617 bp, Homo sapiens
  misc_feature: GYAE6OF02I1IPS.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcgaacattgacacctatttaatggtatcaacatagaccgagggacgacccctaagctacctaatctatgctgcatcctagtttgacaagtcggggtccctatcgaggttcagtggctaggtgtatcgtggacagtatttcactctcacctatcagttatctgacgaacgtgtaagttatttgacttaaacgttattaactgttacaagtagtaattactaagttcgttttacggaccgtaaacggtaaccaacggtaactaaacgttaaaaacgttaaaccgtaaacttgggttacgtaccttacggaaccctaacgtaccttacgttacgtttacccttttacgtaaccttttcccgttacccccggtaccctaacgtttaccgttagttaaccg

SEQ ID NO: 140839 - DNA, 568 bp, Homo sapiens
  misc_feature: GYAE6OF02GLLEC.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatgtatcaacatagaccaggacgcccctaagctcctaatctatgctgcatccagtttgcaaaggtgggtcccagtcgaggttcagtggcagtgatcgtgggacagtatttcactctaccacctatcaagtaactctagacaacgtgaagttatttcgactaacttattacttgtactaacagtaaattactaatttcgttttaccggaacctaagggtacctaacgtaactaaactaaaacgttaaacgaacgttagtaggactagacctaactattacttacgttccttactacttccgttacccgtactacttcgtagtaacg

SEQ ID NO: 140840 - DNA, 532 bp, Homo sapiens
  misc_feature: GYAE6OF02HX3NA.46.67.G01.1.454.CMB.1.raw
  modified_base (217)..(217): a, c, t, g, unknown or other
  misc_feature (217)..(217): n is a, c, g, or t
  modified_base (338)..(338): a, c, t, g, unknown or other
  misc_feature (338)..(338): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacacctatttaaattggtatcaacatagacagggacgcccctaagctctaatctatgctgcatccagtttgcaaagtgggtcccatcgagttcagtggcagtggatntgggacagatttcactctcaccatcagtaatctagacaacgtgaagtattttagctaacttattactagtacaactagaattacaattgttttacggaccaagggaccaacgtaactaactaaaattaaaacgaactagtaggtactgacaacctatctgttacttactattccttcccgacctactctagtac

SEQ ID NO: 140841 - DNA, 525 bp, Homo sapiens
  misc_feature: GYAE6OF02IC50M.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaattggtatcaacatagaccagggacggcccctaagctcctaatctatgctgcatccagtttgcaaagtggggtcccagtcgaggttcagtggcagtggatcgtggacagatttcactctcacatcagtaatctgacaacgtgaagtattttgactaactttattaactgtacaaactagtaaattacaattgttttacggacctaaagggacacgactaactaaattaaacgaacgtagtaggactgacacatctgtcttcactcttcccgactatctagtac

SEQ ID NO: 140842 - DNA, 515 bp, Homo sapiens
  misc_feature: GYAE6OF02H1E8H.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatctgggacagatttcactctcaccatcagtaatctgcaacgtgaagtattttgctaacttattactgtacaacagtaattacaattgtttacggacctaagggactacggaacttaacaaaattaaacgaactagtgctgcacatctgtcttcactccttccgaccatcctgtac

SEQ ID NO: 140843 - DNA, 694 bp, Homo sapiens
  misc_feature: GYAE6OF02HJ3FT.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgcccctaagctacctaatctatgctgcatcctagtttcgactaaaggttcggggtaccctagttccggtaggtttaccgaggtgggcctaggtaggattcgtggggaacagtaattttccaacttcctacctaacctatacctaagttaactctacggaccgtaaacgtacgtaaagttacgtttttacgaacgttaaaccttttaatttaaccgttacgttaacctaaaacgtaagttaaaactttaaacgtaagttttacggtttttacccgggtaaccgtaaacggggtaacctaacggtaaaccttaaacgtaaaaacgtttaaaaccgtaacgttacgtaggtccgttagaccgtaaacctacttacgtacgtttacttacctacgtttcccgttacccgaccctaatttaccagttaacg

SEQ ID NO: 140844 - DNA, 549 bp, Homo sapiens
  misc_feature: GYAE6OF02HG602.46.67.G01.1.454.CMB.1.raw
  modified_base (372)..(372): a, c, t, g, unknown or other
  misc_feature (372)..(372): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaattgtatcaacatagaccagggacggcccctaagctcctaatctatgctgcatccagtttgcaaagtcgggtcccatcgaggttcagtggcagtggatcgtgggacagatttcactctcacatcagtatntgactaacgtgaagtattttgactaactttattactgtactaaacagtaaacttacaattgtttaccggacctaagggacctacgtaactaactaaaattaaacgtaacgtagtaggactagacctaactattccgtacgttacttactacttccttccccgacttactctagtaac

SEQ ID NO: 140845 - DNA, 545 bp, Homo sapiens
  misc_feature: GYAE6OF02IC6SV.46.67.G01.1.454.CMB.1.raw
  modified_base (333)..(333): a, c, t, g, unknown or other
  misc_feature (333)..(333): n is a, c, g, or t
  modified_base (485)..(485): a, c, t, g, unknown or other
  misc_feature (485)..(485): n is a, c, g, or t
  modified_base (539)..(539): a, c, t, g, unknown or other
  misc_feature (539)..(539): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccggcagctcccagggaagggctggaatacattggaagtgtctctcatagtggaggttcctattacagtccgtctctcaagagtcgagtcaccatatctctggacacgtccagcaatctagttttcccngaacgatgagttctgtcgaccgccgctgacacgggcgttttattactgtgcgagagacggctatatgtattttggagttggtttatttcgactaccctagatcgacggggctcgcccgtggggccagggatacgtggtcacgtctccgttancctccaccgagggcccagtccggtccttccccgtggcctaccctcctaccacgntacccg

SEQ ID NO: 140846 - DNA, 504 bp, Homo sapiens
  misc_feature: GYAE6OF02FMXEL.46.67.G01.1.454.CMB.1.raw
  modified_base (485)..(485): a, c, t, g, unknown or other
  misc_feature (485)..(485): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagattttgctaacttattactgtcaacagaattacaatgttttacggctaagggacacgactaacaaattaaacgaactagtgctagctacatctgtcttnattctaccgcactctgtac

SEQ ID NO: 140847 - DNA, 562 bp, Homo sapiens
  misc_feature: GYAE6OF02ITNR5.46.67.G01.1.454.CMB.1.raw
  modified_base (332)..(332): a, c, t, g, unknown or other
  misc_feature (332)..(332): n is a, c, g, or t
  modified_base (361)..(361): a, c, t, g, unknown or other
  misc_feature (361)..(361): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggagggctggaatacattggaagtgtctctcatagtggaggttcctattacagtccgtctctcaagagtcgagtcaccatatctctggacacgtccagcaatcagttttcccngaagatgagttctgtgaccgccgctgacncgggtctttattactgtgcgagagacggctattatgtattttgggagtggtttattcgactaccctagatcggacggggtctccgacccgtggggccagggaactacgtggtcaccggtctccgttagcctaccaccgaacgggcccagtccggttccttcccccgtcggtcccaccccttccctaccaacgtcgtacccg

SEQ ID NO: 140848 - DNA, 574 bp, Homo sapiens
  misc_feature: GYAE6OF02HGGB4.46.67.G01.1.454.CMB.1.raw
  modified_base (210)..(210): a, c, t, g, unknown or other
  misc_feature (210)..(210): n is a, c, g, or t
  modified_base (334)..(334): a, c, t, g, unknown or other
  misc_feature (334)..(334): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggnagctcccaggggaggggctggaatacattggaagtgtctctcatagtggaggttcctattacagtccgtctctcaagagtcgagtcaccatatctctggacacgtccagcaatcagttttcccngaagatgagttctgtcgaccgccgctgacacgggtctttatactgtgcgagagacggcttattatgtatttttggagttggttatttcgactaccctagagtcggacggggcctcgaccccggttgggccgagggatacgtgggtccaccgttctccgttagccctaccaccgaacgggccctacgtccggtccctttcccccgtggccctaccccgttccctacccgaacgcgtacccg

SEQ ID NO: 140849 - DNA, 509 bp, Homo sapiens
  misc_feature: GYAE6OF02H91HH.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctcagaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatcgtgggacagatttcactctcaccatcagtaatctgcaacgtgaagtatttgactaacttattactgtacaacagaattacaattgtttacgaccaagggacacgaactaacaaattaaacgactgtagctgcaccatctagtcttcactccttcccgctatctacg

SEQ ID NO: 140850 - DNA, 618 bp, Homo sapiens
  misc_feature: GYAE6OF02IPSEU.46.67.G01.1.454.CMB.1.raw
  modified_base (277)..(277): a, c, t, g, unknown or other
  misc_feature (277)..(277): n is a, c, g, or t
  modified_base (281)..(281): a, c, t, g, unknown or other
  misc_feature (281)..(281): n is a, c, g, or t
  modified_base (349)..(349): a, c, t, g, unknown or other
  misc_feature (349)..(349): n is a, c, g, or t
tcagactagcagtacacgaccggtgctcgatttagagtatacatattgggtttgtcctcctgctggtggcagctcccagatgggtcctgtccctggtgcaactgcaggagtcggcccacgactggtgaggccttcggagaccctgtccctcacctgcgctgtctctggtgcctcatcagtagtgttcttctggggctgggtccggcagctcccgagggaagggctggaatacagttggaagtgtctcgtcatagtggacgttcctattcagtccgtntctnaagtagtcgagtcacatatctctggacacgtccagcaatctagttttcccagaatatgtagttctgtnacccggcgcgtgaccgacggttctttagttaccgtgtcggacgagtacgaacggtcttaattagtagttagttttagggagttggtttaatttccggtaactacccttaggtacgtacgggaccgggtctccgaccccggtcgggtacccgaagggaactacgtgtaccctacggtcctaccgttacgcccttaccgaccgtaacggccccgtattcccggttcccttccccggcgtccctaccccgtccgtaccaccggataccccgg

SEQ ID NO: 140851 - DNA, 538 bp, Homo sapiens
  misc_feature: GYAE6OF02H6P65.46.67.G01.1.454.CMB.1.raw
  modified_base (192)..(192): a, c, t, g, unknown or other
  misc_feature (192)..(192): n is a, c, g, or t
  modified_base (385)..(385): a, c, t, g, unknown or other
  misc_feature (385)..(385): n is a, c, g, or t
  modified_base (398)..(398): a, c, t, g, unknown or other
  misc_feature (398)..(398): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacacctatttaaattggtatcaacatagaccagggacgcccctaagctctaatctatgctgcatccagtttgcaaagtgggtcccatcgaggttcagtggcagtgatcgtgggacagtattcactctcacatcagtaatctagcaagtgaagtntttgactaacttntactgtacaacagtaattactaagttgtttaccggactaagggactaacggtactaaactaaacttaaacggaacttgtacggcttagacctaacctattcgtcgtacttacacttccttcccgactacttcgtagtaac

SEQ ID NO: 140852 - DNA, 632 bp, Homo sapiens
  misc_feature: GYAE6OF02J1OXA.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggtagtctcggtcaggacacagcatggacatgagggtcccgctcagctcctggggctcctgctactctggctccgaggtgccagatgtgacatcgagctgacccagtctccatcctccctgtctgcaaccgtgggagacagtgtcaccatcacttgccgggnaagtcggaacattgacactatttaaattggtaatcaacatagacagggacggacccctaagcctaccgtaatctaatgctagcaactccagtttagcaaaaggttggggtaccccaagtcggtaacggtttcaaggtggctagtggactcgtgggacagtagtttcaacgtctcgacctatcaacgtaattcagtacaacgttgaaggttactttggaacaactttagttaccttgttaaccgaataacgtaatttaactaagttacgtttttaccggaccgtaaacgggtacaaacggtaaccttaaaccgtaaaaacttaaaccgaattacgtacggtactacggtcccaaacgtacttactaccggttaacttcctacgtttcctaccccggtactaacgttcacgttaacc

SEQ ID NO: 140853 - DNA, 707 bp, Homo sapiens
  misc_feature: GYAE6OF02JYOI2.46.67.G01.1.454.CMB.1.raw
  modified_base (208)..(208): a, c, t, g, unknown or other
  misc_feature (208)..(208): n is a, c, g, or t
  modified_base (284)..(284): a, c, t, g, unknown or other
  misc_feature (284)..(284): n is a, c, g, or t
  modified_base (289)..(289): a, c, t, g, unknown or other
  misc_feature (289)..(289): n is a, c, g, or t
  modified_base (352)..(352): a, c, t, g, unknown or other
  misc_feature (352)..(352): n is a, c, g, or t
  modified_base (376)..(376): a, c, t, g, unknown or other
  misc_feature (376)..(376): n is a, c, g, or t
tcagactagcagtacacgaccggtgctcgatttagagtatacatattggtttgtcctcctgctggtggcagctcccagatgggtcctgtccctggtgcaactgcaggagtcgggcccacgactggtgaggccttcggagaccctgtccctcacctgcgctgtctctggtgcctcatcagtagtggtttcttcgtgggcttgggtccgnagctcccgagggtagggctggaactacgagttggaagttgtctcgtcataggtggagttcctattacgagtccgtntctanaagaggtcgatcaccgattactctctggactacgtccaggcaatctagttttcccagaaagtntgtaagttctagtcgacccggtcncgtagaccgtaggggtccctttttaagtcctagggtcgtacggacgtacgaccggtatttaacgtttagtcggtttagtttttacgggaggtttgtttaacgtttcgaaccttacccgttaagtacggtccgggtacgggtcccgttaccggaaccccggttcgggggtaccgtaacgggtaacgttccggttacgggtacctacccggttcctttaccgttccgacccgttacccgaacccgggtagggacccccttcggtccggttttaccccgttcccccgtggtccccctaaccccttccccgttccggaaccgtccgttaaccccg

SEQ ID NO: 140854 - DNA, 673 bp, Homo sapiens
  misc_feature: GYAE6OF02H42OY.46.67.G01.1.454.CMB.1.raw
  modified_base (254)..(254): a, c, t, g, unknown or other
  misc_feature (254)..(254): n is a, c, g, or t
  modified_base (292)..(292): a, c, t, g, unknown or other
  misc_feature (292)..(292): n is a, c, g, or t
  modified_base (351)..(351): a, c, t, g, unknown or other
  misc_feature (351)..(351): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctggggtccggcagctcccagggaaggggctgggaatacagttggaagtgtctntcatagtggaggttcctattacagtcgtctcgtcaagngtcggatcaccatatctctggacctacgtccaagcaatctaagttttcccagaaacgtntagtacgtttcttgcgacccgcgctaggaccacgggttctttattacgtggttcgacggtagacgacggtacttaattagtgttagttttggagttggttatttcgactacccgtagtacgtagggacgggtcctacggtaccccgttgggggaccctaacggggtaactaccggttcgggtccgtaaaccggtcccttacccgttagtaccccgttacccgtaaccggtaaccggtccccgtaacgttacccgggttccccttacccccggttcggacccttacccccgtcccgttacccgtaaccggtacctaaccccgg

SEQ ID NO: 140855 - DNA, 526 bp, Homo sapiens
  misc_feature: GYAE6OF02GLVS5.46.67.G01.1.454.CMB.1.raw
  modified_base (372)..(372): a, c, t, g, unknown or other
  misc_feature (372)..(372): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccgcagctcccgagggaaggggctggaatacattggaagtgtctctcatagtggatgttcctattacagtccgtctctcaagagtcgagtcaccatatctctggacacgtcagcaatcagttttcccngaagatgagttctgtgaccgcgctgacacgggtctttattactgtgcgagagacggctattatgtattttggagttggttatttcgactacctagatcgacgggctcggacccgtgggccagggatacgtcggtcctaccgtctccgtagtccc

SEQ ID NO: 140856 - DNA, 520 bp, Homo sapiens
  misc_feature: GYAE6OF02JMYV2.46.67.G01.1.454.CMB.1.raw
  modified_base (192)..(192): a, c, t, g, unknown or other
  misc_feature (192)..(192): n is a, c, g, or t
  modified_base (227)..(227): a, c, t, g, unknown or other
  misc_feature (227)..(227): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcgaacnttgacacctatttaaatgtatcaacatagacaggacggcccctaagctctaatctatgctgcatccagtttgactaaagtcggggtcccatcggaggttcagtggcagtggatcgtgggacagtatttcactctcaccatcataatctgctaacgtgaatatttagactaacttattactgtacaactagtaaattactaattgtttacgactaaggacacgactaaacaaattaaacgaactagtagactagactactactctcgtcttacacttcctccgctactctgtac

SEQ ID NO: 140857 - DNA, 533 bp, Homo sapiens
  misc_feature: GYAE6OF02GMCAI.46.67.G01.1.454.CMB.1.raw
  modified_base (503)..(503): a, c, t, g, unknown or other
  misc_feature (503)..(503): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatcgtgggacagtatttcactctcacatcagtaatctgcaacgtgaagtattttagactaacttattacttgtacaacagtaaattaacaattgttttacggaccgtaagggactaacgaacttaacaaaattaaacgaacttagtgactgacaccaatcgttntccttctatccttcccgcctattctgtaac

SEQ ID NO: 140858 - DNA, 548 bp, Homo sapiens
  misc_feature: GYAE6OF02GB8V9.46.67.G01.1.454.CMB.1.raw
  modified_base (211)..(211): a, c, t, g, unknown or other
  misc_feature (211)..(211): n is a, c, g, or t
  modified_base (374)..(374): a, c, t, g, unknown or other
  misc_feature (374)..(374): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctccatcagtagtgtttctcgtggggctgggtccgcagctcccgaggaaggggctggaatacattggaagtgtctctcatagtggaggttcctattacagtccgtctctcaagagtcgagtcaccatactctctggacacgtccagcaatctagttttcccngaagatgagttctgtgaccgccgctgacgacggtcgtttatactgtgcgagagacgctattatgtattttggagttggttatttcgactacccgtagacgtcggacggggctacggccccggtcgggaccgagggtaactacgtcggtcaccgttctccgttacgccctacccg

SEQ ID NO: 140859 - DNA, 509 bp, Homo sapiens
  misc_feature: GYAE6OF02GFMPY.46.67.G01.1.454.CMB.1.raw
  modified_base (499)..(499): a, c, t, g, unknown or other
  misc_feature (499)..(499): n is a, c, g, or t
  modified_base (506)..(506): a, c, t, g, unknown or other
  misc_feature (506)..(506): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatctgggacagatttcactctcaccatcagtaatctgcaacgtgaagtattttgactaacttattacttgtacaacagaattactaatgttttcggaccaagggtacacggtactacaaattaaacgaactagtagctgacacatctgtcttcatctccnctactcntac

SEQ ID NO: 140860 - DNA, 522 bp, Homo sapiens
  misc_feature: GYAE6OF02GW6WX.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattgtatcaacatagaccagggacggcccctaagctcctaatctatgctgcatccagtttgcaaagtgggtccatcgaggttcagtggcagtggatctgggacagatttcactctcaccatcagtaatctgcaacgtgaagtattttgactaacttattacttgtacaactagtaattacaattgttttacggaccgtaagggtacacgtacttaacaaattaaacgaactgtagtctgacacctatctagtcttcactccttcccgactactctatac

SEQ ID NO: 140861 - DNA, 532 bp, Homo sapiens
  misc_feature: GYAE6OF02I1FKK.46.67.G01.1.454.CMB.1.raw
  modified_base (254)..(254): a, c, t, g, unknown or other
  misc_feature (254)..(254): n is a, c, g, or t
  modified_base (389)..(389): a, c, t, g, unknown or other
  misc_feature (389)..(389): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaanatagaccagggacggcccctaagctcctaatctatgctgcatccagtttgcaaagtgggtcccagtcgaggttcagtggcagtggatcgtgggacagatttcactctcaccatcagttaatctgcaacgtgaatnttttgactaacttattactagtcaaacagtaattacaagttgtttacggaccaaagggacaacgtactaactaaacgttaaacgaacgtgtagctagacaactatcttacgtcttcacttccttcccacctacttctagtacg

SEQ ID NO: 140862 - DNA, 515 bp, Homo sapiens
  misc_feature: GYAE6OF02F5YX9.46.67.G01.1.454.CMB.1.raw
  modified_base (455)..(455): a, c, t, g, unknown or other
  misc_feature (455)..(455): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagtattttagctaacttattactgtacaacataattactaattgttttacgaccaagggacagacttaanaaattaaacgaactgtgctgctacatcttgtcttcattccttcccgcctacttctagtac

SEQ ID NO: 140863 - DNA, 530 bp, Homo sapiens
  misc_feature: GYAE6OF02G5LQX.46.67.G01.1.454.CMB.1.raw
  modified_base (255)..(255): a, c, t, g, unknown or other
  misc_feature (255)..(255): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaanatagaccagggacgcccctaagctcctaatctatgctgcatccagtttgacaagtgggtcccatcgagttcagtgcagtggatcgtgggacagatttcactctcacctatcagtaatctgcaacgtgaagtatttgactaattattactgtacaactagaaattactaatgttttacggacctaagggactaacgaacgtaacaaaattaaacgaacttagtacgacttgacaactatctgtactttacacttcctcccgactacgttctagtac

SEQ ID NO: 140864 - DNA, 534 bp, Homo sapiens
  misc_feature: GYAE6OF02IH072.46.67.G01.1.454.CMB.1.raw
  modified_base (333)..(333): a, c, t, g, unknown or other
  misc_feature (333)..(333): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctccagggaggggctggaatacattggaagtgtctctcatagtggaggttcctattacagtccgtctctcaagagtcgagtcaccatatctctggacacgtccagcaatctagttttcccngaagatgagttctgtcgaccgcgctgacacgggtgtttatactgtgcgagagacggctatatgtattttggagttgttattcgactaccctagatcggacgggctcgacccgtgggccagggaatcgtggtcaccgtctccttagccctcaccgaacggcccagtccgtccttccccgcgccaccctcctaccacgagccg

SEQ ID NO: 140865 - DNA, 513 bp, Homo sapiens
  misc_feature: GYAE6OF02HWLBO.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattgtatcaacatagaccagggacggcccctaagctcctaatctatgctgcatccagtttgcaaagtggggtcccatcgaggttcagtggcagtggatctgggacagatttcactctcaccatcagtaatctgcaacgtgaagtattttgctaacttattactgtacaacagaattacaattgtttcggaccaagggacacgactaacaaaattaaacgaactgtggctgacaccatctgtcttcacttccttcccgacctactctgtac

SEQ ID NO: 140866 - DNA, 508 bp, Homo sapiens
  misc_feature: GYAE6OF02G68WO.46.67.G01.1.454.CMB.1.raw
  modified_base (485)..(485): a, c, t, g, unknown or other
  misc_feature (485)..(485): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgcccctaagctcctaatctatgctgcatccagtttgcaaagtgggtcccatcgaggttcagtggcagtggatctgggacagatttcacttctcaccatcagtaatctgacaacgtgaagtattttagactaacttattactgtacaacagtaattacaattgtttacggactaagggacacgactaacaaattaaacgaatgagctagacacatctntacttcatctaccgcatctgtac

SEQ ID NO: 140867 - DNA, 537 bp, Homo sapiens
  misc_feature: GYAE6OF02GLMT4.46.67.G01.1.454.CMB.1.raw
  modified_base (249)..(249): a, c, t, g, unknown or other
  misc_feature (249)..(249): n is a, c, g, or t
  modified_base (370)..(370): a, c, t, g, unknown or other
  misc_feature (370)..(370): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccggnagctccagggagggctggaatacattggaagtgtctctcttagtggaggttcctattacagtccgtctctcaagagtcgagtcaccatatctctggacacgtccagcaatcagttttcccngaagatgagttctgtgaccgccgctgacacgggtcgtttattactgtgcgagagacggctattatgtattttggagttggttatttcgactacctagatcgacggggctcggacccgtggggccagggtaactacgtggtccaccgtctccgtacgccctcaaccgg

SEQ ID NO: 140868 - DNA, 560 bp, Homo sapiens
  misc_feature: GYAE6OF02HMZRO.46.67.G01.1.454.CMB.1.raw
  modified_base (329)..(329): a, c, t, g, unknown or other
  misc_feature (329)..(329): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccgcagctccagggagggctggaatacattggaagtgtctctcatagtggaggttcctattacagtccgtctctcaagagtcgagtcaccatatctctggacacgtccagcaatcagttttcccngaacgatgagttctgtgaccgcgctgacacgggtctttatactgtgcgagagacggctatatgtattttggagttggttatttcgactaccctagtacgtcgacggggtctcgaccccgttgggccgaagggtactacgttggtcctacgtcttccttacgcctaccgaccgaacggcccacgtccggtccttccccgtcggtaccaccccgtcctaccacgtactacccg

SEQ ID NO: 140869 - DNA, 618 bp, Homo sapiens
  misc_feature: GYAE6OF02H0A4K.46.67.G01.1.454.CMB.1.raw
  modified_base (288)..(288): a, c, t, g, unknown or other
  misc_feature (288)..(288): n is a, c, g, or t
  modified_base (334)..(334): a, c, t, g, unknown or other
  misc_feature (334)..(334): n is a, c, g, or t
  modified_base (339)..(339): a, c, t, g, unknown or other
  misc_feature (339)..(339): n is a, c, g, or t
  modified_base (359)..(359): a, c, t, g, unknown or other
  misc_feature (359)..(359): n is a, c, g, or t
  modified_base (365)..(365): a, c, t, g, unknown or other
  misc_feature (365)..(365): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggcctttcggagaccctgtccctcacctgcgctgtctctggtgcctccatcagtagtggtttctctggggctgggtccgcagctcccgagggagggctggaatacattggaagtgtctctcataggtggaggttcctattacagttccgtctctcaagngtcgagtcaccatatctctggacacgtcagcaatctagttttcccngaagntgagttctagtgaccgtcgntcgacncgggtcgtttatactgtcgacgtagagtacgcttagttatgtacgtttttggagttggtttatttacgactacccgtagtacgttcggacgggggtcctcggtaaccccgtggggaccgagggtaatacgtcggttccgaccggttccttccgttacgtccctccaacccgaacgggtccccagttcccggttaccgtttacccccgtcgggtccctaccccgttcccgtacccgtaacggtcgtaaccccgg

SEQ ID NO: 140870 - DNA, 512 bp, Homo sapiens
  misc_feature: GYAE6OF02JFYHF.46.67.G01.1.454.CMB.1.raw
  modified_base (303)..(303): a, c, t, g, unknown or other
  misc_feature (303)..(303): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccggcaagtcggaacattgacacctatttaaatggtatctaacatagaccaggacggcccctaagctcctaatctatgctgcatccagtttncaaagtgggtcccatcgaggttcagtggcagtgatctgggacagatttcactctcaccatcagtaatctgcaacgtgaagtattttagctaacttattactagtacaactagaattacaattgtttacgcaaggacacgactaacaaattaaaccgaatagtagctagactaccaatctagttctactataccttccgcctatctatac

SEQ ID NO: 140871 - DNA, 541 bp, Homo sapiens
  misc_feature: GYAE6OF02IEIR9.46.67.G01.1.454.CMB.1.raw
  modified_base (251)..(251): a, c, t, g, unknown or other
  misc_feature (251)..(251): n is a, c, g, or t
  modified_base (536)..(536): a, c, t, g, unknown or other
  misc_feature (536)..(536): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcacatcacttgccgggcaagtcggaacatgacactatttaaatggtatcaanatagaccagggacggcccctaagctcctaatctatgctgcatccagtttgacaaagtgggtacccatcgaggttcagtggcagtgatcgtggacagatttcactctcacatcagtaatctgctaacgtgtaagtattttgactaactttattacttagtacaaactagtaacttactaattcgtttacggaccgtaagggtaacaacgtaactaaactaaattaaacgtaacgtgtacgctacgacaaccatctcgtcttactactaccgttcccacctatcgtntaacg

SEQ ID NO: 140872 - DNA, 503 bp, Homo sapiens
  misc_feature: GYAE6OF02IL51Q.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgagttcagtggcagtggatctgggacagatttcactctcaccatcagtaatctgcaacgtgaagtatttgctaacttattactgtacaacagaattacaattgtttacggacctaaggacacgtactaacaaattaaacgaactgtagctgacacatctgtcttcattctccgcatctgtac

SEQ ID NO: 140873 - DNA, 504 bp, Homo sapiens
  misc_feature: GYAE6OF02G4F53.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatctgggacagatttcactctcaccatcagtaatctgcaacgtgaagattttgctaacttattactgtacaacagaattacaatgttttcggaccaagggacacgactacaaattaaacgaatgtagctgcgacatctgttcttcactcttcccgccatctgtac

SEQ ID NO: 140874 - DNA, 527 bp, Homo sapiens
  misc_feature: GYAE6OF02HT3WD.46.67.G01.1.454.CMB.1.raw
  modified_base (523)..(523): a, c, t, g, unknown or other
  misc_feature (523)..(523): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaatggtatcaacatagaccagggacgcccctaagctcctaatctatgctgcatccagtttgacaaagtcggggtacccagtcgaggttcagtggcagtgatcgtgggacagtatttcactctcaccatcagtaatctgacaacgtgaagtatttagactaaacttattactgtacaactagtaattacaattggtttacgacgtaaggacacgaactaacaaattaaacgaatgtagactgacaactatactgttcttactacttccttcccgacctatctntacg

SEQ ID NO: 140875 - DNA, 516 bp, Homo sapiens
  misc_feature: GYAE6OF02HM19F.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatctgggacagatttcactctcaccaccagtaatctgcaacgtgaagtattttgctaacttattactgtacaacagaattacaattgttttcgaccgtaagggacacgtaactacaaattaaacgaactagtagctagcaccatctgtcttcattccttccgcctatcctgatacg

SEQ ID NO: 140876 - DNA, 603 bp, Homo sapiens
  misc_feature: GYAE6OF02JJ1KZ.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattgtatcaacatagaccagggacggcccctaagctcctaatctatgctgcatccagtttgcaaagtgggtcccatcgaggttcagtggcagtggatcgtgggacagatttcactctcaccatcagtaatctgacaacgtgtaagtattttgactaaacttattactgtacaaacagtaattacaattcgttttacggacctaaaggggaactaacggtaacttaaacctaaaagtttaaaaccgaaaccttaggtacggtaccttagggaccctaaccgtaacttaccgttacggtttaccctttaactacgtttcccgtttacccccggtacctaactttacccgttaggtaaacccg

SEQ ID NO: 140877 - DNA, 576 bp, Homo sapiens
  misc_feature: GYAE6OF02GPZZL.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacacctatttaaattggtatcaacatagaccagggacggcccctaagcctacctaatctatgctgcatcctagtttgactaaaggtcgggtcccagtcgaggttcagtggcagtggatcgtagggacagtatttcactctacacctatcagtatctgactaagtgaagtatttgactaacttattactagtactaactagtaacttactaagttcgtttaccggacgtaagggtactaacgtaaccttaaacgtaaacttaaacgtaacgttcgtagtacttacgacctaacctattacgtacgttacttactacttccgttacccgacctacttcgtagtaacc

SEQ ID NO: 140878 - DNA, 553 bp, Homo sapiens
  misc_feature: GYAE6OF02GBB9D.46.67.G01.1.454.CMB.1.raw
  modified_base (526)..(526): a, c, t, g, unknown or other
  misc_feature (526)..(526): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgagggaaggggctggaatacattggaagtgtctctcatagtggaggttcctattacagtccgtctctcaagagtcgagtcaccatatctctggacacgtccagcaatcagttttcccagaagatgagttctgtgaccgccgctgacgacgggtctttatactgtgcgagagcggctattatgtattttggagttggttatttcgactaccctagactcggacggggtctcgacccgtggggccagggactacgtggtcaccgtctccgttacgcctccaccgaacggcccagtccggtccttccccgnggcccacccgtcctaccacgctacccg

SEQ ID NO: 140879 - DNA, 653 bp, Homo sapiens
  misc_feature: GYAE6OF02JEBJR.46.67.G01.1.454.CMB.1.raw
  modified_base (337)..(337): a, c, t, g, unknown or other
  misc_feature (337)..(337): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtgggctgggtccggcagcctcccgagggaagggctggaatacagttggaagtgtctctcatagtggaggttcctattacagtccgtctctcaagagtcgagtcaccatactctctggacacgtcagcaatctagttttcccngaagtatgagttctgtcgaccgccgctgacgcgggtctttatacgtgtgcgagagacggtacttagttattgttagttttggtagttaggtttactttaccgaacctacccgttaggtacgtaccgggtaccgggggtccttacccggtaccccgtcgggggaccgtaacggggtaaacttaaccgtcgggttacctacccggttccttaccgttacgtccctacccgtaacccgtaaccgggccctacggtccggttacccttcccccgtacggtcccctacccccgtacccgtaccgtaaccggtacctacccg

SEQ ID NO: 140880 - DNA, 546 bp, Homo sapiens
  misc_feature: GYAE6OF02GBAPJ.46.67.G01.1.454.CMB.1.raw
  modified_base (535)..(535): a, c, t, g, unknown or other
  misc_feature (535)..(535): n is a, c, g, or t
  modified_base (541)..(541): a, c, t, g, unknown or other
  misc_feature (541)..(541): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttccctgaagatgagttctgtgaccgccgctgacacggggctttatactgtgcgagagacggctattatgtatttttggagtggttatttcggcaccctagatcgacggggctcggaccccgtggggccaggggaatacgtgtcaccgtctccttagcctccaccgaacgggcccagtccggtccttcccccgtggcccaccctccncccagngcccg

SEQ ID NO: 140881 - DNA, 615 bp, Homo sapiens
  misc_feature: GYAE6OF02HCFG0.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctcctaatctatgctgcatccagtttgacgaaaggtcggggtcccatcgtaggttcaggtggcagtggatcgtgggacagatttcactctccaccatcaagttaactctgactaacggtagtaaagttattttgacttaactttattacttagtaccaactaagtaacttactaagtttcgtttaccggaccgtaaggggacctaacggtaacttaaaccgtaaaacgtttaaaaccggaacgttaggtcggtaccttgaacccgtaaccgtaactttaccgttacgttacctttacgttaccttcccgttaccccgtacctacgttccgtagtaacc

SEQ ID NO: 140882 - DNA, 565 bp, Homo sapiens
  misc_feature: GYAE6OF02FSLN0.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccaggggaagggctggaatacattggaagtgtctctcatagtggaggttcctattacagtccgtctctcaagagtcgagtcaccatatctctggacacgtccagcaatcagttttcccctgaagatgagttctgtgaccgccgctgacacggggcgttttattactgtgcgagagacggctattatgtatttttggagttggttatttcgacaccctagatcgacggggctcggaccccgtggggccgagggaatacgtggtcaccgtctccttacgcctccaccgaacgggcccacgtccggtccttcccccgtcggcctacccctccctacccaacggacgtacccg

SEQ ID NO: 140883 - DNA, 925 bp, Homo sapiens
  misc_feature: GYAE6OF02F22AA.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagccctccagagtcgggtcctcgtcccgtggtgacaactgcgaggtacggtccgggcccaacgtacgtgggtaggacggtcccgttacgggaaccgtaccccgttcgttccccctacctacccgtggccgtcgttcggttcccttcggttggggtccgtccccttacctaagttaccgtaaggtttacgggttttcggtttttccttcggggtcggggggtccgtttccggggggtccccggacgtacggtcccccgtacccgggaaggggggaacggggtcgtagggtaaactaacgtaggtttagggaacgttcggtccttcctactaaggttaggtagggtaccggtttaccttaagttaccgtacggttcccgtcttcgtacgaaaggtcgtacgtacgtaccaaccgtattactcctacgtacgggaacctaccgtaccagactaaactccgtttaccgttttcccgaaggtaaagtacgttaggtacgtttcgtcggtaccggaccccgtccggtacgttacggaaccggtacggggtttacttttaacgtccgttggtacggacggtaggaccggtaccggtactttaagttagttagtttaacggtttttgggaggtttttacgggttttaacgtttaccggaaaccccttaaccggttagtaccggttacccgggggaccggggttccctacccccgggtacccggggtacgggggtaacccgtaaaggggttaaccttccgggttaccgggtaccccgttacccggttccgtttaccccggttaccgtcccccgttaaccccggg

SEQ ID NO: 140884 - DNA, 557 bp, Homo sapiens
  misc_feature: GYAE6OF02FE6U4.46.67.G01.1.454.CMB.1.raw
  modified_base (342)..(342): a, c, t, g, unknown or other
  misc_feature (342)..(342): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccttgtccctcacctgcgctgtctctggtgcctccatcagtagtggtttcttcgtggggctggggtccggcagcctcccaggggaaggggctgggaatacattggaagtgtctctcatagtggaggttcctattacagtccgttctctcaagagtcgagtcaccatatctctggacacgtccagcaaatcagttttccccngaagatgagttctgtgaccgccgctgacacggggcgttttattacctgtgcgagagacggctattatgatttttgggagttggttattttcgacacccttagatcgacgggggctcggaccccgtggggccagggaatactggtcaccgtctcctagcctccaccgaacgggcccagtccggtcttcccccgtggccacccctcctccagcgacc

SEQ ID NO: 140885 - DNA, 519 bp, Homo sapiens
  misc_feature: GYAE6OF02F3CLN.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagtattttagctaacttattactgtacaactagtaattacaattgtttacggaccaagggtacacgactaacaaattaaacgaactgtgactgacacattctcgttcttacacttcttcccgacctatctgtac

SEQ ID NO: 140886 - DNA, 564 bp, Homo sapiens
  misc_feature: GYAE6OF02IPGCV.46.67.G01.1.454.CMB.1.raw
  modified_base (287)..(287): a, c, t, g, unknown or other
  misc_feature (287)..(287): n is a, c, g, or t
  modified_base (334)..(334): a, c, t, g, unknown or other
  misc_feature (334)..(334): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgagggagggctggaatacattggaagtgtctctcatagtggaggttcctattacagtccgtctctcaagngtcgagtcaccatatctctggacacgtccagcaatctagttttcccngaagatgtagttctgtcgaccgccgctgacgacgggtcgtttattactgtgcgagagacggctattatgtagttttggagttggttatttcgactacctagacgtcggacggggctcggacccgtgggccgagggaactacgtgtctaccgtctccgtacgcctaccgaccgaacggcccagtccgtccttccccgtcggccctaccccttccctaccgacgcgtacccg

SEQ ID NO: 140887 - DNA, 808 bp, Homo sapiens
  misc_feature: GYAE6OF02H8SBQ.46.67.G01.1.454.CMB.1.raw
  modified_base (194)..(194): a, c, t, g, unknown or other
  misc_feature (194)..(194): n is a, c, g, or t
  modified_base (203)..(203): a, c, t, g, unknown or other
  misc_feature (203)..(203): n is a, c, g, or t
  modified_base (746)..(746): a, c, t, g, unknown or other
  misc_feature (746)..(746): n is a, c, g, or t
  modified_base (772)..(772): a, c, t, g, unknown or other
  misc_feature (772)..(772): n is a, c, g, or t
  modified_base (800)..(800): a, c, t, g, unknown or other
  misc_feature (800)..(800): n is a, c, g, or t
tcagactagcagtacacgaccggtgctcgatttagagtatacatattgggtttgggagtctcggtcaggacacagcatggacatgagggtccccgctcagctcctggggctcctgctactctggctccgaggtgccagatgtgacatcgagcctgacccagtcctccatccctcctgtctgacaaccggtgganacctagtcnccactctacgtacggtcggaccggtactaaggtaccgtaacttactaccgtaacctttaactttaagtttaacgttacggtaacctaaccgtaaacgtacccggtaaaccggaacccgggtaaccccgggtaaccccgttaccccttaaccgttacccttaacttaaccgttcgttaacgccgttaacgtaccgttaccgtaccggtttacggtaacggtttaccggtaacgggtaccgggtttaccggtaccgttacggttacggttacggttacgggtagtaccggttaacgggttagttaccggttaacgttacgggtaactttaacgtttaccgtacctttaccgaccttacgtaaccttaaccgtacgttaacgttacttacgtacgttaacgtaagttaagtttaatttaatttaacttacttaacgttactaaccgtattaaagtacttaagttactacgttacgttaccggacgtaacggaactactaaacgtagtaactaacgttcgcgtacgtacgtctacgtccttaccttnttacccgttcttacctacctttaccncccgttataccgttcgtaatttacccgngttaaccg

SEQ ID NO: 140888 - DNA, 547 bp, Homo sapiens
  misc_feature: GYAE6OF02JDCLA.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttccctgaagatgagttctgtgaccgccgctgacacgggtcgtttatactgtgcgagagacggctattatgtatttttggagttggttatttcgactacctagatcgacggggctcggaccctggggccagggatacgtgtcaccgtctccttagcctccaccgaacgggcccagtccggtccttccccgtcggccacccctcctcccacgacgtcccg

SEQ ID NO: 140889 - DNA, 618 bp, Homo sapiens
  misc_feature: GYAE6OF02JCL67.46.67.G01.1.454.CMB.1.raw
  modified_base (343)..(343): a, c, t, g, unknown or other
  misc_feature (343)..(343): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccgcagctccgaggggaagggctggaatacgagttggaagtgtctctcataggtggaggttcctattacagtccgtctctcaagagtcgagtcacatatctctggacacgtccagcaatctacgttttccagaagtntgtagttctgtcgaccgtcgctgacgtacgggtctttagtacgtgtcgacgagacgacgtcttattagtgttagttttgggagttgtttagttcgactaccctagtacgtacggtacggggtctccggacccggtgggaccgtaaggggtactacgtcggtacccgtacgtccgttccgttacgccctaccgaaccggtaacgggtccctagttcccgggttcccttcccccggtacggccctaccccgttccgtacctaacggtccgtacccgg

SEQ ID NO: 140890 - DNA, 512 bp, Homo sapiens
  misc_feature: GYAE6OF02JC956.46.67.G01.1.454.CMB.1.raw
  modified_base (192)..(192): a, c, t, g, unknown or other
  misc_feature (192)..(192): n is a, c, g, or t
  modified_base (478)..(478): a, c, t, g, unknown or other
  misc_feature (478)..(478): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacacctatttaaatggtatcaacatagaccagggacgcccctaagctcctaatctatgctgcatccagtttgctaaagtggggtcccatcgaggttcagtggcagtggatcgtgggacagtatttcactctcacatcagtatctgacaacgtgaatatttgactaacttattactgtacaacagaattacaattgtttacgacgtaagggacacgtactaactaaataaacgaatgtagctagaccnctatctgtcttcattcctacccgctatctagtac

SEQ ID NO: 140891 - DNA, 574 bp, Homo sapiens
  misc_feature: GYAE6OF02HGCLU.46.67.G01.1.454.CMB.1.raw
  modified_base (304)..(304): a, c, t, g, unknown or other
  misc_feature (304)..(304): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgcccctaagctcctaatctatgctgcatccagtttncaaagtgggtcccatcgagttcagtgcagtgatctgggacagatttcactctcacatcagtaactctgcaacgtgaagtatttgactaacttattactgtacaactagtaattacaattcgtttaccggacctaagggtacctaacggtaaccttaaacgtaaaacgtttaaaaccgaacgttaggtacgggtacttacgaccgtaacctaattccgttacgttcctttacgtaactttcccgttaccccgacctacttccgtagtaacc

SEQ ID NO: 140892 - DNA, 585 bp, Homo sapiens
  misc_feature: GYAE6OF02H2BKZ.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgcccctaagctctaatctatgctgcatccagtttgcaaagtggggtcccagtcgaggttcagtggcagtgatctgggacagtattcactctcacatcagtaatctgacaacgtgaagtattttacgactaactttattactagtactaaacagtaaattaacaatttcgttttacggaccgtaaagggtacaaccggtaacctaaactaaaacgttaaaacgaaacgttgtacggtacgtcgtaccgaacctacgttacttacgtttacctttacctactttcccttccccgtacccttaacttccttagttaaccg

SEQ ID NO: 140893 - DNA, 587 bp, Homo sapiens
  misc_feature: GYAE6OF02I0BFD.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacactatttaaatgtatcaacatagaccagggacgcccctaagctcctaatctatgctgcatccagtttcgactaaagtcgggtccaagtcgaggttcagtggcagtggatcgtgggacagtagtttcactctacactatctagtatctagactaacgtgtaatatttgactaacgttattaacttgtacaactaagtaacttactaacgttgtttacggaacctaagggtaaccaaccggtaaccttaaactaaaagttaaaaccggaagttacgtaggaccttagacctaacccgtaatccgttacgttacctttacgacttaccgttaccccgtactaacttccgtagtaacc

SEQ ID NO: 140894 - DNA, 606 bp, Homo sapiens
  misc_feature: GYAE6OF02H4ZHE.46.67.G01.1.454.CMB.1.raw
  modified_base (341)..(341): a, c, t, g, unknown or other
  misc_feature (341)..(341): n is a, c, g, or t
  modified_base (347)..(347): a, c, t, g, unknown or other
  misc_feature (347)..(347): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttggccgggcaaggtcggaacattgacactatttaaattggtatcaacatagacagggacggccctaagctcctaatctatgctgcactccagtttgcaaaagtgggtccatcgaggttcagtggcagtgatntggacngatttcatctcacatcagtaatctcgactaacgtgtaagtattttgactaactttaattactagttactaaacaagtaaattacaaatttgtttttaccggaccgttaacgggaacctaacgtaaaccttaacgtaaaaacttaaaacgtaacgttaggttacggaccttacggtaccgtaacctaactttaccgttacggttacctttacctaacgttacccgttaccccggtacccttaattcccgttagttaaccg

SEQ ID NO: 140895 - DNA, 500 bp, Homo sapiens
  misc_feature: GYAE6OF02FKNU0.46.67.G01.1.454.CMB.1.raw
  modified_base (496)..(496): a, c, t, g, unknown or other
  misc_feature (496)..(496): n is a, c, g, or t
tcagactagcagtacacgaccggtgctcgatttagagtatacatattgggtttggggagtctcggtcaggacacagaatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaattggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagattttgctaacttattactgtcaacagaattacaatgtttcgcctaaggacacgactaacaaattaaacgaactgtgctgcacatctgtcttcatcttcccgcctatctnatac

SEQ ID NO: 140896 - DNA, 565 bp, Homo sapiens
  misc_feature: GYAE6OF02IDYT0.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaattggtatcaacatagaccagggacgcccctaagctcctaatctatgctgcatccagtttgcaaaggtcgggtccatcgaggttcagtgctagtgatcgtggacagatttcactctcaccatcagtaatctgactaagtgaagttatttgactaactttattacttagttacaactaagtaattactaattagttttaccggaccgtaaggacaacgtaacttaaactaaactttaaacgaacttagtacggtacgtacgactaacctacttcgtacgttcctttactacttcccgttacccgtacctacttccgtacgtaac

SEQ ID NO: 140897 - DNA, 544 bp, Homo sapiens
  misc_feature: GYAE6OF02JHOBE.46.67.G01.1.454.CMB.1.raw
  modified_base (374)..(374): a, c, t, g, unknown or other
  misc_feature (374)..(374): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggtccacgactggtgaggccttcggagaccctgtccctcacctgcgctgtctctggtgcctccatcagtagtggtttctctggggctgggtccggcagctcccgagggaaggggctggaatacattggaagtgtctctcatagtggaggttcctattacagtccgtctctcaagagtcgagtcaccatatctctggacacgtccagcaatcagttttcccngaagatgagttctgtgaccgccgctgacacgggtcgtttatactgtgcgagagacggctattatgtatttttggagttggtttatttcgactacccgtagtatcggacggggtctccggtaccccgtgggccagggaactacgtggtcaccgtctccttagccctacccg

SEQ ID NO: 140898 - DNA, 515 bp, Homo sapiens
  misc_feature: GYAE6OF02F5Q7L.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgagttcagtggcagtgatctgggacagattcactctcaccatcagtatctgcaacgtgaagtattttgactaacttattacttgtcaacaagtaattacaattgttttacggaccaagggacacgaactaacaaacttaaacgaactgtgctgacaaccatctcgtcttcacttcttcccgcctactctagtac

SEQ ID NO: 140899 - DNA, 546 bp, Homo sapiens
  misc_feature: GYAE6OF02H1NQ7.46.67.G01.1.454.CMB.1.raw
  modified_base (477)..(477): a, c, t, g, unknown or other
  misc_feature (477)..(477): n is a, c, g, or t
  modified_base (490)..(490): a, c, t, g, unknown or other
  misc_feature (490)..(490): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgagggaaggggctggaatacagttggaagtgtctctcatagtggaggttcctattacagtccgtctctcaagagtcgagtcaccatatctctggacacgtccagcaaatctacgttttccctgaagatgtagttctgtgaccgccgctgacgacgggtcgttttattactgtgcgagagacggcttattagtgtattttggagttggtttattcgactaccctagatcgacgggctcgacccgtgggcaggatacgtgcncgtctctacgccncacgaacggcccagtccggtcctccccgtcggcctcccctcctccacgcgtacccg

SEQ ID NO: 140900 - DNA, 550 bp, Homo sapiens
  misc_feature: GYAE6OF02HTFKG.46.67.G01.1.454.CMB.1.raw
  modified_base (333)..(333): a, c, t, g, unknown or other
  misc_feature (333)..(333): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctccagggaaggggctggaatacattggaagtgtctctcatagtggaggttcctattacagtccgtctctcaagagtcgagtcaccatatctctggacacgtccagcaatcagttttcccngaagatgagttctgtgaccgccgctgacacgggcgtttattactgtgcgagagacggctattatgtattttggagttggttatttcgactaccctagatcggacggggctcgaccccgtgggccgagggaactacgtggtcaccgtctccttagccctccaccgaacggcccagtccggtccttccccgtcggccacccctcctaccacgacacccg

SEQ ID NO: 140901 - DNA, 582 bp, Homo sapiens
  misc_feature: GYAE6OF02GLZIA.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgcccctaagctcctaatctatgctgcatccagtttgcaaaggtgggtcccatcgaggttcagtggcagtggatcgtggactagatttcactctcaccatcagtaatctgctaacgtgaagtatttagactaactttattacttgtacaactagtaattaactaaagtttcgttttaccggaccgtaagggtaacctaacgtaaccttaaactaaaagttaaaccgtaaacgttacggtacggacttacgactaaccctaattccgttagttacctttactacttcccttaccccgacctacttcctagtaaccg

SEQ ID NO: 140902 - DNA, 533 bp, Homo sapiens
  misc_feature: GYAE6OF02JIWDU.46.67.G01.1.454.CMB.1.raw
tcagactagcagtacacgaccggtgctcgatttagagtatacatattggggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggacattgacacctatttaaatgtatcaacatagaccaggacgcccctaagctcctaatctatgctgcatccagtttgcaaagtgggtcccatcgaggttcagtgcagtggatcgtgggacagatttcactctcaccatcagtaatctgcaacgtgaagtatttgactaacttattactgtacaacagtaattacaatttcgtttacggacctaagggactaacgtaacttaacaaaatttaaacgaacttggtaggtactagacaacctattctacgtactttacacttccttacccgctatctgtaac

SEQ ID NO: 140903 - DNA, 511 bp, Homo sapiens
  misc_feature: GYAE6OF02I1RJN.46.67.G01.1.454.CMB.1.raw
  modified_base (500)..(500): a, c, t, g, unknown or other
  misc_feature (500)..(500): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgcccctaagctcctaatctatgctgcatccagtttgcaaagtggggtcccatcgaggttcagtggcagtggatctgggacagattcactctcaccatcagtaatctgcaacgtgaagtattttagctaacttattactgtacaacagaattacaattgttttacggacctaagggacacgactactaaattaaacgaactagtgactagacaccatctgtcttcatcttccnctactctgtac

SEQ ID NO: 140904 - DNA, 536 bp, Homo sapiens
  misc_feature: GYAE6OF02G68M0.46.67.G01.1.454.CMB.1.raw
  modified_base (430)..(430): a, c, t, g, unknown or other
  misc_feature (430)..(430): n is a, c, g, or t
  modified_base (534)..(534): a, c, t, g, unknown or other
  misc_feature (534)..(534): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccgcagctcccagggaaggggctggaatacattggaagtgtctctcatagtggaggttcctattacagtccgtctctcaagagtcgagtcaccatatctctggacacgtccagcaatcagttttcccagaagatgagttctgtgaccgccgctgacacgggtcgtttattactgtgcgagagacggctattatgtattttggagttgttattcgactaccctagntcggcggggctcgacccgtgggccagggatacgtgtcaccgtctcctacgcctccaccgaacggcccagtccgtccttccccgtggtccaccctccctccagcncc

SEQ ID NO: 140905 - DNA, 523 bp, Homo sapiens
  misc_feature: GYAE6OF02F7H26.46.67.G01.1.454.CMB.1.raw
  modified_base (500)..(500): a, c, t, g, unknown or other
  misc_feature (500)..(500): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagcttctaatctatgctgcatccagtttgcaaagtggggtcccatcgaggttcagtggcagtggatctgggacagatttcactctcaccatcagtaatctagcaacgtgaagattttgactaacttattactgtacaaacagtaattacaattgttttaccggacaagggtacaacgacttaacaaaattaaacgaacttgtagctgacctacatctagtcttnacttccttcccgcacttctgtac

SEQ ID NO: 140906 - DNA, 581 bp, Homo sapiens
  misc_feature: GYAE6OF02JY6Z2.46.67.G01.1.454.CMB.1.raw
  modified_base (252)..(252): a, c, t, g, unknown or other
  misc_feature (252)..(252): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggagacagtgtcaccatcacttgccgggcaagtcgacattgacactattaaatgtatcaacatanacaggacgccctaagcctctaatctatgctgcatccagtttgctaaagtcgggtccagtcgagttcagtgctagtcgatcgtggacaggtatttcgactctcaccgtatcgagtaatctagactaacgtagaagtattttagactaaaccttattaacgttcgtaacgtaactagtaaacttataaacgtttggttttaccgaccgtaaacgggtactaaccggtaactttaaactaaacgtttaaaacgaaccgttaggtacggtactcggtacaaccgtattaccgtcgttcttacgtaacttccttaccgtaccaattccgagtac

SEQ ID NO: 140907 - DNA, 523 bp, Homo sapiens
  misc_feature: GYAE6OF02I4GQD.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatctgggacagatttcactctcaccatcagtaatctgacaacgtgaagtattttgctaactttattacttagtacaacagaattacaattagttttcggaccgtaagggacacgtactaacaaattaaacgaactagtaggctagcacctatctgtacttcattccttccgacctatctgtac

SEQ ID NO: 140908 - DNA, 637 bp, Homo sapiens
  misc_feature: GYAE6OF02IW580.46.67.G01.1.454.CMB.1.raw
  modified_base (199)..(199): a, c, t, g, unknown or other
  misc_feature (199)..(199): n is a, c, g, or t
  modified_base (256)..(256): a, c, t, g, unknown or other
  misc_feature (256)..(256): n is a, c, g, or t
  modified_base (289)..(289): a, c, t, g, unknown or other
  misc_feature (289)..(289): n is a, c, g, or t
tcagactagcagtacacgaccggtgctcgatttagagtatacatattgggggtttggggagtcgtcgggtcaggacacagcatggacatgagggtcccgctcaggctcctggggctctgctactctggctccgaggtgccagagtgtggaccatcgagcctgacccagtctccatcctccctgtctggcaccgtggganacagtgtcaccatcacttgccggcaagtcggaacattgacactattaattgatcaanatagacaggacgccctaagctacctaactctangctgcactccagtttcgactaaggtcgggtcccagtcgagttacagtgactgtggacttcgaggtacaggtactttacacgtcctcgaccacgtctaagttactcgtacgacgtaacggtagaagttacgttttcggacttaactttagtttacttagttaccaactacgtaatttactaagtttacgttttacggaaccgtaaacggtaccgtaacgtaaccgttaaactaaacgtttaaaccgtaacggtacggttacggaccgttacggaccgtaaccgtaactttcgttaacgttccttaaccgtacgttacccgttacccgccgtaaccgttcttacgtaccg

SEQ ID NO: 140909 - DNA, 690 bp, Homo sapiens
  misc_feature: GYAE6OF02F4FWI.46.67.G01.1.454.CMB.1.raw
tcagactagcagtacacgaccggtgctcgatttagagtatacatattgggtttgggggagttctcggtcaggacacgacgccatggacagtagagggtcccgactcacgctccgtcgggctcctgctacgtcgtggctccgaggtgccacgatcgtgacatcgacgctgacccgagtcgtcccagtcctcccgtgtactcgtcgaaccgtcggagaccagtgtcaccatcacttgccgggtcaacgtccgaacattgacacctatttaaattggttagtcaacgatacgaccgacgggacggaccccgtaagcgtactagtctagtgctgcatccgtaggtttcgactaaaggttcgggtacccacgttccgtaaggttcacggtcggactaggtggactcgtagggaacaagtacgtttacaactaccttacacctactacgaagtactctagtctaacgtagaacgtagtttcgactaaccgttacttaacgtagtactaacgtacgtaacttacgaaagttcggtttaccggacgtaaagggtaccttaacggtaaccttaaacgaaaactttaaaccgggaaccttacgggttacggtacctacggacccgtaaccctacttccgtaccgttaccttaccgaccgtttcccgtaccccgacttacccggttaccgtaccgtaaccg

SEQ ID NO: 140910 - DNA, 550 bp, Homo sapiens
  misc_feature: GYAE6OF02HCE53.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaattggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagtattttgactaacttattactgtacaactagtaattactaattgttttacggacctaaagggacaacgtaacttaactaaaacttaaacgaacttaggtaggtactagacaacctaatcgttagttacctttactacttccttccccgacctacttctagtaac

SEQ ID NO: 140911 - DNA, 558 bp, Homo sapiens
  misc_feature: GYAE6OF02GBF2B.46.67.G01.1.454.CMB.1.raw
  modified_base (334)..(334): a, c, t, g, unknown or other
  misc_feature (334)..(334): n is a, c, g, or t
  modified_base (530)..(530): a, c, t, g, unknown or other
  misc_feature (530)..(530): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttcccngaagatgagttctgtgaccgcgctgacacgggtctttattactgtgcgagagacggctattatgtattttggagttggttatttcgactaccctagatcggacggggctccgacccgtggggccaggggaactacgtggtacaccgttctccgttagccctccaccgaacgggcccctagtccggtccttccccgnggccctacccctcctacccagctacccg

SEQ ID NO: 140912 - DNA, 534 bp, Homo sapiens
  misc_feature: GYAE6OF02ID2IA.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcgaacatgacactattaaattgtatcaacatagaccagggacgcccctaagctcctaatctatgctgcatccagtttgcaaagtgggtcccatcgaggttcagtggcagtggatctgggacagatttcatctcaccatcagtaatctgcaacgtgaagtattttgactaactttattacttagttacaactaagaaattacaaattcgttttacgaccgaaggaacacgaacttaacaaaattaaacgaacttgtaggtactaggaccaactatctcgttaccttctacttccgttcccacctattctgtaac

SEQ ID NO: 140913 - DNA, 533 bp, Homo sapiens
  misc_feature: GYAE6OF02IB45J.46.67.G01.1.454.CMB.1.raw
  modified_base (329)..(329): a, c, t, g, unknown or other
  misc_feature (329)..(329): n is a, c, g, or t
  modified_base (375)..(375): a, c, t, g, unknown or other
  misc_feature (375)..(375): n is a, c, g, or t
  modified_base (405)..(405): a, c, t, g, unknown or other
  misc_feature (405)..(405): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggcctttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagngtcgagtcaccatatctctggacacgtccagcaatcagttttcccngaagatgagtttctgtgaccgccgctgacncgggcgtttattactgtgcgagagacgctattatgtatttttggagttggtttatttcgactaccgtagatcgacggggctccgcccgtgggccagggatcgtggtcaccgtctccttacgcctaccg

SEQ ID NO: 140914 - DNA, 558 bp, Homo sapiens
  misc_feature: GYAE6OF02GS64R.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatctgggacagatttcactctcacatcagtaactctgacaacgtgaagtatttgactaacttattactgtacaactagaaattactaattcgttttacggaccgtaagggactaacggaacttaaactaaaacgttaaacgtaactagtaggtctagacctaactacttctacgttccttacgtactttccttaccccgacctacttccgtagtaaccg

SEQ ID NO: 140915 - DNA, 546 bp, Homo sapiens
  misc_feature: GYAE6OF02GSKK9.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatctgggacagatttcactctcaccatcagtaatctgcaacgtcgaagtattttgactaacttattactgtacaaacagtaattacaattcgttttacggaccgtaagggaactaacgtaactaaactaaaagtttaaaccgaaacttagtaggactgactaaccacttcgtgttcctttcacttccttcccgacctatcctagtac

SEQ ID NO: 140916 - DNA, 561 bp, Homo sapiens
  misc_feature: GYAE6OF02G998H.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctccagggaagggctggaatacattggaagtgtctctcatagtggaggttcctattacagtccgtctctcaagagtcgagtcaccatactctctggacacgtccagcaatctacgttttcccagaacgtatgtagttctgtcgaccgcgctgacgtacgggtctttatcgtgtgcgagacgacgtctattagtgttagttttggagttggtttacgttcgtactaccgtagtacgtcgggacgggctaccgcccggtgggccgaggtatacgtgtccgacgtctcgtacgcctccaccgacggcccagtccgtcccttcccgtcgcccaccctcctaccacgcgtaccg

SEQ ID NO: 140917 - DNA, 570 bp, Homo sapiens
  misc_feature: GYAE6OF02I18PK.46.67.G01.1.454.CMB.1.raw
  modified_base (218)..(218): a, c, t, g, unknown or other
  misc_feature (218)..(218): n is a, c, g, or t
  modified_base (251)..(251): a, c, t, g, unknown or other
  misc_feature (251)..(251): n is a, c, g, or t
  modified_base (353)..(353): a, c, t, g, unknown or other
  misc_feature (353)..(353): n is a, c, g, or t
  modified_base (436)..(436): a, c, t, g, unknown or other
  misc_feature (436)..(436): n is a, c, g, or t
tcagactagcagtacacgaccggtgctcgatttagagtatacatattgggtttggggagtctcggtcaggacacagcatggacatgagggtcccgctcagctcctggggctcctgctactctggctccgaggtgccagatgtggcatcgagctgacccagtctccatcctccctgtctgcaaccgtgggagacagtgtcaccatcacttggccgggtnaagtcggaacattgacacctatttaaatgtatnaacatagacagggacgcccctaagctcctaatctatgctgcatccagtttgcaaagtggggtcccatccgaggttccagtggacagtgggatcgtgggaacngatttcgactctacaccatcagtatctcgacaacgtgaagattttagctaacttattacttgtactaacataagttacaagtnttttacggactaaacgggtacacgaacttaacgaaattaaaccgaacttacgtagtcctacgtaccaacgtaactccgttagttacctttacgtaacttccgttaccccgtaccctaacttacctacggttaac

SEQ ID NO: 140918 - DNA, 538 bp, Homo sapiens
  misc_feature: GYAE6OF02HHAPZ.46.67.G01.1.454.CMB.1.raw
  modified_base (192)..(192): a, c, t, g, unknown or other
  misc_feature (192)..(192): n is a, c, g, or t
  modified_base (376)..(376): a, c, t, g, unknown or other
  misc_feature (376)..(376): n is a, c, g, or t
  modified_base (515)..(515): a, c, t, g, unknown or other
  misc_feature (515)..(515): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacacctatttaaattggtatcaacatagaccagggacggcccctaagctacctaatctatgctgcatccagtttgacaaagtggggtcccatcgaggttcagtggcagtggatcgtggacagtatttcactctcacatcagtatntgacaagtgaagtattttagactaacttattactagtacaacaagtaattactaattcggttttacggacctaagggacaacgaacttaactaaaacttaaacgaacttgtagctagaccgtaactatctagttcttanacttcctcccactactctagtac

SEQ ID NO: 140919 - DNA, 603 bp, Homo sapiens
  misc_feature: GYAE6OF02JEJJ2.46.67.G01.1.454.CMB.1.raw
  modified_base (435)..(435): a, c, t, g, unknown or other
  misc_feature (435)..(435): n is a, c, g, or t
tcagactagcagtacacgaccggtgctcgatttagagtatacatattgggtttgtcctcctgctggtggcagctcccagatgggtcctgtccctggtgcaactgcaggcgtcgggcccacgactggtgaggccttcggagaccctgtccctcacctgcgctgtctctggtgcctccatcagtagtggtttcttcgtggggctgggtccggcagcctccgagggaagggctggaatacagttggagtgtctctcagtagtggaggttcctattacagtccgtctctcaagagtcgagtcaccatatctctggacacgtccagcaatctacgttttcccagaacgatgtagttctgtgaccgcgctgacagggtctttatactgtgcgtagagtacggctattatgtatttggtagttgttattcgaactacctagngtcggacgggtcctacggacccgtgggaccgaggtaacgtaccgttcggtacctaccggttcctacgttaccgccctacccgtaccggaaaccgggtccctaacgttcccggtccctttaccccccgtcgggtacccctaccccgtccctaccgtaacgcgtaccccg

SEQ ID NO: 140920 - DNA, 560 bp, Homo sapiens
  misc_feature: GYAE6OF02GGISO.46.67.G01.1.454.CMB.1.raw
  modified_base (334)..(334): a, c, t, g, unknown or other
  misc_feature (334)..(334): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaagggctggaatacattggaagtgtctctcatagtggaggttcctattacagtccgtctctcaagagtcgagtcaccatatctctggacacgtccagcaatcagtttttcccngaagatgagttctgtgaccgccgctgacacgggctttattactgtgcgagagacggctattatgtatttttggagttggttatttcgactacccttagatcggacggggtctcgacccgtggggccagggaatacgtggtcaccgtctccgttagcctccaccgaacggccctacgtccggtccttcccccgtcggccctaccccttcctacccgacgcgtacccg

SEQ ID NO: 140921 - DNA, 563 bp, Homo sapiens
  misc_feature: GYAE6OF02HWNNQ.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgagggagggctggaatacattggaagtgtctctcatagtggaggttcctattacagtccgtctctcaagagtcgagtcaccatatctctggacacgtccagcaatctagttttccctgaacgatgagttctgtgaccgccgctgacacgggtcgtttattactgtgcgagagacggtctattatgtagtttttggagttggttatttcgactaccctagactcggacggggctcggaccccgtggggcccgagggaatacgtggtcaccgtctccttacgccctccaccgaacggcccacgtccgttccttccccgtcggccacccctcctaccacgacgtacccg

SEQ ID NO: 140922 - DNA, 535 bp, Homo sapiens
  misc_feature: GYAE6OF02HI1UO.46.67.G01.1.454.CMB.1.raw
  modified_base (511)..(511): a, c, t, g, unknown or other
  misc_feature (511)..(511): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcgaacattgacactattaatgtatcaacatagaccagggacgcccctaagctcctaatctatgctgcatccagtttgacaaagtcgggtcccatcgaggttcagtggcagtggatcgtgggacagtatttcactctcaccatcagtactctgactaacgtagtaagtatttagactaacttattactgtacaatagtaattactaattgtttacggacctaagggtaccaacgtaactaactaaacgtaaacgaacgtagtacgactacgacctaacattctcgtacttnacttcctcccgactactctagtac

SEQ ID NO: 140923 - DNA, 547 bp, Homo sapiens
  misc_feature: GYAE6OF02H9UVP.46.67.G01.1.454.CMB.1.raw
  modified_base (302)..(302): a, c, t, g, unknown or other
  misc_feature (302)..(302): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagacagggacgcccctaagctctaatctatgctgcatccagtttncaagtgggtccatcgaggttcagtgcagtggatctgggacagatttcactctcacatcagtaatctagactaacgtgtaaagtattttagactaaactttaattaacttcgtacaaacagtaaacttactaaattgttttaccggaccgtaagggtaaccacggtaactaaactaaataaaacgaacgttagtagactagctaacattcgtgttactctacttccttcccgactattactgtaac

SEQ ID NO: 140924 - DNA, 556 bp, Homo sapiens
  misc_feature: GYAE6OF02IWVF8.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaatggtatcaacatagaccagggacgcccctaagctcctaatctatgctgcatccagtttgcaagtgggtcccatcgaggttcagtggcagtggatctgggacagtatttcactctcaccatctagtaactctgacaacgtgaagtatttgactaaactttattacttagtactaacgtagtaattaactaattgttttacggtaccgaaagggtacctaacgtactaaactaaaattaaacgaaacgttagtagtctagtaccaacctattctcgttctttactaacttcccttacccgactacttcgtagtac

SEQ ID NO: 140925 - DNA, 559 bp, Homo sapiens
  misc_feature: GYAE6OF02IZU86.46.67.G01.1.454.CMB.1.raw
  modified_base (334)..(334): a, c, t, g, unknown or other
  misc_feature (334)..(334): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttcccngaagatgagttctgtcgaccgccgctgacacgggtcgtttatactgtgacgagagacggctattatgtattttggtagttggttatttccgactacccgttagtagtcgaccgggggtcctccggacccgtcggggaccgagggaactacgtggtccaccgtctcgttacgcctccaccgacggcctatccggtcttccgactcggcccaccctcctaccacgac

SEQ ID NO: 140926 - DNA, 534 bp, Homo sapiens
  misc_feature: GYAE6OF02ID9NO.46.67.G01.1.454.CMB.1.raw
  modified_base (372)..(372): a, c, t, g, unknown or other
  misc_feature (372)..(372): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaagggctggaatacattggaagtgtctctcatagtggaggttcctattacagtccgtctctcaagagtcgagtcaccatatctctggacacgtcagcaatctagtttcccngaagatgagttctgtcgaccgcgctgactacgggtctttatactgtgcgagacgacgtctattatgtattttggagttgttattcgtacacctagatcggacgggtctccggacccgtgggccaaggactacgtcggtacaccgtcctaccttgccctaccg

SEQ ID NO: 140927 - DNA, 496 bp, Homo sapiens
  misc_feature: GYAE6OF02HGZ37.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatctgggacagatttcactctcaccatcagtaatctgcaacgtgaagattttgcaacttattactgtacaacagaattacaattgtttcgaccaagggacacgactacaaattaaacgactgtgctgcacatctgtcttcatcttccgcatctgtac

SEQ ID NO: 140928 - DNA, 505 bp, Homo sapiens
  misc_feature: GYAE6OF02FJFYI.46.67.G01.1.454.CMB.1.raw
  modified_base (495)..(495): a, c, t, g, unknown or other
  misc_feature (495)..(495): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgtcgggcaagtcggaacattgacacctatttaaattggtatcaacatagaccagggacggcccctaagctcctaatctatgctgcatccagtttgcaaagtggggtcccatcgaggtttcagtggcagtggatctgggacagatttcactctcaccatcagtaatctgcaacgtgaagattttgctaacttattactgtcaacagaattacaattgttttcgaccaagggacacgactaacaaattaaacgaactgtagctgcaccatctgtcttcatcttcccncctatctgac

SEQ ID NO: 140929 - DNA, 701 bp, Homo sapiens
  misc_feature: GYAE6OF02IZYI8.46.67.G01.1.454.CMB.1.raw
  modified_base (119)..(119): a, c, t, g, unknown or other
  misc_feature (119)..(119): n is a, c, g, or t
  modified_base (228)..(228): a, c, t, g, unknown or other
  misc_feature (228)..(228): n is a, c, g, or t
  modified_base (238)..(238): a, c, t, g, unknown or other
  misc_feature (238)..(238): n is a, c, g, or t
  modified_base (261)..(261): a, c, t, g, unknown or other
  misc_feature (261)..(261): n is a, c, g, or t
tcagactagcagtacacgaccggtgctcgattttagagtatacatagttggggtttggggagtctacggtcaggacgaacagctatggacatgaggtcccgctccagctcctggggacncctgacgtactcctggctccgtacggtcgtccgagagtggtcggacgacttcggagtcgtcgaccctacgtctccatccgtccctggtctggcaaccgtgggacgacgngtggtcacgntcgacttcggccggcagtcgacncttgacacctatttaacgttggtactacaactctagaccagggtaccgccctaagcttcctagtctacgtcgcctcgacgtaccgtcgtaaggttcgacggaacggttcggggtcccagtccgtaaggtttcgagttcggacgtaggtaggggtattcgtacggtactacgtacgtttccaacttctacgacctagtacctacgtaacttcgtacgtacgaacgttagaacgtatttacgactaacgtttattcgtcgttacaacgtagtaacttacgtacgtttcggtttcgaacccgaacggggtacctaacggaaccttaaaccgtaaaccgttaaacgtaacgtttcgtcggtacgtacggtacaaccggttactcggtacgttacccgtttaaccaccgtttacctacccggttacaaccgttcgtacggtaccg

SEQ ID NO: 140930 - DNA, 538 bp, Homo sapiens
  misc_feature: GYAE6OF02GS2S1.46.67.G01.1.454.CMB.1.raw
  modified_base (374)..(374): a, c, t, g, unknown or other
  misc_feature (374)..(374): n is a, c, g, or t
  modified_base (519)..(519): a, c, t, g, unknown or other
  misc_feature (519)..(519): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctgacacgtccagcaatctagttttcccngaagatagtagttctgtcgaccgccgcgtcgtacgacgggtcgtttattactgtgcgagagacgtctattagtgtagttttggagttgtttattcgactacctagatcggacgggctccggcccgtgggcgacggatcgtggtcnccgtctcgtacgcctaccg

SEQ ID NO: 140931 - DNA, 538 bp, Homo sapiens
  misc_feature: GYAE6OF02GPHP8.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacgcccctaagctcctaatctatgctgcatccagtttgcaaagtgggtcccatcgagttcagtgcagtgatcgtgggacagattcactctcaccatcagtatctgcaacgtgaagtatttgactaacttattactgtacaactagtaacttacaattgtttacggaccgtaaggacacgaacttaacgaaattaaacgtaatcgtaggacttacgactaactacttactagttaccttactacgttccttacccgcctacgttcctagtaacg

SEQ ID NO: 140932 - DNA, 541 bp, Homo sapiens
  misc_feature: GYAE6OF02IWQ4K.46.67.G01.1.454.CMB.1.raw
  modified_base (332)..(332): a, c, t, g, unknown or other
  misc_feature (332)..(332): n is a, c, g, or t
  modified_base (393)..(393): a, c, t, g, unknown or other
  misc_feature (393)..(393): n is a, c, g, or t
tcagactagcagtacacgaccggtgctcgatttagagtatacatattgggtttgtcctcctgctggtggcagctcccagatgggtcctgtccctggtgcaactgcaggagtcgggaccacgactggtgaggccttcggagaccctgtccctcacctgcgctgtctctggtgcctccatcagtagtggtttcttctggggctgggtccggcagctccagggagggctggaatacattggaagtgtctctcatagtggaggttcctattacagtccgtctctcaagagtcgagttcaccatatctctggacacgtccagcaatcagttttcccngaacatgagttctgtgaccgccgctgacacgggcttttatactgtgcgagagacgctattntgtattttggagttggttatttcgacacctagatcggacgggctcgacccgtgggaccagggaatacgtgtcaccgtctccttagccctaccaccgaacggcccagtccgtccttccccgtcgccaccctccctaccacgcgtacccg

SEQ ID NO: 140933 - DNA, 532 bp, Homo sapiens
  misc_feature: GYAE6OF02GJUX3.46.67.G01.1.454.CMB.1.raw
  modified_base (211)..(211): a, c, t, g, unknown or other
  misc_feature (211)..(211): n is a, c, g, or t
  modified_base (248)..(248): a, c, t, g, unknown or other
  misc_feature (248)..(248): n is a, c, g, or t
  modified_base (370)..(370): a, c, t, g, unknown or other
  misc_feature (370)..(370): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttctctggggctgggtccgnagctccagggagggctggaatacattggaagtgtctctcatagtggaggttcctattacagtccgtctctcaagagtcgagtcaccatatctctggacacgtccagcaatctagttttcccngaagatgtagttctgtgaccgcgctgacacgggtctttatactgtgcgagagacgctattatgtattttggagttggttatttcgactaccgtagagtcggacgggctccggacccgtgggccgagggactacgtggtccaccgtctccgtacgcctacccg

SEQ ID NO: 140934 - DNA, 613 bp, Homo sapiens
  misc_feature: GYAE6OF02HEAZF.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacactatttaaatgtatcaacatagaccaggacgcccctaagctcctaatctatgctgcatcctagtttgcaaagtcgggtcccatcgaggttcagtggcagtggatcgtgggacagtactttcactctacaccatacaagttaatctagactaacgtagtaagtattttgactaaactttattactagtaccaaacgtagtaaattactaattcggtttaccggacccgtaaaggggtaccaacggtaaccttaaacgtaaaacgtttaaaaccgaacgttaggttaacggacgttacgaaccctaacctacgttaccgttacgttacctttaccgtaacgtttcccgttaccccgacccgtactttaccgtaggttaacc

SEQ ID NO: 140935 - DNA, 500 bp, Homo sapiens
  misc_feature: GYAE6OF02HN9YS.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggagacagtgtcaccatcacttgccggcaagtcggaacattgacacctatttaaattgtatcaacatagaccaggacgcccctaaagctcctaatctatgactgcatccagtttgcaaagtgggtcccatcgagttcagtgcagtgatctggacagatttcacgtctcaccatcagtatctgacaacgtgaagtatttgctaacttattactgtacaactagaacttacaattgtttcggacctaaggacacgactacgaaattaaacgaactgtgctgacacatctgtcttcgatcctccgctatctagtac

SEQ ID NO: 140936 - DNA, 590 bp, Homo sapiens
  misc_feature: GYAE6OF02GBUL2.46.67.G01.1.454.CMB.1.raw
  modified_base (349)..(349): a, c, t, g, unknown or other
  misc_feature (349)..(349): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatgtatcaacatagaccagggacgcccctaagctctaatctatgctgcatccagtttgacaaagtgggtcccagtcgtaggttcagtggcagtggatcgtaggganagtattcactctcaccatacagtaatctcgactaacgtagtaagttatttagactaaactttatacttgtaactaactaataattaactaagtttcgtttacggaccgtaaagggaacctaacgtaacttaaactaaaacgttaaaacgtaacgttcgtagtacctagacctaaccgtaattaccgttacgttacctttactaccgttaccctttaccccgaccttacttaccgtgtaacg

SEQ ID NO: 140937 - DNA, 587 bp, Homo sapiens
  misc_feature: GYAE6OF02JBPCX.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgagggaaggggctggaatacattggagtgtctctcatagtggaggttcctattacagtccgtctctcaagagtcgagtcacctatatctctgacacgtcctagctaatctagttttccctgaagtatgtagttctgtcgaccgccgcgtacgacgtacgggtcgttttattacgtgttgcgagagacgtactattatgttattttggagtttggtttagtttcgtaacgtacccgttagtacgtccggacggggtcctaccggtaccccggtcgggaccgtaagggaacgttacgtacggtcgtacccgtctccttacgtccctacccg

SEQ ID NO: 140938 - DNA, 554 bp, Homo sapiens
  misc_feature: GYAE6OF02GJPXE.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttcccctgaagatgagttctgtgaccgccgctgacacgggcttttattactgtgcgagagacggctattatgtatttttggagttggttatttcgacacctagatcggacggggctcgacccgtcggggccagggatacgtggtcaccgtctccttagcctcacccgaacgggccctacgtccggtccttccccgtcggcccacccctcctacccacgagtacccg

SEQ ID NO: 140939 - DNA, 579 bp, Homo sapiens
  misc_feature: GYAE6OF02GFVUT.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgcccctaagctctaatctatgctgcatccagtttgcaaagtcggggtcccatcgaggttcagtggcagtggatcgtgggacagtatttcactctcaccatcagtaatctgacaacgtgaagttattttagactaacgttattactagtacaaactataattactaagttgttttaccggacctaagggactaacgtaacttaaactaaattaaacgtaacttagtacggtacgtacgacctaacctattaccgtcgtttacctttacgtaactttcccgtttaccccgacctaacttccgtagttaacccg

SEQ ID NO: 140940 - DNA, 538 bp, Homo sapiens
  misc_feature: GYAE6OF02F6ET2.46.67.G01.1.454.CMB.1.raw
tcagactagcagtacacgaccggtgctcgatttagagtatacatattgggtttggggagtctcggtcaggacacagaatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtggggtcccatcgaggttcagtggcagtggatctgggacagatttcactctcaccatcagtaatctgcaacgtgaagtattttgctaacttatactgttacaactagaattacaattgttttacggacctaagggacacgtactaactaaattaaacgaaacttagtagtactgtaccaccgtaactactagtccttctattcctttcccgcctattcctagacttacg

SEQ ID NO: 140941 - DNA, 572 bp, Homo sapiens
  misc_feature: GYAE6OF02GVVNZ.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaattggtatcaacatagaccagggacggcccctaagctcctaatctatgctgcatcctagtttgacaaagtcgggtcccagtcggaggttcagtggcaggtggatcgtgggacagtatttcactctcacctatcagtaatctagacgtaagtgaagtatttagactaactttattactgtacaactagtaattactaatttcggtttacggacctaaagggactaacggtaactaaacgtaaaatttaaaccgaaacttggtacgacttaggacctacctaattcgtcgttaccttacttacttccttaccccgacctacttcctagttacg

SEQ ID NO: 140942 - DNA, 543 bp, Homo sapiens
  misc_feature: GYAE6OF02IY07W.46.67.G01.1.454.CMB.1.raw
  modified_base (533)..(533): a, c, t, g, unknown or other
  misc_feature (533)..(533): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttggccgggcaagtcggaacattgacactatttaaatggtatcaacatagaccagggacgcccctaagctcctaatctatgctgcatccagtttgacaaaggtcggggtcccagtcgtaggttcaggttggcagtggatcgtagggacagtatttcactctacacatcagtaatctagactaacgtagaagttatttagtacttaacttattactgtacaactataattacaatttcgtttaccggactaaggacaacgtaactaactaaagttaaacgactagtcggactcgactaacattactgttctactactccttaccncactctgtac

SEQ ID NO: 140943 - DNA, 528 bp, Homo sapiens
  misc_feature: GYAE6OF02GDY1Z.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccaggacggcccctaagctcctaatctatgctgcatccagtttgcaaagtggggtcccatcgaggttcagtggcagtggatctgggacagattcactctcaccatcagtaatctgacaacgtgaagtattttgactaacttattactgtactaacagtaattacaattgttttcggacctaagggacctacgaacttaacaaattaaacgaacttagtagactagcctaactaatctagtcttcacttcttcccgacacttctgtaac

SEQ ID NO: 140944 - DNA, 566 bp, Homo sapiens
  misc_feature: GYAE6OF02F43BK.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggagacagtgtcaccatcacttgccgggcaagtcggaacattgacactattaatgtatcaacatagaccagggacgcccctaagctcctaatctatgctgcatccagtttgcaaagtgggtccatcgaggttcagtggcagtggatcgtgggacagtattcactctcaccatcagtaatctagcaacgtgaagtattttgactaacttattactgtacaactagtaattacaagttcgttttacggacctaacgggtactaacgaacttaacgaaaactttaaacgaacgttagtagggtactacggtacctaaccgattacgtcgttacctttactaacgtttcccttacccccgtactacgtttacctaggttaacc

SEQ ID NO: 140945 - DNA, 571 bp, Homo sapiens
  misc_feature: GYAE6OF02IPZND.46.67.G01.1.454.CMB.1.raw
  modified_base (336)..(336): a, c, t, g, unknown or other
  misc_feature (336)..(336): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagcctcccgagggaggggctggaatacattggaagtgtctctcatagtggaggttcctattacagtccgtctctcaagagtcgagtcaccatatctctggacacgtccagcaatcagttttcccngaagatgagttctgtcgaccgccgctgacacgggtcttttaataccgtgtgcgagagacggctatatgtattttggagttggttattcgtactaccctagtacgtcggacggggctcggacccgtacgggccgaagggactacgtggtccaccgtctccgttactcctcccaccgaacggccctacgtccggttaccttccccgtcgccctaccctccctacccacgcgtacccg

SEQ ID NO: 140946 - DNA, 632 bp, Homo sapiens
  misc_feature: GYAE6OF02J0V60.46.67.G01.1.454.CMB.1.raw
  modified_base (199)..(199): a, c, t, g, unknown or other
  misc_feature (199)..(199): n is a, c, g, or t
  modified_base (232)..(232): a, c, t, g, unknown or other
  misc_feature (232)..(232): n is a, c, g, or t
  modified_base (621)..(621): a, c, t, g, unknown or other
  misc_feature (621)..(621): n is a, c, g, or t
tcagactagcagtacacgaccggtgctcgatttagagtatacatattgggttggggagtctcggtcaggacacagcatggacagtgagggtccccgctcagcctccgtggggctcctgctactctggctccgaggtgcctagatgtgacatcgagctgacccagtctccgatcctcccgtgtctgccaaccggtggganacaggtcgtaccaccatccacgttgcccgggtnaacggtccggaactattcgacctaaccttatttaattcggtaatcaacagtacggaccgaggggacggtcccctaaggcctaccgtaatcatgctgcactcctagtttgacgaaacggtcggggtccccaagtccgtaagggtttccagggttcggacgtaggttcggtaagttccgttaggggaactaggtaactttccacttcttaccacctatcctaagtaacctgtcgactacgtagtaagtatttacgactaagttattactacgtacaaacgtattaaatactaagttcggtttaacgacgtaacggtacacgtaactaactaaagttaacgtaactcgttagtcagtaccacctattactcgtactacgtacttctacccgntactcgtatac

SEQ ID NO: 140947 - DNA, 525 bp, Homo sapiens
  misc_feature: GYAE6OF02HH6PI.46.67.G01.1.454.CMB.1.raw
  modified_base (495)..(495): a, c, t, g, unknown or other
  misc_feature (495)..(495): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctcctaatctatgctgcatccagtttgcaaagtggggtcccatcgaggttcagtggcagtggatcgtgggacagatttcactctcaccatcagtaatctgacaacgtgaagtattttgactaactttattacttgtacaactagaattacaattgtttacgacctaagggacaacgactaactaaaattaaacgaactgtagactgactaaccatctntacttactacttcctaccgcctatctatac

SEQ ID NO: 140948 - DNA, 636 bp, Homo sapiens
  misc_feature: GYAE6OF02I2S0W.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtccatcgaggttcagtggcagtgatcgtgggacagtatttcactctcacatcagtaatctagactaacgtgaagtattttagactaactttattacgttagtactaaacgtaagtaaactttaactaatttcggtttttaccggaccgtaaacggggtaacctaaccggtaaccttaaacgtaaaaacgtttaaaaccggtaaacgtttacggttaacgggtacttacgacccgtaaacctaacttaccgttacgtttacctttaaccgtaacgtttccccgtttaccccggtaccctaaccgtttaccgttacggttaacc

SEQ ID NO: 140949 - DNA, 521 bp, Homo sapiens
  misc_feature: GYAE6OF02IODPL.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaatggtatcaacatagaccagggacggcccctaagctcctaatctaatgctgcatccatttgcaaagtgggtccatcgagttcagtgcagtgatcgtggacagatttcactctcacatcagtaatctgacaacgtgaagtattttgactaacttattactgtacaaacagtaaatacaatgtttacggacctaaggacaacgtaactaactaaaattaaacgaactgtaggcttagacaactaatctagttctactacttcgttcccgactatctgtaac

SEQ ID NO: 140950 - DNA, 579 bp, Homo sapiens
  misc_feature: GYAE6OF02GVJ34.46.67.G01.1.454.CMB.1.raw
  modified_base (380)..(380): a, c, t, g, unknown or other
  misc_feature (380)..(380): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttgccgggcaagtcggaacattgacactattaatggtatcaacatagaccaggacgccctaagctctaatctatgctgcatccagtttgactaaaggtcgggtacccagtcgaggttcaggtggcaggtggatcgtagggacagtatttcactctcaccatcagtatcgtnactaacgtgaagtactttcgactaacttattactgtacaaactagtaattacaagttcgtttacggacctaaagggactaacggtaactaaacgtaaacgttaaacgaacgttagtacggtactacggtacctaaccgtattaccgtcgttaccttactaacgttcccgttaccccgtacctattaccgtagttaaccg

SEQ ID NO: 140951 - DNA, 609 bp, Homo sapiens
  misc_feature: GYAE6OF02H898I.46.67.G01.1.454.CMB.1.raw
  modified_base (97)..(97): a, c, t, g, unknown or other
  misc_feature (97)..(97): n is a, c, g, or t
  modified_base (218)..(218): a, c, t, g, unknown or other
  misc_feature (218)..(218): n is a, c, g, or t
  modified_base (229)..(229): a, c, t, g, unknown or other
  misc_feature (229)..(229): n is a, c, g, or t
  modified_base (254)..(254): a, c, t, g, unknown or other
  misc_feature (254)..(254): n is a, c, g, or t
  modified_base (258)..(258): a, c, t, g, unknown or other
  misc_feature (258)..(258): n is a, c, g, or t
  modified_base (302)..(302): a, c, t, g, unknown or other
  misc_feature (302)..(302): n is a, c, g, or t
tcagactagcagtacacgaccggtgctcgatttagagtatacatattgggtttggggagtctcggtcaggacacagcatggacatgagggtccccgntcagctcctggggctcctgctactctggctccgaggtgccagatgtgacatcgagctgacccagtctccatccctccctgtctgacaaccgtgggagacagtgtcaccatcacttgccggnaagtcggaacnttgacacttatttaaatgtatacanatanacaggacggcctaagctcctaatctatgactgcatcccagtttnactaaacggtcgggtaccagtacggtacggtttcgaacggtggtacaggtcggtaagtccgtagggactagtacgtttcacttacgtacctaccaagtcctaagttactctacgtactaaccgtagtaagtaattttcgaacttaactttaattacttgtactaacaataagttaactaagttgtttaccgaccgtaaggtacgacgacttaaactaaactaaacgaaacttagtagtactacgtacgtaaccagttctacgttaccttactacttaccttcccgtaccgtacttccgtagttaacc

SEQ ID NO: 140952 - DNA, 561 bp, Homo sapiens
  misc_feature: GYAE6OF02I28W7.46.67.G01.1.454.CMB.1.raw
  modified_base (289)..(289): a, c, t, g, unknown or other
  misc_feature (289)..(289): n is a, c, g, or t
  modified_base (336)..(336): a, c, t, g, unknown or other
  misc_feature (336)..(336): n is a, c, g, or t
  modified_base (399)..(399): a, c, t, g, unknown or other
  misc_feature (399)..(399): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgagggagggctggaatacagttggaagtgtctctcatagtggaggttcctattacagtccgtctctcaagngtcgagtcaccatatctctggacacgtccagcaatctagttttcccngaagatgagttctgtcgacccgcgctcgacacgggtcgtttaatactgtgcgagacgacggtntattatgtagttttggagttgttattcgtactacctagatcggacgggtctcgacccgtgggccgagggaacttacgtcgtcaccgtcttccttacgcctccgaccgaacggccctaacgtcgtccttcccctcggcctacccctcctaccacgcgtacccg

SEQ ID NO: 140953 - DNA, 522 bp, Homo sapiens
  misc_feature: GYAE6OF02GRDQ5.46.67.G01.1.454.CMB.1.raw
  modified_base (519)..(519): a, c, t, g, unknown or other
  misc_feature (519)..(519): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgcccctaagctcctaatctatgctgcatccagtttgcaaagtgggtacccatcgaggttcagtggcagtggatcgtgggacagtatttcactctcaccatcagtaatctgacaacggtagaagtattttgactaacttattacttagtactaaactagtaattactaattgtttcgaccgaaggacacgtactaacaaattaaacgaatagtagtctgacacatctattctcacttcctcccgctactctntac

SEQ ID NO: 140954 - DNA, 597 bp, Homo sapiens
  misc_feature: GYAE6OF02JL6ED.46.67.G01.1.454.CMB.1.raw
  modified_base (208)..(208): a, c, t, g, unknown or other
  misc_feature (208)..(208): n is a, c, g, or t
  modified_base (257)..(257): a, c, t, g, unknown or other
  misc_feature (257)..(257): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtgggctgggtccgnagctccgagggagggctaggatacattggaagtgtactcgtacagtagngagtcctatacagtcctcattccaagagtcgagtcacatatctctagacacgtccagcaatcgagtttacctgaagtatgtagtctagtcgaccgcgactgactacggtcgttatacgtgtacgcgagagacgactatatagtagtttaggagtagttacttacgacacctagacgtacggtacggggacctcggacccgtgggaccaggggtaataccgttagggtaccctaccggtcctacctaccgtaccacccgtaacccgaacgggtcccaacgttcccggtaccgtttacccccgaggtaccctaccccgtaccgtaccctaacgacgtacccg

SEQ ID NO: 140955 - DNA, 558 bp, Homo sapiens
  misc_feature: GYAE6OF02IRDO1.46.67.G01.1.454.CMB.1.raw
  modified_base (329)..(329): a, c, t, g, unknown or other
  misc_feature (329)..(329): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggttcttctgggctgggtccggcagctccagggagggctggaatacattggaagtgtctctcatagtggaggttcctattacagtccgtctctcaagagtcgagtcaccatatctctggacacgtccagcaatcagttttcccngaagatgagttctgtgaccgcgctgacacgggtcgtttatacgtgtgcgtagagacggctattatgtagttttggagttggttatttcgactaccctagtatcggacgggctcgacccgtgggccagggatacgtgtcgaccgtctccttacgcctccaccgaacgggccctaacgtccgttccgttacccccgtggtaccctacccctcccgtaccaacgcgtacccg

SEQ ID NO: 140956 - DNA, 557 bp, Homo sapiens
  misc_feature: GYAE6OF02GNH0J.46.67.G01.1.454.CMB.1.raw
tcagactagcagtacacgaccggtgctcgatttagagtatacatattgggtttgggggacctcctgtgctaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctggggtccggcagctcccgagggaaggggctggaatacattggaagtgtctctcatagtggaggttcctattacagtccgtctctcaagagtcgagtcaccatatctctggacacgtccagcaatctacgttttccctagaagatgagttctgtcgaccgccgtctgacacgggtcgtttattactgttgcgagacggacggtcttattagtgttagtttttggagttggtttatttcgactacctagactcggacggggtctccggacccgtgggccaggaactacgtggtccaccgtctccgttagcctacccg

SEQ ID NO: 140957 - DNA, 550 bp, Homo sapiens
  misc_feature: GYAE6OF02JE1AX.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaagggctggaatacattggaagtgtctctcatagtggaggttcctattacagtccgtctctcaagagtcgagtcacccatatctctggacacgtccagcaatcagttttcccctgaagatgagttctgtgaccgccgctgacacgggctttatactgtgcgagagacggctattatgatttttggagttggttatttcgactaccctagatcgacggggctcggacccgtggggccagggaatacgtggtcaccgttctccttagcctccaccgaagggcccagtccggtccttcccccgtggccaccccgtccctcccagcgtacccg

SEQ ID NO: 140958 - DNA, 610 bp, Homo sapiens
  misc_feature: GYAE6OF02JWM15.46.67.G01.1.454.CMB.1.raw
  modified_base (385)..(385): a, c, t, g, unknown or other
  misc_feature (385)..(385): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctggggtccggcagcctcccgagggaggggctggaatacagttggaagtgtctctcagtagtggaggttcctattacagtcgtctctacagagtcgagtcaccatatctactggaactcgtaccagacaactctacgttttcccngaaagatgtagttctgtacgaccgtccgctacgacgacggtcgtttattacgtgtgcggagagacggtctagttattgttagtttttggacgtttaggtttactttacgtaccgtaacccgttagttagtccgggtacggggtccttaccggaccccggtagggacccgtaagggtaactacgttcggtaccgtaccgttccctacggttacgcccttaacccgg

SEQ ID NO: 140959 - DNA, 617 bp, Homo sapiens
  misc_feature: GYAE6OF02GN7RX.46.67.G01.1.454.CMB.1.raw
  modified_base (233)..(233): a, c, t, g, unknown or other
  misc_feature (233)..(233): n is a, c, g, or t
  modified_base (344)..(344): a, c, t, g, unknown or other
  misc_feature (344)..(344): n is a, c, g, or t
  modified_base (348)..(348): a, c, t, g, unknown or other
  misc_feature (348)..(348): n is a, c, g, or t
  modified_base (365)..(365): a, c, t, g, unknown or other
  misc_feature (365)..(365): n is a, c, g, or t
  modified_base (403)..(403): a, c, t, g, unknown or other
  misc_feature (403)..(403): n is a, c, g, or t
  modified_base (432)..(432): a, c, t, g, unknown or other
  misc_feature (432)..(432): n is a, c, g, or t
  modified_base (437)..(437): a, c, t, g, unknown or other
  misc_feature (437)..(437): n is a, c, g, or t
  modified_base (443)..(443): a, c, t, g, unknown or other
  misc_feature (443)..(443): n is a, c, g, or t
  modified_base (449)..(449): a, c, t, g, unknown or other
  misc_feature (449)..(449): n is a, c, g, or t
  modified_base (457)..(457): a, c, t, g, unknown or other
  misc_feature (457)..(457): n is a, c, g, or t
  modified_base (464)..(464): a, c, t, g, unknown or other
  misc_feature (464)..(464): n is a, c, g, or t
  modified_base (489)..(489): a, c, t, g, unknown or other
  misc_feature (489)..(489): n is a, c, g, or t
  modified_base (496)..(496): a, c, t, g, unknown or other
  misc_feature (496)..(496): n is a, c, g, or t
  modified_base (521)..(521): a, c, t, g, unknown or other
  misc_feature (521)..(521): n is a, c, g, or t
  modified_base (548)..(548): a, c, t, g, unknown or other
  misc_feature (548)..(548): n is a, c, g, or t
  modified_base (598)..(598): a, c, t, g, unknown or other
  misc_feature (598)..(598): n is a, c, g, or t
  modified_base (610)..(610): a, c, t, g, unknown or other
  misc_feature (610)..(610): n is a, c, g, or t
tcagactagcagtacacgaccggtgctcgatttagagtatacatattgggtttggggtagtctcggtcaggacacagcatggacatgagggtccccgcgtcagctcctggggctcctgcgtacgtctggctcggaggtggcccagagttgtgacgatcggagctcggacccagtcctccgacttccctccgtgtaccgtgacctaccggtggacacgtagtcgtaccaaccgntccgtaacttcgggcccgggacaaggtacggaactattcgaacctaccttaatttaaagtggtatacaacagtacaacgagggaccgaccctaagcctacctaatcttagnctanctactccaaggtttcanaaaacgggtcggtccctaagtccgaaggttcagtgganagtggatcggtaggacagtattcacgttncactnaactanaatctncgtaaacngtaagtntttagacattagtacttagactaanataaatnaacggttttacggactaacggtaanacgaacctaataaactaaacgtaaacngtaagtgtaacactaaccattcctaggttaaccttctatccggtaccctntaacccggtttntacgtac

SEQ ID NO: 140960 - DNA, 521 bp, Homo sapiens
  misc_feature: GYAE6OF02FP2KZ.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacgcccctaagctcctaatctatgctgcatcctagtttgactaaaggtcggggtcccagtcgaggttcagtggcagtggatcgtgggacagtatttcactctacaccatcagtaatctgacaagtgaatattttgactaacttattactgtacaactagtaattacaattgtttacggactaagggacacgactaacaaattaacgaatgtgctagacactatctgttctactacttcttacccgctactctatac

SEQ ID NO: 140961 - DNA, 533 bp, Homo sapiens
  misc_feature: GYAE6OF02GXAQF.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacactatttaaatggtatcaacatagaccagggacggcccctaagctcctaatctatgctgcatccagtttgcaaagtgggtcccatcgaggttcagtggcagtggatcgtgggacagtatttcactctcaccatcagtaatctgacaagtgaagtatttagactaacttattactgtacaactagtaattacaattgtttacggactaagggtacaacgtaactaactaaagttaaacgaactagtaggctagctaacctatctgttcttactacttccttacccgacctacttctagtac

SEQ ID NO: 140962 - DNA, 590 bp, Homo sapiens
  misc_feature: GYAE6OF02HP31R.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaattgtatcaacatagaccagggacgcccctaagctcctaatctatgctgcatccagtttgacaaagtcgggtcccatcgaggttcagtggcagtggatcgtggactagatttcactctcaccatcagtatctgacaacgtgtaagtatttagactaacttattactgtacaactaagtaattactaagttgttttaccggaccgtaagggactaacgtaaccttaactaaaagttaaaccgtaacgttaggtaggtacgttacgtaccgtaacctacttccttacggtttaccctttaccgttaactttcccgtttaccccgtacccttaacgttcctacggttaacc

SEQ ID NO: 140963 - DNA, 575 bp, Homo sapiens
  misc_feature: GYAE6OF02GMEYP.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaaggtcggaacattgacacctattaaattggtatcaacatagacagggacgcccctaagctcctaatctatgctgcatccagtttgcaaagtgggtccatcgaggttcagtggcagtgatctgggacagatttcactctacaccatcagtaatctgacaacgtagaagtattttgactaacttattactgtacaacagtaattactaattgttttacggaccgtaaagggtactaaccgtaacttaaacaaaacgtttaaacgaaacgtaggtacggtacgttacgaccgtaacctaattaccgttacgttaccttacctacttccgttaccccggccctaacttaccgttgtaaccg

SEQ ID NO: 140964 - DNA, 558 bp, Homo sapiens
  misc_feature: GYAE6OF02FPZBO.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctcctaatctatgctgcatccagtttgcaaagtggggtcccagtcgaggttcagtggcagtggatctgggacagattcactctcactatcagtaatctgactaacgtgaagtattttgactaacttattacttgtacaaactagtaacttaactaattaggttttacggaccgtaaagggacctaacggacttaacaaattaaaacgaacttagtacggcgtagactaccaattacttagttccgtttactacttccttacccgacctacttcgtagtaac

SEQ ID NO: 140965 - DNA, 569 bp, Homo sapiens
  misc_feature: GYAE6OF02JHS2E.46.67.G01.1.454.CMB.1.raw
  modified_base (193)..(193): a, c, t, g, unknown or other
  misc_feature (193)..(193): n is a, c, g, or t
  modified_base (216)..(216): a, c, t, g, unknown or other
  misc_feature (216)..(216): n is a, c, g, or t
  modified_base (284)..(284): a, c, t, g, unknown or other
  misc_feature (284)..(284): n is a, c, g, or t
  modified_base (290)..(290): a, c, t, g, unknown or other
  misc_feature (290)..(290): n is a, c, g, or t
  modified_base (564)..(564): a, c, t, g, unknown or other
  misc_feature (564)..(564): n is a, c, g, or t
tcagactagcagtacacgaccggtgctcgatttagagtatacatattgggtttggggtagtcgtcggtcgaggacacagcatggacatgaggtccccgctcagctcctggggctcctgctactctggctccgagtgccagatgtgacatcgagctgacccagtctccatcctccctgtcctgacaccgtggancagtgcaccatcacttgccgggnaagtcgacattgacactatttaatgtatcacatagacaggacgccctagctctaatcctatgctgcanccattncaagtggccatgagtcagtgactgtacggatcgtggacagtagtttcacgtcttcgaacctagttaccaggttaactccttacgacgtaacgtacgtaacgttatttacgactaacgttattacttacgtactaacgtagtaattacctaattacgtttacgacgtaaacggactacgtaacctaagtaaactaaacgaacgttactacggtacttacggactactaattacctacgttccgttatacttccgtacccttaccgtattaccctntaacg

SEQ ID NO: 140966 - DNA, 559 bp, Homo sapiens
  misc_feature: GYAE6OF02HNF46.46.67.G01.1.454.CMB.1.raw
  modified_base (249)..(249): a, c, t, g, unknown or other
  misc_feature (249)..(249): n is a, c, g, or t
  modified_base (320)..(320): a, c, t, g, unknown or other
  misc_feature (320)..(320): n is a, c, g, or t
  modified_base (328)..(328): a, c, t, g, unknown or other
  misc_feature (328)..(328): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccggnagcctcccgagggaggggctggaatacattggaagtgtctctcatagtggatgttcctattacagtccgtntctcaagngtcagtcacctatatctctggacacgtcagcaatctacgttttcccagaagtatgagttctgtcgaccgcgctgacgtacgggtcgtttattacgttgtgcgtagagtcggctattatgtagttttgagttgtttattcgactaccgtagacgtcggacggggcctccggaccccggtggggaccgaagggtactacggtcggtcctacccggtcttaccgttacgtaccc

SEQ ID NO: 140967 - DNA, 572 bp, Homo sapiens
  misc_feature: GYAE6OF02GVNRP.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacacctatttaaatggtatcaacatagaccagggacgcccctaagctcctaatctatgctgcatccagtttgcaaagtgggtcccatcgaggttcagtggcagtgatcgtgggacagatttcactctcaccatcgagtaatctgacaacgtgtaagtatttgactaacttatacttgtacaacagtaattaactaattcgttttacgaccgtaaagggtactaacgtaacttaaactaaagttaaacgaacgttagtacggtctacgtactaacctacgttacttacggttactttaccgtaacctttccgttacccccgtacctacgttcctagtaaccg

SEQ ID NO: 140968 - DNA, 534 bp, Homo sapiens
  misc_feature: GYAE6OF02GO86Q.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagtattttgactaacttattacttagtacaacagtaattactaattgtttttaggaccgtaaagggtactacgaactaactaaaattaaacgaacttagtagctgcgaacctatctgttcttactacttccttcccgcctactctgtac

SEQ ID NO: 140969 - DNA, 616 bp, Homo sapiens
  misc_feature: GYAE6OF02I3HHP.46.67.G01.1.454.CMB.1.raw
  modified_base (191)..(191): a, c, t, g, unknown or other
  misc_feature (191)..(191): n is a, c, g, or t
  modified_base (218)..(218): a, c, t, g, unknown or other
  misc_feature (218)..(218): n is a, c, g, or t
  modified_base (416)..(416): a, c, t, g, unknown or other
  misc_feature (416)..(416): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtggganacagtgtcaccatcacttcggccgggnaaggtcggaacattgacacttaatttaaatggtatacaacatagaccgagggacgcccctaagcctacctaatctatgctgcatcctagtttcgacaaacggttcgggtcccagtcggtaggttcagtgacaggtggactcggtggacaagttacttcgactcgtacacctaatcaagtaatcgtacgacctaaggtntaaggttaacttcgtaacctaaacttattaaccgtagttaactaacgaaacgttaacttaaactaggttaacgttttaccggaacctaaaggggtaccaacgtacttaaaccgtaaaacttaaacgtaactagtcggtactagtaccgaacctatcgtaacttcttaacgtcttaccgtaccgctacttcgtagttaacc

SEQ ID NO: 140970 - DNA, 542 bp, Homo sapiens
  misc_feature: GYAE6OF02JDBD3.46.67.G01.1.454.CMB.1.raw
  modified_base (416)..(416): a, c, t, g, unknown or other
  misc_feature (416)..(416): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagacagggacggcccctaagctcctaatctatgctgcatccagtttgacaaagtgggtcccatcgaggttcagtggcagtggatcgtagggacagtatttcactctcaccatcagtaatctagctaacgtgaagtattttacgactaactttattacgtntacaaactagtaaattacaattgtttacggactaagggacaacgtaactaacgtaaattaaacgaaactgtagtctaggactaacctattctacgtcttactacttcccttccgactattctatac

SEQ ID NO: 140971 - DNA, 703 bp, Homo sapiens
  misc_feature: GYAE6OF02IX5OC.46.67.G01.1.454.CMB.1.raw
  modified_base (326)..(326): a, c, t, g, unknown or other
  misc_feature (326)..(326): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccagactggtgaggccttcggagaccctgtccctcacctgcgctgtctctggtgcctccatcagtagtggtttcttctggggctgggtccggcagctccgagggaagggctggaatacattggaagtgtctctcatagtggaggttcctattacagtccgtctctcaagngtcgagtcacatatctctggacacgtccagcaatctagttttccctgaagatgtagttcgttgtcgtaccggcccgcgtcgaaccgtacggggtcgttttaacgttacgttggttaggtcggaaggacggacggggtacctttaagtttacttacggtttaagtttttttagggtaaggttttagggttttaacgtttttacccggtaaccggtaaccccgtttagggtaacggtttccggggacccggggggttaccgttcccgggtaaccccccgggttcggggggtacccggtaacggggttaacgtaaccgggttacgggtacccgttaacccggttcccgttacccggtttaccgtccccgttaacccccgg

SEQ ID NO: 140972 - DNA, 559 bp, Homo sapiens
  misc_feature: GYAE6OF02GPPTA.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaagggctggaatacattggaagtgtctctcatagtggaggttcctattacagtccgtctctcaagagtcgagtcacatatctctggacacgtccagcaatcagttttcccagaagatgtagttctgtgaccgcgctgacacgggtctttatacgtgtgcgagagacggctattatgtattttggagttggttatttcgactacccgtagagtcgacggggtctcgacccgtggggccgagggactacgtggtcaccgtctccttacgcctccgaccgtaacgggcccctagtcccggtccttccccgtcggcccacccgtccctaccacgcgtacccg

SEQ ID NO: 140973 - DNA, 550 bp, Homo sapiens
  misc_feature: GYAE6OF02HO3NR.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgcccctaagctcctaatctatgctgcatccagtttgcaaagtgggtccatcggagttcagtggcagtggatcgtgggacagatttcactctcacatcagtaatctagacaacgtagtaagtattttagactaactttattactgtacaatagaattactaattgtttacggactaagggacaacgaacttaacgaaaacttaaacgaacttgagtcgttagaccaacctagtactacgttacttccgtacttccgttaccccgcctaacttccgtagtaacg

SEQ ID NO: 140974 - DNA, 580 bp, Homo sapiens
  misc_feature: GYAE6OF02F644C.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgccctcatcagtagtggtttcttcgtggggctgggtccggcagcctccgaggggaaggggctggaatacattggaagtgtctctcatagtggaggttcctattacagtccgtctctcaagagtcgagtcacatatctctggacacgtccagcaactctacgttttccctagaagtatgtagtttctgtcgaccgccgctgacgtacgggtcgtttattactgtgcgagagcgtctattatgtattttggagttggtttatttcgactaccgtagtacgtcggacggggtctccggaccccggtcggggacccgaaggggtaacttacgtcgggtacctacccggttccttacccgttacgccctaacccg

SEQ ID NO: 140975 - DNA, 527 bp, Homo sapiens
  misc_feature: GYAE6OF02FFPP5.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtgatctgggacagattcactctcaccatcagtaatctgcaacgtgaagtattttgctaacttattacttgtacaacaagtaattactaattcgttttacggaccgtaagggactaacgaactaacaaaacttaaacgaactagtacggctagcaaccatctgtcttctactccttcccgccactctgtac

SEQ ID NO: 140976 - DNA, 595 bp, Homo sapiens
  misc_feature: GYAE6OF02HAI0Z.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgagggccttcggagaccctgtccctcacctgcgctgtctctggtgcctccatcagtagtggtttcttcgtggggctggggtccggcagctcccgaggggaagggctggaatacagttggaagtgtctctcatagtggaggttcctattacagtccgtctctcaagagtcgagtcacatatctctggacacgtccagcaatctagtttcccagaagtatgtagttctggtcgaccgcccgcgtagaccgtacggggtcgttttaattacgtggtagcgagagacggcttaattagtgtattttgggagttggtttattcgtacctacctagtacgtcggacggggcctccggacccgtcgggaccgagggtactacgtggtccaccgtcctccttacgccctaccgaccgaacggtccctacgttcccgtcccttccccgcgtccctacccctcctacccacgcacccg

SEQ ID NO: 140977 - DNA, 614 bp, Homo sapiens
  misc_feature: GYAE6OF02GQRVU.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccaggacggcccctaagctcctaatctatgctgcatccagtttgcaaagtgggtcccatcgaggttcagtggcaggtgatcgtagggacagtattcactcgtcacctatctagtaatctgacaacgtgaagtatttgactaacttattacttgtactaacaagtaactttaactaagttcgttttaccggaaccgtaaacgggtaacctaaccggtaaaccttaaacgtaaaaactttaaaaccggaaacgttacggtaggtaccgtcggaccgtaaccctattaccgttacgtttacctttaccgtactttacccgttttacccccgacccttaactttcccgtagttaaccg

SEQ ID NO: 140978 - DNA, 527 bp, Homo sapiens
  misc_feature: GYAE6OF02JF0F2.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccaggacggcccctaagctcctaatctatgctgcatccagtttgcaagtgggtcccatcgaggttcagtgcagtgatctgggacagattcactctcaccatcagtaatctgcaacgtgaagtattttagtaacttattactagttacaaataagtaattacaaattgttttacggacctaagggacaaccgaactaacaaattaaacgaactgtagctgcacctattacctgtcttactacttcctttcccgacctattcctgtatac

SEQ ID NO: 140979 - DNA, 576 bp, Homo sapiens
  misc_feature: GYAE6OF02HN9RR.46.67.G01.1.454.CMB.1.raw
  modified_base (288)..(288): a, c, t, g, unknown or other
  misc_feature (288)..(288): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagngtcgagtcaccatatctctggacacgtccagcaatcagttttccctgaagattagttctgttgaccgccgctgacgacgggtctttatactgtgcgagagacggctattatgtattttggagttggttatttcgactacccgtagactcggacggggtctccggacccgtggggaccgagggaactacgtggtaccaccgtctccgttacgcctccaccgaacgggcccacgttccggtcccttcccccgtggtccctacccctccctacccaacggacgcctacccg

SEQ ID NO: 140980 - DNA, 537 bp, Homo sapiens
  misc_feature: GYAE6OF02FOPRV.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgaccccagtctccatcctccctgtctgcaaccgtgggagacagtgtcaccatcacttgccgggcaagtcggaacattgacacctattaaatggtatcaacatagaccaggacggcccctaagctcctaatctatgctgcatccagtttgcaaagtggggtcccagtcgacggttacacgtggcagtggatctgggacagtattcactctccacctactcagtaatctgactaacgtgtaagtatttcgactaacttattacttgtacaactaagaacttacaattcgttttcgacgtaaggacacgacttaacaaattaaacgaactagtagtctagacgaaccatctcgttacttctactcgttacccgctactctagtacg

SEQ ID NO: 140981 - DNA, 589 bp, Homo sapiens
  misc_feature: GYAE6OF02IGHAT.46.67.G01.1.454.CMB.1.raw
  modified_base (211)..(211): a, c, t, g, unknown or other
  misc_feature (211)..(211): n is a, c, g, or t
  modified_base (235)..(235): a, c, t, g, unknown or other
  misc_feature (235)..(235): n is a, c, g, or t
  modified_base (248)..(248): a, c, t, g, unknown or other
  misc_feature (248)..(248): n is a, c, g, or t
  modified_base (273)..(273): a, c, t, g, unknown or other
  misc_feature (273)..(273): n is a, c, g, or t
  modified_base (391)..(391): a, c, t, g, unknown or other
  misc_feature (391)..(391): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctccatcagtgtggtttcttcgngggctgggtccgnagctccgagggagggctggatacgnttggaagtgtctcgtcagtagtggtaggttcctattacacgtccgtctctacaagagtcgagtcaccatatctcgtgactacgtcagcaatctagttttcccagaagtatcgtagttntagtcgaccgtccgctacggacgtacgggtctttaacgttacgtgtcgacgagacggacggtcttaattagttgttagtttttggtaagttaggtttactttacgactaccgtagtacgtcggacggggtctccgaacccggtgggaccaagggtaacacggttcggtacctaccgttcgtcccttagccctaacccg

SEQ ID NO: 140982 - DNA, 509 bp, Homo sapiens
  misc_feature: GYAE6OF02I10I4.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattgtatcaacatagaccagggacggcccctaagctctaatctatgctgcatccagtttgcaaagtgggtcccatcgaggttcagtggcagtggatctgggacagattcactctcaccatcagtaatctgcaacgtgaagtattttgctaacttattactagtacaacagtaattacaattgtttacggacctaagggacacgactaacaaattaaacaactgtagctgacacatctgtacttcactccttcccgctactctgtac

SEQ ID NO: 140983 - DNA, 563 bp, Homo sapiens
  misc_feature: GYAE6OF02JMJF2.46.67.G01.1.454.CMB.1.raw
  modified_base (335)..(335): a, c, t, g, unknown or other
  misc_feature (335)..(335): n is a, c, g, or t
  modified_base (491)..(491): a, c, t, g, unknown or other
  misc_feature (491)..(491): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctcatcagtagtggtttcttcgtggggctgggtccggcagctcccgagggaagggctggaatacagttggaagtgtctctcatagtggaggttcctattacagtccgtctctcaagagtcgagtcaccatatctctggacacgtccagcaatcagttttcccngaagatgagttctgtcgaccgcgctgacgacgggtcgtttattacgtgtgcgagcgacggtctattatgtattttggagttggttatttcgactacctagatcggacgggtctccgacccgtgggccagggaactacgtggtcaccgtctcgttcncctccaccgacggccctacgtaccggtcctttccccgcggtcccaccccgttcctcccgaacgtcgtacccg

SEQ ID NO: 140984 - DNA, 546 bp, Homo sapiens
  misc_feature: GYAE6OF02GYRL1.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccgtgggagacagtgtcaccatcacttgccgggcaagtcggaacattgacacctatttaaatggtatcaacatagaccagggacggcccctaagctcctaatctatgctgcatccagtttgacaaaggtcggggtcccagtcgaggttcagtggcaggtggatcgtgggacagtatttcactctcaccatcagtaatctgacaacgtgaagtatttgactaacttattacttgtacaactagtaattacaattcgtttacggaccgtaagggtaccaacgtaactaactaaacttaaacgtaacgtgtaggtactagactaacctatctagtcttctactccttacccgactactctagtac

SEQ ID NO: 140985 - DNA, 566 bp, Homo sapiens
  misc_feature: GYAE6OF02JHC4X.46.67.G01.1.454.CMB.1.raw
  modified_base (213)..(213): a, c, t, g, unknown or other
  misc_feature (213)..(213): n is a, c, g, or t
  modified_base (308)..(308): a, c, t, g, unknown or other
  misc_feature (308)..(308): n is a, c, g, or t
  modified_base (315)..(315): a, c, t, g, unknown or other
  misc_feature (315)..(315): n is a, c, g, or t
  modified_base (339)..(339): a, c, t, g, unknown or other
  misc_feature (339)..(339): n is a, c, g, or t
  modified_base (342)..(342): a, c, t, g, unknown or other
  misc_feature (342)..(342): n is a, c, g, or t
  modified_base (348)..(348): a, c, t, g, unknown or other
  misc_feature (348)..(348): n is a, c, g, or t
  modified_base (371)..(371): a, c, t, g, unknown or other
  misc_feature (371)..(371): n is a, c, g, or t
  modified_base (375)..(375): a, c, t, g, unknown or other
  misc_feature (375)..(375): n is a, c, g, or t
  modified_base (383)..(383): a, c, t, g, unknown or other
  misc_feature (383)..(383): n is a, c, g, or t
  modified_base (392)..(392): a, c, t, g, unknown or other
  misc_feature (392)..(392): n is a, c, g, or t
  modified_base (397)..(397): a, c, t, g, unknown or other
  misc_feature (397)..(397): n is a, c, g, or t
  modified_base (403)..(403): a, c, t, g, unknown or other
  misc_feature (403)..(403): n is a, c, g, or t
  modified_base (479)..(479): a, c, t, g, unknown or other
  misc_feature (479)..(479): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtcccctcacctgccgctgtctctggtncctccatcagtagtgtttctcgtgggctgggtccgcagctccagggagggctggatacattggaagtgtctctcatagtggagttcctagttacngtccgtntctcaagcgtcgagtcaccatacnctntggacncgtccagcaatctacgttttccngaantgagttcngtgaccgcntgacncgggtnttactctgtgtcgagagacgtctattagtacgttagttttaggagttggtttaactttcgaacctacccgtaagtnttaccgggacgggggtccttaccggaccccggttgggaccgtaagggtaacttcgtacggtcgaccgttctcccgttagccctaccg

SEQ ID NO: 140986 - DNA, 573 bp, Homo sapiens
  misc_feature: GYAE6OF02HF14Z.46.67.G01.1.454.CMB.1.raw
  modified_base (408)..(408): a, c, t, g, unknown or other
  misc_feature (408)..(408): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcgaacattgacactatttaatggtatcaacatagaccagggaccggcccctaagctacctaatctatgctgcatccagtttgcaaaggtcgggtcccagtcgaggttcagtggcagtggatcgtggacagtatttcactctcacatcagtatctgcaacgtgaagtatttgactaacttattacgtnttacaactagtaacttaactattcgtttcggaccgtaagggaccaacgtaacctaaagtaaacgttaaacgtaacgttgtacgtacgttacggactaaccgtaacttcgttacgttacctttactactttacccgttccccgaccttaccttacgttacgtaacg

SEQ ID NO: 140987 - DNA, 581 bp, Homo sapiens
  misc_feature: GYAE6OF02F8DCZ.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacacctatttaaatggtatcaacatagaccagggacggcccctaagctcctaatctatgctgcatccagtttgcaaagtgggtccatcgagttcagtggcagtggatctgggacagatttcactctcaccatcagtaatctagcaacgtgaagtattttgactaaacttattactagtactaacagtaaattactaattggttttaccggacctaaagggtaccaacggtaacttaactaaaagttaaaaccgtaacttagtagtactacgactaaccgtattaccgttaggttacctttacgtaactttcccgtttaccccggtacccttaacttaccgttagttaacg

SEQ ID NO: 140988 - DNA, 523 bp, Homo sapiens
  misc_feature: GYAE6OF02HVV22.46.67.G01.1.454.CMB.1.raw
  modified_base (520)..(520): a, c, t, g, unknown or other
  misc_feature (520)..(520): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgcccctaagctcctaatctatgctgcatccagtttgcaaagtcgggtcccatcgaggttcagtggcagtggatctgggacagatttcactctcaccatcagtaatctgcaacgtgaagtatttgctaactttattactgtacaacagtaaacttactaattcgttttcggacctaagggtacacgaactaactaaactaaacgaactgtagtactgactacattctgttcttcactccttcccgactatctntac

SEQ ID NO: 140989 - DNA, 662 bp, Homo sapiens
  misc_feature: GYAE6OF02JUETK.46.67.G01.1.454.CMB.1.raw
  modified_base (192)..(192): a, c, t, g, unknown or other
  misc_feature (192)..(192): n is a, c, g, or t
  modified_base (215)..(215): a, c, t, g, unknown or other
  misc_feature (215)..(215): n is a, c, g, or t
tcagactagcagtacacgaccggtgctcgatttagagtatacatattgggtttggggtagtctcggtcgaggacacagcatggacatgagggtcccgctcagctcctggggctcctgctactctggctccgaggtgccagatgtgacatcgagctgacccagtctccatcctccctgtctgcaaccgtgganacagtgcaccatcacttgccggnaagtcggaacattcgacactatttaaactggtatcaacatagacctagggaccgaccctaagctacctaactcttaatgcctgcctaatcctagtttgactaaacggtggggtaccccagttacggtaggttaccaggttgcgaaggttgaattcgtggggaactagggtaatttccgaacgttccctacgtaccctaattaccgtagttaacgtctcggtaaccgtaacgtacggtaaagtattttacgacgttaacttacttaacttacgtactaactagtaaacttactaaatttacgggtttacgtacctaagggtaacctacggtaacttaaaccgtaaagttaaacgaacgttacgtacggtactaacgtaccgtaacctagttacctacgttacgttacctacgttaccttaccccgtacgtaccttacggtattaaccg

SEQ ID NO: 140990 - DNA, 580 bp, Homo sapiens
  misc_feature: GYAE6OF02H7TIX.46.67.G01.1.454.CMB.1.raw
  modified_base (255)..(255): a, c, t, g, unknown or other
  misc_feature (255)..(255): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaanatagacagggacgcccctaagctcctaatctatgctgcatcctagttttgcaaaggttggggtcccagtcgagttcagtggcaggtgatcgtgggacagatttcactctcaccatcagtatctgactaacgtagaatatttgactaactttattaactgtacaacagtaattaacattagttttaccggaaccgtaacgggtaacctacgtaacttaaactaaaacttaaaacgaacttagtacggtacttagacctaactacgttctacggttaccttacgtcctttacccgttacccccgtactactttacccgtgttaaccg

SEQ ID NO: 140991 - DNA, 607 bp, Homo sapiens
  misc_feature: GYAE6OF02HTY4Q.46.67.G01.1.454.CMB.1.raw
  modified_base (250)..(250): a, c, t, g, unknown or other
  misc_feature (250)..(250): n is a, c, g, or t
  modified_base (337)..(337): a, c, t, g, unknown or other
  misc_feature (337)..(337): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggcctttcggagacccctgtcccctcacctgcgctgtctctggtgcctccatcagtagtggtttctctggggctgggtccgcagctccagggaaggggctggaatacattggaagtgtctntcatagtggaggttcctattacagtccgtctctcaagagtcgagtcaccatatctctggacacgtccagcaatctacgttttccccngaagatgtagttctgtcgaccgccgctgacacgggtctttatactgtgcgagagacggctatatgtattttggagttggtttatttcgactaccctagtacgtacggacggggtcctccggaccccgtggggacccgaagggtaacgtacgtcggtaccgacccgttctcccgttacgccctacccgacccgaacgggtcccctacgtcccggttacccttcccccgtacggtcccgtaccccttcccgtacccgtaacggacgtacccg

SEQ ID NO: 140992 - DNA, 587 bp, Homo sapiens
  misc_feature: GYAE6OF02GBI5V.46.67.G01.1.454.CMB.1.raw
  modified_base (291)..(291): a, c, t, g, unknown or other
  misc_feature (291)..(291): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagcctcccgagggaaggggctggaatacagttggaagtgtctctcatagtggaggttcctattacagtccgtctctcaagngtcgagtcaccatactctctggacacgtccagcaatctagttttcccagaagatgagttctgtcgaccgcgctgacgacgggtctttattacgtgtgcgagaggacggtactattatgttagtttttggagttggtttatttcgaacctaccgtagagtcggacggggtctccgacccggtcgggaccgagggtactacgtggtctaccgtctccgttagccctaccgaccgaacggccctacgtcccggttcccttccccgtcggccctaccccgtccgtacccacgcgtacccg

SEQ ID NO: 140993 - DNA, 545 bp, Homo sapiens
  misc_feature: GYAE6OF02G9OHI.46.67.G01.1.454.CMB.1.raw
  modified_base (334)..(334): a, c, t, g, unknown or other
  misc_feature (334)..(334): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttcccngaagatgagttctgtgaccgccgctgacacgggcgtttatactgtgcgagagacggctattatgtatttttggagttggttatttcgactacccttagatcgacggggctcggaccccgtggggcccagggaatacgtggtcaccgtctccttagcctccaccgaacggcccagtccggtccttccccgtggccaccctcctccagacgcc

SEQ ID NO: 140994 - DNA, 620 bp, Homo sapiens
  misc_feature: GYAE6OF02H44RP.46.67.G01.1.454.CMB.1.raw
  modified_base (332)..(332): a, c, t, g, unknown or other
  misc_feature (332)..(332): n is a, c, g, or t
  modified_base (380)..(380): a, c, t, g, unknown or other
  misc_feature (380)..(380): n is a, c, g, or t
  modified_base (386)..(386): a, c, t, g, unknown or other
  misc_feature (386)..(386): n is a, c, g, or t
  modified_base (458)..(458): a, c, t, g, unknown or other
  misc_feature (458)..(458): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccggcagctcccgaggggaggggctaggaatacagttggaagtgtctctcatagtggtaggttcctattacagtccgtctctcaagntcgagtcaccatatctctggacacgtccagacaactctacgttttccngaaagntagtattctgtcgacccgccgtctgacgtacgggtcgtttacttacgtggttcgacgtaggacgtaccggtnttaattagtaggtttatttttaggggagtttggttaatttaccggaactacccttaagggtacgtccgggaccggggtctacccgggtaccccggttgggggacccgaagggtaactacggttcggtccgacccgtttcctacccgttaccggccctacccg

SEQ ID NO: 140995 - DNA, 691 bp, Homo sapiens
  misc_feature: GYAE6OF02IPKFB.46.67.G01.1.454.CMB.1.raw
  modified_base (440)..(440): a, c, t, g, unknown or other
  misc_feature (440)..(440): n is a, c, g, or t
  modified_base (475)..(475): a, c, t, g, unknown or other
  misc_feature (475)..(475): n is a, c, g, or t
tcagactagcagtacacgaccggtgctcgatttagagtatacatattgggtttggggggaccgtcctgtgcaacgaacggactgaagcacctcgtggtttgtcctcctcgctggtggtcacgtctaccctagactggtcctgtccgtcggtcgcgaactcgcgaagggagtcgggccacggactcggtgacggtcctttcggagacccgttggttccccttctaccgttcgaccgccttcggtccgttccttcggtcgaccgttccgtatccagttaggttcggtttacttcgtcggggcttcggggtaaccgcgacgtcctcccgagggaagggctaggaactaacacttggaagtgtcctcgtcacgtacgtggtacggtttccttaatttacgacggtccgtacgtcctacgaaggacggtcgacggtcaccgaatntctcgtggacacggtccagcaactctacgtttccngactacgtacgtacgttctgtcgaccgtccgtcgtcgaccgtcgggtacttttacgtacgtcgtacgcgacgacgtacggctacgttagtcggttagttttggacgttcggttacttcgtaccgtaccgtagtacgttcggacgggtcctacggcccggtcgggaccgtaggtaacgtcgtcggtaccgtaccgtcctaccgttacgcccgtaccg

SEQ ID NO: 140996 - DNA, 616 bp, Homo sapiens
  misc_feature: GYAE6OF02HFH2E.46.67.G01.1.454.CMB.1.raw
  modified_base (146)..(146): a, c, t, g, unknown or other
  misc_feature (146)..(146): n is a, c, g, or t
  modified_base (223)..(223): a, c, t, g, unknown or other
  misc_feature (223)..(223): n is a, c, g, or t
  modified_base (353)..(353): a, c, t, g, unknown or other
  misc_feature (353)..(353): n is a, c, g, or t
tcagactagcagtacacgaccggtgctcgatttagagtatacatagtttgggtttgggggacctcctgtgcaagaacatgaagcacctgtgggtttgtccctacctgtctggtggcagctcccagatgggtccttgtccctggtcncaactgcaggtgtccgggccctacgactggtgaggccttcggagaccctgtccctcacctgccgctgtctctggtcncctccactccagttagtggtttactcgtggggtcttggggtccggcacggcctcccgagggaaggggctggaatacgattggaagtgtctctcatagtggaggttcctattacgagtccgtctctcaagngtcgagtcaccatatctctggacacgtccagcaatctacttttcccagaagatgtagttctgtcgaccgcgcgtcgacgtacgggtcgttttacttacgtgttcgacgagacggacgtctagttatgttagttttggagttggtttagtttcgactaccgtagtacgtcgggacggggtcctaccggtccccgtggggacccgtaaggggtaacttacggtcggtaccgtacccggttccgtacccgttacgccctaacccgg

SEQ ID NO: 140997 - DNA, 593 bp, Homo sapiens
  misc_feature: GYAE6OF02FNJWW.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatctagttttccctgaagatgagttctgttcgaccgccgctgacacgggtcttttatactgtgcgagagacgctattatgtagttttggagttgttattcgactaccctagacgtcggaccggggtctaccggacccgtggggaccgtagggtaattacgtcgggtacctaccggtcttcccgttacgccctaccgaaccgtaacgggcccctacggtcccggttccttcccccgtcggccctaccccgtccctacccgtacgacgtacccg

SEQ ID NO: 140998 - DNA, 534 bp, Homo sapiens
  misc_feature: GYAE6OF02GMANC.46.67.G01.1.454.CMB.1.raw
  modified_base (192)..(192): a, c, t, g, unknown or other
  misc_feature (192)..(192): n is a, c, g, or t
  modified_base (412)..(412): a, c, t, g, unknown or other
  misc_feature (412)..(412): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacacctatttaaattggtatcaacatagaccagggacgcccctaagctcctaatctatgctgcatccagtttgacaaaggtcgggtcccagtcgaggttcagtggcagtgatcgtgggacagtattcactctcacatcattaatctgactaacgtgaagtattttgactaacttattactntacaactagtaattacaattcgtttacggacaaggtacaacgtaactaacaaaacttaaacgaactagagtactagacaaccatctgttacttcacttccttacccgcctacttctagtaac

SEQ ID NO: 140999 - DNA, 609 bp, Homo sapiens
  misc_feature: GYAE6OF02JN4BJ.46.67.G01.1.454.CMB.1.raw
  modified_base (377)..(377): a, c, t, g, unknown or other
  misc_feature (377)..(377): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctcatcagtagtggtttctctggggctgggtccggcagctcccgagggagggctggaatacattggaagtgtctctcatagtggaggttcctattacagtccgtctctacagagtcgagtcaccatactctacgtggacacgtccagacaatctacgttttcccngaagtatgtacgttctgtcgaccgcgtcgtgacgtacgggtctttaactacgttggtcgacgagacgtacgtacttagttagtgttagttttggtaggttggtttactttacgacctaccgtaagtacgtacgggtacggggtcttaccggtaaccccgttcggggaccgtaacgggtaacttacggttcggtaccgtacccggttaccgttccgttacgcccttaacccgg

SEQ ID NO: 141000 - DNA, 562 bp, Homo sapiens
  misc_feature: GYAE6OF02H2AH6.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggagacagtgtcaccatcacttgccgggcaagtcggaacattgacacctatttaagttggtatcaacatagaccagggacgcccctaagctcctaatctatgctgcatccagtttgcaaagtgggtcccatcgaggttcagtggcagtgatctgggacagatttcactctcactatcagttaatctgctaacgtgtaaagtattttgactaactttattactgtacaaacagtaattaacaatttgtttaccggaccgtaaacggtactaacgtaacttaacaaaacgtttaaaacgaacttagtagacttacgaccgaacctattctacgttacttactaacttcccttaccccgtacctaacttcctagtaac

SEQ ID NO: 141001 - DNA, 575 bp, Homo sapiens
  misc_feature: GYAE6OF02IU355.46.67.G01.1.454.CMB.1.raw
  modified_base (373)..(373): a, c, t, g, unknown or other
  misc_feature (373)..(373): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctcatcagtagtggtttcttcgtggggctgggtccgcagctcccgagggagggctggaatacagttggaagtgtctctcatagtggaggttctattacagtccgtctctcaagagtcgagtcaccatatctctggacacgtccagcaatctacgtttcccngaagatgtattctgtgaccgcgctgactacgggtctttactacgtgtcgacgagagacgtactattatgtattttggagttggtttacttcgtaactacccgtaagtacgtaccgggacggggtcctaccgggaccccgtggggacccgtaagggtaactacggtcggtacctaccggtcttcccgttacgccctaacccgg

SEQ ID NO: 141002 - DNA, 687 bp, Homo sapiens
  misc_feature: GYAE6OF02IKCN7.46.67.G01.1.454.CMB.1.raw
  modified_base (287)..(287): a, c, t, g, unknown or other
  misc_feature (287)..(287): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgagggccttcgggagaccctgtccctcacctgcgctgtctcgtgtgcctccatcagttgtggtttcttcgtggggcttgggtccgcagctcccgagggagggctggatacagttggaagtgtctcgtcatagtggaggttcctattacagtccgtctctnaagtagtcgagtcacctatatctctggacacgtccagcaagtcctaggttttcccagtaagatgtagtttactggttagacccggtcgtcgttgacgtaccgggtacgttttattaccgtggttcgccgaaggtacgacggtcttaattagttgttagtttttcggaagtttcggtttagtttcgactacccttaagacttcggacggggtcctaccggtaccccggtggggacccgtaggggtaacgtacgttcgggttccgtaacggttcccttaccgttaccgacccgttaccgaacccggtaacccgggacccctacgttacccgggttccccgtttacccccgttccgggacccttacccccgttccccgttacccgacggtacccggtaccccg

SEQ ID NO: 141003 - DNA, 558 bp, Homo sapiens
  misc_feature: GYAE6OF02I9MJH.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccggcaagtcggaacattgacacctatttaaatggtatcaacatagaccagggacgccctaagctcctaatctatgctgcatcctagtttgactaaaggtcgggtccctagtcgtaggttcagtgcgtagtgatcgtaggacagtatttcacgtctcactatactaagtaatcgtagactaacgtagtaagtattttagacttaacttattacttagtactaaatagtaattactaattgttacgacgaaggtacaacgtactaacaaacttaaacgaactagtacgtactacgactaactatctcgttacttactacgttccctacccgtacctacttctagtaac

SEQ ID NO: 141004 - DNA, 566 bp, Homo sapiens
  misc_feature: GYAE6OF02G2RGL.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctccagggaaggggctggaatacattggaagtgtctctcatagtggaggttcctattacagtccgtctctcaagagtcgagtcaccatatctctggacacgtccagcaatctagttttcccctgaagatgagttctgtgaccgcgctgacacgggtctttattactgtgcgagagacggctagttatgtattttggagttggttatttcgactacccgtagatcggacggggctcgacccgtgggccgagggaacgtcgtaggtcaccgtctcctacgcctccgaccgaacgggcccagtccggttccttcccccgtcggtccctaccccgtccctacccgacgtacgtacccg

SEQ ID NO: 141005 - DNA, 537 bp, Homo sapiens
  misc_feature: GYAE6OF02H4RBE.46.67.G01.1.454.CMB.1.raw
  modified_base (249)..(249): a, c, t, g, unknown or other
  misc_feature (249)..(249): n is a, c, g, or t
  modified_base (325)..(325): a, c, t, g, unknown or other
  misc_feature (325)..(325): n is a, c, g, or t
  modified_base (372)..(372): a, c, t, g, unknown or other
  misc_feature (372)..(372): n is a, c, g, or t
  modified_base (376)..(376): a, c, t, g, unknown or other
  misc_feature (376)..(376): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccggnagctccagggaggggctggaatacattggaagtgtctctcatagtggaggttcctattacagtccgtctctcaagngtcgagtcaccatatctctggacacgtccagcaatctagttttcccngaantgtagttctgtgaccgccgctgacacgggcgtttatacgtgtgcgagagcgctattatgtagttttggagttggttatttcgacacctagagtcgacggggtctccggacccgtgggtccgagggaactacgtcggtcaccgttctaccttcgcctacccg

SEQ ID NO: 141006 - DNA, 533 bp, Homo sapiens
  misc_feature: GYAE6OF02FVVLB.46.67.G01.1.454.CMB.1.raw
tcagactagcagtacacgaccggtgctcgatttagagtatacatattgggtttgggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaattggtatcaacatagaccagggacggcccctaagctcctaatctatgctgcatccagtttgcaaagtggggtcccatcgaggttcagtggcagtggatctgggacagtatttcactctcaccatcagtaatctgcaacgtgaagtattttagactaacttattacttgtacaactagtaattactaattgttttacggacctaagggacaacgtactaactaaattaaacgaactgtagctacgacacctatctgttcttactacttccttacccgcctacttcctagtac

SEQ ID NO: 141007 - DNA, 631 bp, Homo sapiens
  misc_feature: GYAE6OF02IS24J.46.67.G01.1.454.CMB.1.raw
  modified_base (335)..(335): a, c, t, g, unknown or other
  misc_feature (335)..(335): n is a, c, g, or t
  modified_base (399)..(399): a, c, t, g, unknown or other
  misc_feature (399)..(399): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatctagttttcccngaagtatgtagttctgtcgaccgccgctgacgacgggtcttttattactgtgcgagacggacgnttattagtagttagttttggagttggttattcgaacctaccctagactcgggaccggggtctacccggacccggtggggacccgtaaggggtaacttacggtcggttacctacccggttaccttacccgttacgcccttacccgaaccgaaccggggtccccaaggttccccggtaccccgtttcccccgttcggcccttaccccccgtacctacccgaacggacctacccg

SEQ ID NO: 141008 - DNA, 604 bp, Homo sapiens
  misc_feature: GYAE6OF02GE89R.46.67.G01.1.454.CMB.1.raw
  modified_base (189)..(189): a, c, t, g, unknown or other
  misc_feature (189)..(189): n is a, c, g, or t
  modified_base (212)..(212): a, c, t, g, unknown or other
  misc_feature (212)..(212): n is a, c, g, or t
  modified_base (467)..(467): a, c, t, g, unknown or other
  misc_feature (467)..(467): n is a, c, g, or t
tcagactagcagtacacgaccggtgctcgatttagagtatacatattgggtttggggtagtctcggtcaggacacagcatggacatgaggtcccgctcagctcctggggctcctgctactctggctcgaggtgccagatgtgacatcgagctgacccagtctccatcctcctgtctgcaaccggtgganacagtgtcaccatcattgccggnaaggtcggaacattcgacacctatttaaacttggtatactaacatagacagggacggccctaagctctaatctatgcctgactatcctagtttacgtacaaaacggtcggggtacccctaagtcggtaacggggtttccaaggttcggcgtaaggtcggaatccgttagggactagtagtttcaacgttctccaactactcagtaatctgacaacgtagaagtagtttagaactacttattacctgtaccgtaanaagtaattaactaattagtttaccgaacgtaggtaacctaccggtaattaaaccaaaagttaaaccgtaacttagtacgttcacgacctaacattcggtacttacgttcaacttcccgtaccgtccattactgtaac

SEQ ID NO: 141009 - DNA, 520 bp, Homo sapiens
  misc_feature: GYAE6OF02JWAF9.46.67.G01.1.454.CMB.1.raw
  modified_base (192)..(192): a, c, t, g, unknown or other
  misc_feature (192)..(192): n is a, c, g, or t
  modified_base (217)..(217): a, c, t, g, unknown or other
  misc_feature (217)..(217): n is a, c, g, or t
  modified_base (479)..(479): a, c, t, g, unknown or other
  misc_feature (479)..(479): n is a, c, g, or t
  modified_base (497)..(497): a, c, t, g, unknown or other
  misc_feature (497)..(497): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggnagtcggacattgacactatttaaatggtatcaacatagaccagggacggcccctaagctcctaatctatgctgcatccagtttgacaaagtcgggtcccatcgaggttcaggtggcagtggatcgtgggactagattcgactctcaccatcagtatcgtgactaacgtgaagttatttgactaacttattcttagtacaactaagtaattacagttcgtttcggacctaggacacgtactaataaagtaacgatagtacgtntacacacagtctctctanacttcctaccgctactctagtac

SEQ ID NO: 141010 - DNA, 568 bp, Homo sapiens
  misc_feature: GYAE6OF02ITRRX.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatcctagtttgctaaagtggggtcccatcgaggttcagtggcagtggatcgtgggacagtattcactctcaccatcagtaatctgctaacgtgaagtatttgactaacttattacttgtacaactaagtaattacaattggtttacggaccgaagggtacaacggtaactaactaaaattaaaacgtaactagtacggtactacgacctaacctaattacgttcgttacctttacgtacttccgtttaccccgaccctacttacctagtaacg

SEQ ID NO: 141011 - DNA, 512 bp, Homo sapiens
  misc_feature: GYAE6OF02GC4I6.46.67.G01.1.454.CMB.1.raw
  modified_base (509)..(509): a, c, t, g, unknown or other
  misc_feature (509)..(509): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatctgggacagatttcactctcaccatcagtaatctgcaacgtgaagtattttgactaacttattacttgtacaacagtaattacaattgttttacggctaagggacacgactaacaaattaaacgaactgtagctgacacatctgtcttcactccttcccgctactctntac

SEQ ID NO: 141012 - DNA, 566 bp, Homo sapiens
  misc_feature: GYAE6OF02JA1O7.46.67.G01.1.454.CMB.1.raw
  modified_base (248)..(248): a, c, t, g, unknown or other
  misc_feature (248)..(248): n is a, c, g, or t
  modified_base (373)..(373): a, c, t, g, unknown or other
  misc_feature (373)..(373): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccgnagctcccgagggaaggggctggaatacattggaagtgtctctcatagtggaggttcctattacagtccgtctctcaagagtcgagtcaccatatctctggacacgtccagcaatcagttttcccngaagatgagttctgtcgaccgccgctgacacgggtctttatacgtgtgcgagagacggtctattagtgtattttggagttggtttatttcgactaccctagactcggacggggtctaccggtccccgtggggccaaggggaacttacgtacggtccgtacccgttccgtccgtttacggccccttaaccccgg

SEQ ID NO: 141013 - DNA, 559 bp, Homo sapiens
  misc_feature: GYAE6OF02HYBMI.46.67.G01.1.454.CMB.1.raw
  modified_base (331)..(331): a, c, t, g, unknown or other
  misc_feature (331)..(331): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccgcagctccagggagggctggaatacattggaagtgtctctcatagtggaggttcctattacagtccgtctctcaagagtcgagtcaccatatctctggacacgtccagcaatctagttttcccngaagatgagttctgtgaccgcgctgacacgggtcttttatactgtgcgagagacggctattatgtattttggagttggtttatttcgactacctagatcggacggggctcgacccgtgggccgagggaactacgtgtcacgtcctccgttacgcctaccgaccgaacggccccagtccggttcccttccccgtcggccctaccccgttccctaccacggacgtacccg

SEQ ID NO: 141014 - DNA, 598 bp, Homo sapiens
  misc_feature: GYAE6OF02JCZZE.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgcccctaagctctaatctatgctgcatccagtttgacaaagtcgggtcccatcgaggttcagtggcagtggatcgtgggacagtatttcactctacacctatctagtaactctagactaacgtgaagtattttgacttaacttattactgtactaactaagtaactttactaatttcgtttaccggaaccgtaagggtaacctaacgtaacttaaactaaaacgtttaaacgaacgttaggttacggacttacggacctaaccgtacttaccgttacgtttacctttactacctttcccttacccgacccttaacgttcccgtagtaacc

SEQ ID NO: 141015 - DNA, 856 bp, Homo sapiens
  misc_feature: GYAE6OF02I4I3T.46.67.G01.1.454.CMB.1.raw
tcagactagcagtacacgaccggtgctcgatttagagtatacatagttaggggtttacggggaacgtcgtccggtcagggacacacgcatggacagtgacggtccccgctcaggctccgtggggctcctgctactctggctcgagtgcagatgtcacactcgagctcgaccagtcctcctactcccgtcctgtcgtcggaccgaaccgggtgggacgacgtacggttcgtaccaaccgtagttccacgttcgggacccgggacgtaacggttaccgggaaattgtttaacggaaccctaaccgtttaaagttttaaacggttatccgggtaaacctacgtaaacggtaaccttaagggaaaccccgacggttaaacgggggcccccttaaaacgggtaaccttacccgttaaaacgttccggtaaacttggggtaccttaaggtaccctaaagttttaccgacggttttaaacggtaccgggtaaaaccggttacgggggttaacccctaggtttaaccggtaaacgggttttacggaacggttacgggtacggtaaacggtttacggggtaacggttaccggtaggggtaaccgttaacgtaaccgttttaccgaaccgtacccttacgaaccctaagttaacgtacgtaacgtacgtacgtacgaacgtagtagtagttacgtactacgttagtacgtacgtacgtaacattacgtaacgaacttacggttaccgtaacggtaacgtaacgtaacgtaacgtaaacgtaaacgtaaacgtaacgttacgtacgtacgtaacgtacgtaacgtacgtacgtacgttacgtacgtaccgtaccgtaccgtacgtac

SEQ ID NO: 141016 - DNA, 601 bp, Homo sapiens
  misc_feature: GYAE6OF02I4VT5.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgaggggaagggctggaatacattggaagtgtctctacatagtggaggttcctattacagtccgtctctcaagagtcgagtcaccatatctctggacacgtccagcaaatcagttttccctgaagatgagttctgtgaccgccgctgacacgggtctttatactgtgcgagagacggctatatgtattttgagttgtatttcgactaccctagatcggaacggggctcgaccccgtgggacccgaggggtaaactaccgtggtaccaccgttccgtacctttacgccttacccgaaccgaacggggaccccacgttacccgggttcctttccccccgttacgggccctaaccccgttcccgtaccgtaaaccgacgttaccccg

SEQ ID NO: 141017 - DNA, 584 bp, Homo sapiens
  misc_feature: GYAE6OF02INODO.46.67.G01.1.454.CMB.1.raw
  modified_base (245)..(245): a, c, t, g, unknown or other
  misc_feature (245)..(245): n is a, c, g, or t
  modified_base (249)..(249): a, c, t, g, unknown or other
  misc_feature (249)..(249): n is a, c, g, or t
  modified_base (294)..(294): a, c, t, g, unknown or other
  misc_feature (294)..(294): n is a, c, g, or t
  modified_base (325)..(325): a, c, t, g, unknown or other
  misc_feature (325)..(325): n is a, c, g, or t
  modified_base (416)..(416): a, c, t, g, unknown or other
  misc_feature (416)..(416): n is a, c, g, or t
  modified_base (428)..(428): a, c, t, g, unknown or other
  misc_feature (428)..(428): n is a, c, g, or t
tcagactagcagtacacgaccggtgctcgatttagagtatacatattgggtttgggagtctcggtcaggacacagcatggacatgaggtccccgctcagctccgtggggctcctgctactctggctcgaggtgccagatgtgacatcgagctagacccagtctccatcctcctgtctgcaaccgtggagacagtgcaccgatcatgccggcaagtcggaacattgacactattaaatgtatcaanatanacaggacgcctaagctacctaatctaatgactgacagtccagttnacaaagtgggtaccagtcgaggttcagtganagtgagtctgggacagattcactctacacatacaagtaatctagaccaaagtgaaagtattttacgactaactttaataacttgtacaaanacgtaaattaanaattgtttaccggacctaaagggactacggtaaactaactaaaaactttaaacggaaaccttggtagtcgttaacggactaaacccgaaggttctacggttacctttaacgactttaccccgttacccggacccttaaggtccctttagaaacccg

SEQ ID NO: 141018 - DNA, 568 bp, Homo sapiens
  misc_feature: GYAE6OF02H5KH4.46.67.G01.1.454.CMB.1.raw
  modified_base (217)..(217): a, c, t, g, unknown or other
  misc_feature (217)..(217): n is a, c, g, or t
  modified_base (289)..(289): a, c, t, g, unknown or other
  misc_feature (289)..(289): n is a, c, g, or t
  modified_base (304)..(304): a, c, t, g, unknown or other
  misc_feature (304)..(304): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgtcagatgtgacatcgagctgacccagtctccatcctccctgtctgcaaccgtgggagacagtgtcaccatcacttgccgggnaagtcggaacattgacacctatttaaattggtatcaacatagaccagggacgcccctaagctcctaatctangctgcatccagtttncaaaggtgggtccatcgagttcagtgcagtgatctgggacagatttcactctcaccatcagtaatctgacaacgtgtaagtattttgactaactttattactgtacaacagtaaattaactaattggttttacggaccgtaaagggtaccaacgtaacttaaactaaaacttaaacgtaacgttagtaggtacttaggacctaacctaacgttcttagttacctttactacttccgttaccccgtacctacttcctaggtaacc

SEQ ID NO: 141019 - DNA, 604 bp, Homo sapiens
  misc_feature: GYAE6OF02JIYXW.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacacctatttaaattggtatcaacatagaccagggacggcccctaagctcctaatctatgctgcatccagtttgcaagtcgggtcccatcgagttcagtggcagtgatctgggacagtattcactctcaccatcagtaatctgcaacgtgaagtatttgctaacttattactgtacaacagtaattacaattcgttttacggacctaaagggtacctaacggtaaccttaaactaaaacgtttaaaaccgaaacgttacggtacggtaccgtacggtaccgtaacccgtaacgtttaccgttacggtttaccctttaccgtaacctttcccgtttacccccggtaccctaacgtttacccgttacggttaacc

SEQ ID NO: 141020 - DNA, 605 bp, Homo sapiens
  misc_feature: GYAE6OF02HYDMP.46.67.G01.1.454.CMB.1.raw
  modified_base (227)..(227): a, c, t, g, unknown or other
  misc_feature (227)..(227): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaacgtgggagacagtgtcaccatcacttgccgggcaagtcggaacnttgacactatttaatgtatcaacatagacagggacgcccctaagctcctaatctatgctgcatccagtttgacaaacgtgggtacccatcgaggttcagtggcagtgatcgtggactagtattcactctcacatactagtaatctagacaacgtgaagttatttcgactaacttacttacttagtacaactaagtaaattaactaagtttacgttttaccggaccgtaaacggggtaacctaaaccggtaaccgttaaaacaaaacgtttaaaacgtaaccgttaggtacgtacgttacggactaaccctaacttccgtacgtttaccgttacgtaccgttacccgttccccgtaccgttacgttaccgtagttaacc

SEQ ID NO: 141021 - DNA, 554 bp, Homo sapiens
  misc_feature: GYAE6OF02F5DQI.46.67.G01.1.454.CMB.1.raw
  modified_base (335)..(335): a, c, t, g, unknown or other
  misc_feature (335)..(335): n is a, c, g, or t
  modified_base (340)..(340): a, c, t, g, unknown or other
  misc_feature (340)..(340): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctccgagggaaggggctggaatacattggaagtgtctctcatagtggaggttcctattacagtccgtctctcaagagtcgagtcaccatactctctggacacgtccagcaatcagttttcccngaagntgagttctgtgaccgccgctgacacgggctttatactgtgcgagagcggctattatgtattttggagttggttatttcgacacccttagatcgacggggctcgaccctggggccagggatacgtgtccacgtcttcctgccttccgaccgtaacgggcccacgtccggttccttccccgtcggcccgtccctcccgtaccgtacgtacgtcccg

SEQ ID NO: 141022 - DNA, 561 bp, Homo sapiens
  misc_feature: GYAE6OF02FUGMB.46.67.G01.1.454.CMB.1.raw
  modified_base (334)..(334): a, c, t, g, unknown or other
  misc_feature (334)..(334): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttcccngaagatgagttctgtgaccgccgctgacacgggctttatactgtgcgagagacggctattatgtattttggagttggttatttcgacaccctagatcgacggggctcgaccccgtggggccaggggaatacgtggtcaccgttctccttagcccttccgaccgaacgggcccagtcccgggttcctttccccccgtggcccaccccgtccctacccgaacgcgaccc

SEQ ID NO: 141023 - DNA, 563 bp, Homo sapiens
  misc_feature: GYAE6OF02IVKHW.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacacctatttaaattggtatcaacatagaccagggacggcccctaagctcctaatctatgctgcatccagtttgcaaagtcgggtcccagtcgaggttcagtggcaggtggatcgtggacagtatttcactctacacctatcagtaactctgacaacgtgaagtattttgactaactttattacttgtacaactagtaattaacaattcgtttcggacctaagggacctaacgtaacttaacaaaagttaaacgaacgttgtacggtactagacctaactacgttactacgttcttactacgttaccttcccgacctacgttacctagtaac

SEQ ID NO: 141024 - DNA, 518 bp, Homo sapiens
  misc_feature: GYAE6OF02GJ0N0.46.67.G01.1.454.CMB.1.raw
  modified_base (494)..(494): a, c, t, g, unknown or other
  misc_feature (494)..(494): n is a, c, g, or t
  modified_base (515)..(515): a, c, t, g, unknown or other
  misc_feature (515)..(515): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatcgtgggacagatttcactctcaccatcagtaatctgacaacgtgaagtatttgactaacttattactgtacaactagtaattactaagttcgttttacggacctaagggactacgactaactaaattaaacgaactgtagctagcacatctntcttcactctcccgcactctntac

SEQ ID NO: 141025 - DNA, 558 bp, Homo sapiens
  misc_feature: GYAE6OF02IG7PF.46.67.G01.1.454.CMB.1.raw
  modified_base (211)..(211): a, c, t, g, unknown or other
  misc_feature (211)..(211): n is a, c, g, or t
  modified_base (249)..(249): a, c, t, g, unknown or other
  misc_feature (249)..(249): n is a, c, g, or t
  modified_base (376)..(376): a, c, t, g, unknown or other
  misc_feature (376)..(376): n is a, c, g, or t
  modified_base (436)..(436): a, c, t, g, unknown or other
  misc_feature (436)..(436): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttctctggggctgggtccggnagctcccagggaagggctaggaatacattggaagtgtctctcatagtggaggttcctattacagttccgtctctcaagagtcgagtcacatatctctgacacgtcagcaatctacgttttccagaanatgagtttctgtcgaccgcgctgacgacgggtctttatactgtgcgagagacgctagttntgtagttttggagttggttatttcgactacctagacgtcggacggggtctccggacccggttcgggaccgtaagggtaactacgttcggtaccgaccggttcctccgttacgtccctacccg

SEQ ID NO: 141026 - DNA, 541 bp, Homo sapiens
  misc_feature: GYAE6OF02IFHPA.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatgtatcaacatagaccagggacgcccctaagctcctaatctatgctgcatccagtttgcaaagtgggtcccatcgaggttcagtggcagtgatctgggacagatttcactctcaccatcagtaatctgcaagtgaagtattttagactaactttattactgtacaactagaattaacaattgtttcggacctaaggacaacgtaactaactaaaattaaacgaacgttagtaggctacgacaacctaattcttagttaccttacgtacttccgttaccccgcctaattcctagtaac

SEQ ID NO: 141027 - DNA, 520 bp, Homo sapiens
  misc_feature: GYAE6OF02F5QY5.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatctgggacagatttcactctcaccatcagtaatctgcaacgtgaagtattttagctaacttattactgtacaacagtaattacaattcgttttacggacctaagggacacgactaactaaattaaacgaactgtagactgactacattctgttcttacacttcttcccgcactctagtac

SEQ ID NO: 141028 - DNA, 560 bp, Homo sapiens
  misc_feature: GYAE6OF02GKHZ9.46.67.G01.1.454.CMB.1.raw
  modified_base (337)..(337): a, c, t, g, unknown or other
  misc_feature (337)..(337): n is a, c, g, or t
  modified_base (533)..(533): a, c, t, g, unknown or other
  misc_feature (533)..(533): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtccctcacctgcgctgtctctggtgcctccatcagtagtggtttcttctggggctgggtccggcagctcccgagggaaggggctggaatacattggaagtgtctctcatagtggaggttcctattacagtccgtctctcaagagtcgagtcaccatatctctggacacgtccagcaatcagttttccccngaagatgagttctgtcgaccgccgctgacacgggtcttttaattactgtgcgagagacggctagttatgtatttttggagttggttatttcgactaccctagatcggacggggctcgacccgtggggccagggaatacgtggtccaccgtctccgttacgcctccaccgaacgggcccagtccgtcccttccccgngcccaccctccctaccacgacgtcccg

SEQ ID NO: 141029 - DNA, 705 bp, Homo sapiens
  misc_feature: GYAE6OF02GLT7B.46.67.G01.1.454.CMB.1.raw
  modified_base (311)..(311): a, c, t, g, unknown or other
  misc_feature (311)..(311): n is a, c, g, or t
  modified_base (343)..(343): a, c, t, g, unknown or other
  misc_feature (343)..(343): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgagggaaggggctaggaatacagttggaagtgtctctcagtaggtggaggttcctattacagtccgtctctcaagagtcgagtcacatatctngacacgtcagacaatctacgtttccagaagtntgtagttctgtcgacccgcgtcgtcgtacgtacgggttcttttaatacgtgtgacgagacgacggtacttaagtttagtagttttaggttttacggtaggtttacggtttactttaccggaaccgtacccgtaaggtaccggtaccggggtaccggggtaccctacccggtaaccccgggtggggaccgtaaaggggtaaccgttccggttaccggttacccgtacccgtttaccgttacccgttacccgtacccgtacccggtaacccggaacccgggtcccttaccggttccccggtttacccccttccccggtccggaccccttcccccgttaccgaaccgaccggtaccgtaccccgg

SEQ ID NO: 141030 - DNA, 782 bp, Homo sapiens
  misc_feature: GYAE6OF02IFR73.46.67.G01.1.454.CMB.1.raw
  modified_base (191)..(191): a, c, t, g, unknown or other
  misc_feature (191)..(191): n is a, c, g, or t
  modified_base (194)..(194): a, c, t, g, unknown or other
  misc_feature (194)..(194): n is a, c, g, or t
  modified_base (213)..(213): a, c, t, g, unknown or other
  misc_feature (213)..(213): n is a, c, g, or t
  modified_base (222)..(222): a, c, t, g, unknown or other
  misc_feature (222)..(222): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctccatcctccctgtctgcaaccgtggganacngtgtcaccatcatgccggnaagtcgaanttgactactatttaaatggtatcaacatagacgagggaccgccctaagaccttacctaatctatgcttcgctatcctagtttcgacgtaaacggttcggggtacccagttaccggtaacggtttacgacggttggactaggttaggaacgttcggtagggtaacctaggtaacgttttccgaaccgtttcctacccgtaaccctagttaccgtaaggtttaacttccgttacgaccgttaaaccgtaggtaaagtttacgttttacggtaacttaaacgttttaacttaaccgtttaacggttaacctaaacgtaagttaaacgtttaaacgtaaacgttttacgggttttacccgggtaaccgttaaacggggtaacctaaaaccggttaaaccgtttaaaaccgttaaaaacgtttaaaacggtaaaccgtttaggttaaccgggtaccttaaccggtaccgtaaacccgttaacgttaccgtttaacgttaccttttaccgtaacctttaccccgttaccccggttacccctaacgtttacccttaaggttaacccg

SEQ ID NO: 141031 - DNA, 515 bp, Homo sapiens
  misc_feature: GYAE6OF02GMETS.46.67.G01.1.454.CMB.1.raw
  modified_base (494)..(494): a, c, t, g, unknown or other
  misc_feature (494)..(494): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatctgggacagatttcactctcaccatcagtaatctgcaacgtgaagatttgactaacttattactgtactaacagtaaattacaattgttttacggacctaagggacacgacttaacaaattaaacgaactagtgactgacacatctgtcttanacttcttcccgcactctgtac

SEQ ID NO: 141032 - DNA, 618 bp, Homo sapiens
  misc_feature: GYAE6OF02I3M5Q.46.67.G01.1.454.CMB.1.raw
  modified_base (291)..(291): a, c, t, g, unknown or other
  misc_feature (291)..(291): n is a, c, g, or t
  modified_base (338)..(338): a, c, t, g, unknown or other
  misc_feature (338)..(338): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgagggaggggctggaatacagttggaagtgtctctcataggtggaggttcctattacagtccgtctctcaagngtcgagtcaccatatctctggacacgtccagcaatctagttttcccngaagatggagttctgtcgacccgcgctcgacgtacgggtcgtttattactgtgcgagacgacgggcttattatgttagttttggagttggttactttccgactacccgttagacgtcggacggggtcgtcccgaccccgtggggaccgagggtaactacgtcggtacctacccgttcctaccgttacgccctacccgaacccggaacgggtaccctacgttcccggttccctttcccccgtcggtaccctaccccgttccctacccgacggtacgtcccg

SEQ ID NO: 141033 - DNA, 513 bp, Homo sapiens
  misc_feature: GYAE6OF02FZYSQ.46.67.G01.1.454.CMB.1.raw
  modified_base (506)..(506): a, c, t, g, unknown or other
  misc_feature (506)..(506): n is a, c, g, or t
  modified_base (510)..(510): a, c, t, g, unknown or other
  misc_feature (510)..(510): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatctgggacagatttcactctcaccatcagtaatctgacaacgtgaagtattttagctaacttattacttgtacaactagtaattacaattgtttcggactaagggacaacgacttaacaaattaaacgaactagtagctagcacatctgtcttgctccttcccgcntctntac

SEQ ID NO: 141034 - DNA, 523 bp, Homo sapiens
  misc_feature: GYAE6OF02GI2O9.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatctgggacagatttcactctcaccatcagtaatctgcaacgtgaagtattttgactaacttattacttgtactaacagtaaattacaattgttttcggacctaagggacacgaacttaacaaaattaaacgaacttgtagctgacacattctgttcttcacttccttcccgcctattctgtac

SEQ ID NO: 141035 - DNA, 611 bp, Homo sapiens
  misc_feature: GYAE6OF02JIXO8.46.67.G01.1.454.CMB.1.raw
  modified_base (251)..(251): a, c, t, g, unknown or other
  misc_feature (251)..(251): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctccatcctccctgtctgcaaccgtggagacagtgtcaccatcacttgccgggcaagtcggaacattgacacctattaaattgtatcaanatagacaggacgccctaagctactaatctatgctgcatccagtttcgacaaggtcgggtcccagtcgagttcagtgcgagtgatcgtaggacagtattcactctacacatcgtagtaatcgtagactaaacgtagaaagttactttgaaccttaagttactttaactgttacgaaactaacggtaaatttaacgtaagtttacgttttaccggaccgtaaacgggtacctaacggtaacttaaacgaaaagttaaacgaaacgttgttaacggaccgttacgaacgaacccttaagttaccgttagttaccctttactaaccttttccgtaaccccgttacctaacgtaccttagtaacc

SEQ ID NO: 141036 - DNA, 673 bp, Homo sapiens
  misc_feature: GYAE6OF02IR2IH.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctccatcctccctgtcctgcaaccgtggganacagtgtcaccatcacttggccgggcaagtcggaacattgactactatttaaatggtatacaacatagacagggaccgaccctaagctacctaatctatgctgacatcctagtttgacgtaaaggtcgggttacccagttcggaacggttcgaaggtggactaggttaggaacgttcgtaggggaactaggtaactttccaacttctaccgaaccctaatccgtaagttaaacttcgtacgtaacgtaaacggtgtaaagttattttcgaacttaactttaagttacttacgtactaaacgtaagttaaacttacgtaactttacggtttccggaaccgtaaacgggaaacctaaccgtaaaccgttaaactaaaacgtttaaaacgtaaccgttaggttggacgttacgaccgtaacctaacttcttacgttacttaccgtaacgtttcccgttacccgaccgtacttacgtacgtaacg

SEQ ID NO: 141037 - DNA, 514 bp, Homo sapiens
  misc_feature: GYAE6OF02GH6Q3.46.67.G01.1.454.CMB.1.raw
  modified_base (358)..(358): a, c, t, g, unknown or other
  misc_feature (358)..(358): n is a, c, g, or t
  modified_base (452)..(452): a, c, t, g, unknown or other
  misc_feature (452)..(452): n is a, c, g, or t
  modified_base (468)..(468): a, c, t, g, unknown or other
  misc_feature (468)..(468): n is a, c, g, or t
  modified_base (489)..(489): a, c, t, g, unknown or other
  misc_feature (489)..(489): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcgaacattgacacctatttaatggtatcaacatagaccaggacggcccctaagctcctaatctatgctgcatccagtttgcaaagtggggtcccatcgaggttcagtggcagtggatcgtgggacagtattcactcncaccatcagtaatctgcaacgtgaatattttgactaacttattactgtacaacagtaattacaattgtttacgacctaagggacacgtactaanaaattaaacgaactgngtctgacaccattctgttctntacttccttacccgctactctgtac

SEQ ID NO: 141038 - DNA, 571 bp, Homo sapiens
  misc_feature: GYAE6OF02GYUMZ.46.67.G01.1.454.CMB.1.raw
  modified_base (217)..(217): a, c, t, g, unknown or other
  misc_feature (217)..(217): n is a, c, g, or t
  modified_base (541)..(541): a, c, t, g, unknown or other
  misc_feature (541)..(541): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacacctatttaaatgtatcaacatagaccagggacggcccctaagctcctaatctatgctgcatccagtttgcaaagtgggtcccagtcggaggttcagtggcaggtggatcgtgggacagtatttcactctcactatcaagttaatctagactaacgtgaaagtattttacgactaaactttattactagtacaaacagtaaatttaactaattgttttaccggaccgtaaagggtaccaacgtaacttaaactaaaatttaaacgaaacttgtaggactagtaccgtaaccattcgtagttcccttanacttcccgtaccctccgtacttctagtaac

SEQ ID NO: 141039 - DNA, 524 bp, Homo sapiens
  misc_feature: GYAE6OF02HV232.46.67.G01.1.454.CMB.1.raw
  modified_base (498)..(498): a, c, t, g, unknown or other
  misc_feature (498)..(498): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgcccctaagctcctaatctatgctgcatccagtttgcaaagtgggtcccatcgaggttcagtggcagtgatcgtgggacagattcactctcaccatcagtaatctgcaacgtgaagtattttgactaacttattactgtacaacagaattacaattgtttacggacctaagggactaacgactaactaaattaaacgaactagtggactagacaactatctgttccttanacttccttcccgctacttctagtaac

SEQ ID NO: 141040 - DNA, 565 bp, Homo sapiens
  misc_feature: GYAE6OF02G8PDE.46.67.G01.1.454.CMB.1.raw
  modified_base (333)..(333): a, c, t, g, unknown or other
  misc_feature (333)..(333): n is a, c, g, or t
  modified_base (368)..(368): a, c, t, g, unknown or other
  misc_feature (368)..(368): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccgcagctcccagggaaggggctggaatacattggaagtgtctctcatagtggaggttcctattacagtccgtctctcaagagtcgagtcaccatatctctggacacgtccagcaatcagttttcccngaagatgagttctgtgaccgcgctgacgacgggtnttttattactgtgcgagagacggcttattatgtagtttttggagttggttatttcgaactaccctagtatcggacggggctcgacccgtggggccagggactacgtgtctaccgtcttcctacgcctaccgaccgaacgggccctacgtccggtccctttccccgcggccctaccccgtccctccgacgtcgacccg

SEQ ID NO: 141041 - DNA, 512 bp, Homo sapiens
  misc_feature: GYAE6OF02FSG77.46.67.G01.1.454.CMB.1.raw
  modified_base (489)..(489): a, c, t, g, unknown or other
  misc_feature (489)..(489): n is a, c, g, or t
  modified_base (493)..(493): a, c, t, g, unknown or other
  misc_feature (493)..(493): n is a, c, g, or t
  modified_base (505)..(505): a, c, t, g, unknown or other
  misc_feature (505)..(505): n is a, c, g, or t
  modified_base (509)..(509): a, c, t, g, unknown or other
  misc_feature (509)..(509): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgctaaagtggggtcccagtcgaggttcagtggcagtggatcgtgggacaggatttcacttctcaccatcagtaatctgcaacgtgaagtattttgactaacttattacttgtacaatagaattacaattgtttcgaccgtaaggacacgactaactaaataaacgaactgtagctgacacatctntctntactcttccgcntctntac

SEQ ID NO: 141042 - DNA, 552 bp, Homo sapiens
  misc_feature: GYAE6OF02F9JNY.46.67.G01.1.454.CMB.1.raw
  modified_base (377)..(377): a, c, t, g, unknown or other
  misc_feature (377)..(377): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagacccctgtccctcacctgcgctgtctctggtgcctccatcagtagtggtttctctggggctggggtccggcagcctcccgagggaaggggctggaatacattggaagtgtctctcatagtggaggttcctattacagtccgtctctcaagagtcgagtcaccatatctctggacacgtccagcaatcagttttcccngaagatgagtttctgtgaccgccgctgacacgggtcgtttatactgtgcgagagacggctattatgtatttttggagttggtttatttcgactaccctagacgtcggacggggtctccggtacccgtggggcccaagggtactacgtggtcaccgtctccgttacgccctacccg

SEQ ID NO: 141043 - DNA, 568 bp, Homo sapiens
  misc_feature: GYAE6OF02HWHMR.46.67.G01.1.454.CMB.1.raw
  modified_base (393)..(393): a, c, t, g, unknown or other
  misc_feature (393)..(393): n is a, c, g, or t
  modified_base (398)..(398): a, c, t, g, unknown or other
  misc_feature (398)..(398): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgagggagggctggaatacattggaagtgtctctcatagtggaggttcctattacagtccgtctctcaagagtcgagtcaccatatctctggacacgtccagcaatctacgttttcccagaagatgtagttctgtcgacccgccgctgactacgggtctttattacgtgtgcgagngacgntatatgtagttttggagttggtttattcgactaccctagacgtcggacggggcctcggaccccgtggggacccgagggaactacgtggtccaccgtcttccgtacgccctccgaccgaacggcccagtccgtcccttccccgtgccctaccctcctaccgacgctacccg

SEQ ID NO: 141044 - DNA, 551 bp, Homo sapiens
  misc_feature: GYAE6OF02FWG4B.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatgtatcaacatagaccagggacggcccctaagctcctaatctatgctgcatccagtttgcaaagtggggtcccatcgagttcagtggcagtggatctgggacagattcactctcaccatcagtaactctgacaacgtgaagtatttgactaacttattactagtacaactagtaattaactaattagttttccggactaaagggacaacgaacttaaacgtaaaattaaaacgaaacttagtaggtactagaccgtaacagttactgtacctttcacttccttaccccgtctacttccgtagtaccg

SEQ ID NO: 141045 - DNA, 552 bp, Homo sapiens
  misc_feature: GYAE6OF02HPOIZ.46.67.G01.1.454.CMB.1.raw
  modified_base (290)..(290): a, c, t, g, unknown or other
  misc_feature (290)..(290): n is a, c, g, or t
  modified_base (525)..(525): a, c, t, g, unknown or other
  misc_feature (525)..(525): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctgggaatacattggaaagtgtctctcatagtggaggttcctattacagtccgtctctcaagngtcgagtcaccatatctctggacacgtccagcaatcagttttccctgaagatgagttctgtgaccgcgctgacacgggtcttttattacgtgtgcgagacgacgtctattatgtagtttttggagttgttatttcgactaccctagatcggacgggctcgacccgtggggaccagggactacgtgtccaccgtctccttagcctccaccgaacggcccagtccggtccttccccncggtccacccctcctccacgacgaccg

SEQ ID NO: 141046 - DNA, 574 bp, Homo sapiens
  misc_feature: GYAE6OF02GMT63.46.67.G01.1.454.CMB.1.raw
  modified_base (192)..(192): a, c, t, g, unknown or other
  misc_feature (192)..(192): n is a, c, g, or t
  modified_base (387)..(387): a, c, t, g, unknown or other
  misc_feature (387)..(387): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacacctatttaaatgtatcaacatagacaggacgcccctaagctcctaatctatgctgcatccagtttgactaaaggtgggtcccagtcgaggttcagtgcaggtgatcgtggacagtattcgactctcacatcagtatctgactaacgtgaagtntttagacttaacgttattacgttcgtacaaacgtagtaacttaacaagtttcgtttccggaaccgtaaagggtacctaacgtaacttaaaccaaaagtttaaaccgaacgttagtagtactacgacctaacctattaccgtgttaccttacgtacttccgttacccgaccgtacttcgtagttaacg

SEQ ID NO: 141047 - DNA, 536 bp, Homo sapiens
  misc_feature: GYAE6OF02I4TVB.46.67.G01.1.454.CMB.1.raw
  modified_base (251)..(251): a, c, t, g, unknown or other
  misc_feature (251)..(251): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactattaattgtatcaanatagaccagggacggcccctaagctcctaatctatgctgcatccagtttgcaaagtgggtacccatcgaggttcagtggcagtggatctgggacagatttcactctcaccatcagtaatctcgacaacgtgtaagattttgactaacttattactgtacaactagtaaattactaatgttttacggaccgtaaaggactaacgtactaactaaagttaaacgaaactagtacgctagcaaccatcgtagttcttacacttccttacccgcctagttcctgtaacg

SEQ ID NO: 141048 - DNA, 664 bp, Homo sapiens
  misc_feature: GYAE6OF02GZ8RJ.46.67.G01.1.454.CMB.1.raw
  modified_base (231)..(231): a, c, t, g, unknown or other
  misc_feature (231)..(231): n is a, c, g, or t
  modified_base (261)..(261): a, c, t, g, unknown or other
  misc_feature (261)..(261): n is a, c, g, or t
  modified_base (395)..(395): a, c, t, g, unknown or other
  misc_feature (395)..(395): n is a, c, g, or t
tcagactagcagtacacgaccggtgctcgatttagagtatacatattggtttggggtagtcgtcggtcgaggacacagcatggacatgaggtcccgctcagctcctggggctcctgctactctggctccgaggtgccagatgtgacatcgagctgacccagtctccactcctccctgtcctgcaaccgtgggagaccagtgtcaccatcacgttgccggacaagtcggaanattgacaccttattaaatgtatcaacatanacaggacgcccctaagctacctaatctactgctgcactcagtttcgcaaaggtgggtcccagtcgaacgggtttcaaggttgcgaagttggcttactgggacagactttcgaactctcgactagtcagtatctnactaacgtgtaagtaatttgtacccctaattactttaacttacgtactaactaacgtaaattaactaagttacttttacgggtaacccgttaaagggtaaccgtaaccggtaacgttaaaccgtaaaacctttaaaaaccggtaaaaccgttaacgggttaacgtaccgttaaggtaccctaaccggtaacttaccgttacggttacccgtttacccgtaaccgttttacccttccccggttacccctaaccgttccctacgttaaccg

SEQ ID NO: 141049 - DNA, 784 bp, Homo sapiens
  misc_feature: GYAE6OF02JGKIJ.46.67.G01.1.454.CMB.1.raw
  modified_base (247)..(247): a, c, t, g, unknown or other
  misc_feature (247)..(247): n is a, c, g, or t
  modified_base (249)..(249): a, c, t, g, unknown or other
  misc_feature (249)..(249): n is a, c, g, or t
  modified_base (281)..(281): a, c, t, g, unknown or other
  misc_feature (281)..(281): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccgcagctccgagggagggctggaatacagttggagtgtctntnataggtggagttcctattacagtccgtctctnaagagtcgagttccacctatacgtctactggactacgtccagctaatcagttttcccagacgactgtagttctgtcgaccgcctctgacgacgggtcgttattacgtgtcgcgtaggacgtacggtctaacgttagtagttacgttttagggtaggtttaggtttacgtttaccggtaaccgttacccgttaaggtaccgttaccggggtaccgggggtacccttacccgggtaaccccgggttcgggggtaccccggtaaagggggtaacctttaaccggggttaccgggttacccggttaaaccccggtttccccggtttacccgtttaaccgggtccccgttacccccggtaaacccgggtaaaccccgggggtacccctaacgggttttaacccccgggtttcccccggtttaccccccccggtttacggggaccccccttacccccccggttaaccccggtttacccccggtaaacggttacccggttaaccccccgg

SEQ ID NO: 141050 - DNA, 573 bp, Homo sapiens
  misc_feature: GYAE6OF02GVKS3.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatctgggacagtatttcactctcaccatcagtatctgcaacgtgaagtatttgactaacttattacttagtacaacagtaaattactaattggttttacggaccgtaaaggggtaccaacggtaaccttaaactaaaactttaaacgaaacttagtacggtactcggtaccaacctaattccttacgtttcctttactacttccttacccccgtacctacgttcctaggtaacc

SEQ ID NO: 141051 - DNA, 554 bp, Homo sapiens
  misc_feature: GYAE6OF02FSJ64.46.67.G01.1.454.CMB.1.raw
  modified_base (432)..(432): a, c, t, g, unknown or other
  misc_feature (432)..(432): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctcatcagtagtggtttctctggggctgggtccgcagctccagggagggctggaatacattggaagtgtctctcatagtggaggttcctattacagtccgtctctcaagagtcgagtcaccatatctctggacacgtccagcaaatctaacgttttcccagaagatgagttctgtgaccgccgctgacacgggtcgtttattacttgtgcgagagacggntattatgtatttttggtagttggttatttcgactaccctagacgttcggacggggtctccggtaccccgtggggacccaagggaatacgtggtccgaccgttccgtccttacgccctacccg

SEQ ID NO: 141052 - DNA, 769 bp, Homo sapiens
  misc_feature: GYAE6OF02H50IL.46.67.G01.1.454.CMB.1.raw
  modified_base (260)..(260): a, c, t, g, unknown or other
  misc_feature (260)..(260): n is a, c, g, or t
tcagactagcagtacacgaccggtgctcgatttagagtatacatattgggtttggggggacctcctgtgcaagaacatgaagcacctgtggtttgtcctcctggctggtggcagctcccagactgggtcctgtccctggtgcaactgcagggagtcgggcccacgacctggtgacggcctttcggagaccctgtcccctcacctgcgctgtctctggtcgcctccatcagtagtcggtttctactggggctgggtccggnagtctcccgagggtaacgggctggaatactagtttgggaaagttcgtacctcgtaccaagttacgtacgggtacgtttcctaatttacgaggttccgttcctactaccaaaggtacgtccgagtccgaaccgtattactccttcgtacggacctacgttccgaagtactaaactccgtaacgtttttaccccagggtaaacgtacgttacggtaacgtttccgttacggttccggaacccggtccgtaccgtacggtaaccgtacggggttacgttttaacgtttacgttggttacggtacggaagttaacggtacgggtactttaagtttacgttaggttttaacggtttttcgggtaaggttttaggtttacgttttacggtaaccctaacccgttaaggtaacgtcgggtaccgggggtacctacccgggtacccggttcggggaccgtaacgggtactaccggttaggtccgtaccgttccgtaccgttaccgcccgtaacccgg

SEQ ID NO: 141053 - DNA, 596 bp, Homo sapiens
  misc_feature: GYAE6OF02GOE9Q.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaatggtatcaacatagaccagggacggcccctaagctcctaatctatgctgcatccagtttgcaagtgggtccatcgagttcagtggcagtgatctggacagattcactctcacctatcagtaatctgacaacgtgaagtatttgctaattattactagtaccaaacgagtaaactttactaaattcggttttacggaccgtaaaggggtaacaaacggtaacttaaacaaaagtttaaaaccgaaacgttagttacgggaccttaggaccctaaccgtaactttccgttacgttaccttttcgtaacctttcccgttttaccccggaccctaacgtttcccgttagttaaaccg

SEQ ID NO: 141054 - DNA, 616 bp, Homo sapiens
  misc_feature: GYAE6OF02HPV5B.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgactactatttaaatgtatacaacatagacaggacgccctaagctacctaatctatgctgcatcctagtttcgactaaaggtcgggtcccagtcgaggttcagtggcagtgatcgtggacagtatttcatctacactatcaagtaatctgactaacgtagtaagtattttagacttaaactttacttaactacgtacaaacgtagttaattacgtacttaagtttcggttttaccgggaccgtaaagggtaactaaccggtaacttaaaccgtaaaacgttaaaaccgtaacgttaggtacggtacctaggccctaaccgtaagttaccgtttacgttacctttacgtacctttacccgttaccccggtacctagttccgttaacg

SEQ ID NO: 141055 - DNA, 550 bp, Homo sapiens
  misc_feature: GYAE6OF02F5TXX.46.67.G01.1.454.CMB.1.raw
  modified_base (347)..(347): a, c, t, g, unknown or other
  misc_feature (347)..(347): n is a, c, g, or t
  modified_base (387)..(387): a, c, t, g, unknown or other
  misc_feature (387)..(387): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccaggacggcccctaagctcctaatctatgctgcatccagtttgcaaagtgggtcccatcgaggttcagtgcagtgatcgtggacagntttcactctacaccatacagtaatctgcaacgtagaagtntttagactaacttattactatacaactagtaattacaattgtttacgacgtaagggacacgtaactaactaaacttaaacgaacttaggtacggactcgacgtacctaattccgtacgttaccgtttacacttccttacccgtacctaacgttcctagtaacc

SEQ ID NO: 141056 - DNA, 580 bp, Homo sapiens
  misc_feature: GYAE6OF02G7W1J.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctggggtccggcagcctcccgaggggaaggggctgggaatacagttggaagtgtctctcatagtggaggttcctattacagtccgtctctcaagagtcgagtcaccatatctctggacacgtccagcaatctagttttccctagaagatgtagttctgtcgaccgccgctgacgacgggtcgttttatacgtgtgcgagagacggctattagtgttattttggagttggttatttcgactacccgtagagtcggacgggctcgacccgtgggccgtagggactacgtgtccgtaccgtctccgttacgcctaccgaccgacgggccctagtcccgttcccttccccgtcgccctacccctcccgtaccgacgcgtacccg

SEQ ID NO: 141057 - DNA, 573 bp, Homo sapiens
  misc_feature: GYAE6OF02HWYD3.46.67.G01.1.454.CMB.1.raw
  modified_base (211)..(211): a, c, t, g, unknown or other
  misc_feature (211)..(211): n is a, c, g, or t
  modified_base (232)..(232): a, c, t, g, unknown or other
  misc_feature (232)..(232): n is a, c, g, or t
  modified_base (247)..(247): a, c, t, g, unknown or other
  misc_feature (247)..(247): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctccatcagtagtgtttctntggggctgggtccgnagctccgagggaagggctggaatacattggaagtgtctctcatagtggaggttcctattacagtccgtctctcaagagtcgagtcaccatatctctgacacgtccagcaatctacgttttcccagaagatgagttctgtcgaccgcgctgacgacgggtcgtttatactgtgcgagagcgctattagtgtagttttggagttggttatttcgactaccgtagtacgtcgggacggggtctaccggaccccggttggggacccgtaaggggtaacttaccgtcgggtacctacccggttaccttacccgtttacgcccttaaccccg

SEQ ID NO: 141058 - DNA, 598 bp, Homo sapiens
  misc_feature: GYAE6OF02IW0SA.46.67.G01.1.454.CMB.1.raw
  modified_base (209)..(209): a, c, t, g, unknown or other
  misc_feature (209)..(209): n is a, c, g, or t
  modified_base (245)..(245): a, c, t, g, unknown or other
  misc_feature (245)..(245): n is a, c, g, or t
  modified_base (316)..(316): a, c, t, g, unknown or other
  misc_feature (316)..(316): n is a, c, g, or t
  modified_base (365)..(365): a, c, t, g, unknown or other
  misc_feature (365)..(365): n is a, c, g, or t
  modified_base (373)..(373): a, c, t, g, unknown or other
  misc_feature (373)..(373): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcggcccagactggtgaggccttcggagaccctgtccctcacctgcgctgtctctggtncctcatcagtgtgtttctcgtggggctgggtcccgnagctccgagggaagggctggaatacagttggaagtgtctctctatagtggaggttcctattacagtccgtntctcaagagtcgagtcacatatctctgacacgtcagcaatcatttcccngaaacgtntgtagttctgtcgaccgccgtctcgaacgtacgggtcgttttattaccgtgtacgcgagacggacgattacgtttaatggttattttgggtagtttcgggtttaatttccgaacgtaacccttgtaacgttccgggacggggtcttacccggccccggttaggggacccgtaagggtaacgttacgtcggtacctaccgttccgttaccgttccgtccctacccg

SEQ ID NO: 141059 - DNA, 588 bp, Homo sapiens
  misc_feature: GYAE6OF02HTSFD.46.67.G01.1.454.CMB.1.raw
  modified_base (332)..(332): a, c, t, g, unknown or other
  misc_feature (332)..(332): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtccctcacctgcgctgtctctggtgcctccatcagtagtggtttcttctggggctgggtccgcagctccagggaagggctggaatacattggaagtgtctctcatagtggaggttcctattacagtccgtctctcaagagtcgagtcaccatatctctggacacgtccagcaatcagttttcccngaagatgagttctgtgaccgccgctgacacgggtcgtttattactgtgcgagagacgctatatgtattttggagttggttattcgactacctagtactcggacggggtctacgaccccgtggggccgagggaattacgtggtaccgtaccgtccttccgttacgtccctaccacccgaacgggcccctaagttcccggttacccgtttcccccgtacggtccctaccccgttccctacccgaacgtacgtaccccg

SEQ ID NO: 141060 - DNA, 668 bp, Homo sapiens
  misc_feature: GYAE6OF02IVQ4T.46.67.G01.1.454.CMB.1.raw
  modified_base (191)..(191): a, c, t, g, unknown or other
  misc_feature (191)..(191): n is a, c, g, or t
  modified_base (218)..(218): a, c, t, g, unknown or other
  misc_feature (218)..(218): n is a, c, g, or t
tcagactagcagtacacgaccggtgctcgatttagagtatacatattggggtttggggagtctcggtcaggacacagcatggacatgagggtccccgctcagctcctggggctcctgctactctggctcgaggtgccagatgtgacatcgagctgaccagtctccatcctccctgtctgcaaccgtggganacagtgtcaccatcacttggccggganaagtcggaacatgacactatttaatggtatcaacatagaccaggacggccctaagctactatctatgctgcatccgtagtttcgacgtaaagtcggggtaccctagtccggtaggttacgaggtggtacaggtacggagtcgtacgggactagtatttccgacttctcaaccctatacgaagtaacttctaggactaaacggtgtaaacgttattttcgactaacttaattacctaggttaaccaaactagtaaacttacgaaatttcggtttaccggaccgtaaagggacctaaccggtaaccttaaactaaacggtttaaaaccgagtttacgggtacggtaccgtacggtacccgtaacccgtaattaccgttacggtttaccgtttaaccttaacgtttaccccggttaccccccttacggtacttttacccgtacgtttaaaccg

SEQ ID NO: 141061 - DNA, 562 bp, Homo sapiens
  misc_feature: GYAE6OF02IRHDJ.46.67.G01.1.454.CMB.1.raw
  modified_base (191)..(191): a, c, t, g, unknown or other
  misc_feature (191)..(191): n is a, c, g, or t
  modified_base (254)..(254): a, c, t, g, unknown or other
  misc_feature (254)..(254): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgganacagtgtcaccatcgacttgccggcaagtcggaacattgactacctatttaaatggtatcaanatagaccaggacggcccctaagctctaatctatgctgcatccgagtttgacgaaagtcgggtaccctagtcgaggttcagtgacagtgatcgtgggactagtatttcactcctcaccctataccagtaatctagaccaacgtgaatatttcgactaacgttattacgtcgtacaacagtaattacaattgtttacgacgtaacgggactaacggtaactaactaaacttaaacgaactgtacgactgactaccgtacttcgttcgttaccttcgtacttaccttacccggcctaacgttcctagtaac

SEQ ID NO: 141062 - DNA, 797 bp, Homo sapiens
  misc_feature: GYAE6OF02JXM2D.46.67.G01.1.454.CMB.1.raw
tcagactagcagtacacgaccggtgctcgatttagagtatacatattgggtttggggtaggtctcggtcaggacacagcatggacatgagggtcccgctcagctcctggggctcctgctactctggctccgaggtgccagatgtgacatcgagctgacccagtctccatcctcctgtctgacaaccggtggagacagtgtcaccatcacttggcccgggtcaaaggtccgggaaactagttcgaaccgtaccttaattttaaaagttcggttaacttcaaactaagttaacggtaccaacgggggaaccggtaccccctaaaggaccttacccgttaaatcctaagttcgacctcggtacacttaccctaggtttcgacgtaaaaggtcgggggttccccaagttccgtaaggttcaacggttggacagggttacgggattaccggtgggggaacctaagggtactttttaccaaccgtttaccgttacccaaacccgtaagtttaccgtaaacggttaaattcccgtttaggtaacccgtaaacgggttacgttaaaacgggtttactttttacggtaacccttaaaaggttttacccttttaacggttacctttaagaaaccgttaagtaactttaaactaggtttacgttttacgggactaaacgggtacctaacggtacttaaacgtaaaagttaaaccgaacgttaggtaccggtatacgtaccgaaccttaagttcctaacgttaccgttctaaccgtttcccgtacctaccgttacttaccgttataacg

SEQ ID NO: 141063 - DNA, 561 bp, Homo sapiens
  misc_feature: GYAE6OF02GVV5E.46.67.G01.1.454.CMB.1.raw
  modified_base (211)..(211): a, c, t, g, unknown or other
  misc_feature (211)..(211): n is a, c, g, or t
  modified_base (326)..(326): a, c, t, g, unknown or other
  misc_feature (326)..(326): n is a, c, g, or t
  modified_base (373)..(373): a, c, t, g, unknown or other
  misc_feature (373)..(373): n is a, c, g, or t
  modified_base (378)..(378): a, c, t, g, unknown or other
  misc_feature (378)..(378): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctccatcagtagtgtttctcgtggggctgggtccgcagctcccgagggaggggctggaatacattggaagtgtctctcatagtggaggttcctattacagtccgtctctcaagngtcgagtcaccatatctctggacacgtccagcaatctagttttcccngaagntgagttctgtcgaccgccgctgacacgggtctttattactggttgcgagagacggtctattatgttattttgggagttggtttatttcgacctacctagactcggacggggtctccgggaccccgtggggacccaagggtaacttacgtcggtcgtacccgttctccgttacgcctaccccgg

SEQ ID NO: 141064 - DNA, 520 bp, Homo sapiens
  misc_feature: GYAE6OF02GMU7L.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgcccctaagctcctaatctatgctgcatccagtttgcaaagtgggtcccatcgaggttcagtggcagtggatctgggacagatttcactctcaccatcagtaatctgcaacgtgaagtattttagctaacttattacttgtacaactagtaattactaattcgttttacggacctaagggacacgactaactaaattaaacgaactgtagctagcactatctgttacttcacttcctcccgctactctgtac

SEQ ID NO: 141065 - DNA, 612 bp, Homo sapiens
  misc_feature: GYAE6OF02IA9Q9.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatgtatcaacatagaccagggacgcccctaagctctaatctatgctgctatccagtttgacgtaaaggtgggtcccagtcgaggttcagtcggacaggtgatcgtagggacagatttcacttctcaaccattcaagttaatctacgacctaaacggtagtaaagttattttacgaccttaaactttattacttagtacaaactaagttaaacttaactaatttgttttaccaacggtaccgtaaaggggaacctaacgaaaccttaaactaaaacgttaaaaacgtaacgttagtacggtacttacggcctaaccgtaattccgttaacgttcctttacacgtttcccttacccacctacttccttacg

SEQ ID NO: 141066 - DNA, 528 bp, Homo sapiens
  misc_feature: GYAE6OF02IW71I.46.67.G01.1.454.CMB.1.raw
  modified_base (410)..(410): a, c, t, g, unknown or other
  misc_feature (410)..(410): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttgccgggcaagtcggaacatgacacctatttaaatggtatcaacatagaccagggacggcccctaagctcctaatctatgctgcatccagtttgcaaagtgggtcccatcgaggttcagtggcagtggatcgtgggacagtatttacactctcactatcagtaatctgacaacgtgaagtatttgactaacttattactntacaactagtaattacaattgtttacgactaaagggacacgtaactaactaaaattaaacgaaactgtacgactgacactatctagtcttacgacttccttcccgcctattctgtaac

SEQ ID NO: 141067 - DNA, 567 bp, Homo sapiens
  misc_feature: GYAE6OF02JNLU9.46.67.G01.1.454.CMB.1.raw
  modified_base (195)..(195): a, c, t, g, unknown or other
  misc_feature (195)..(195): n is a, c, g, or t
  modified_base (198)..(198): a, c, t, g, unknown or other
  misc_feature (198)..(198): n is a, c, g, or t
  modified_base (205)..(205): a, c, t, g, unknown or other
  misc_feature (205)..(205): n is a, c, g, or t
  modified_base (218)..(218): a, c, t, g, unknown or other
  misc_feature (218)..(218): n is a, c, g, or t
  modified_base (311)..(311): a, c, t, g, unknown or other
  misc_feature (311)..(311): n is a, c, g, or t
  modified_base (335)..(335): a, c, t, g, unknown or other
  misc_feature (335)..(335): n is a, c, g, or t
  modified_base (442)..(442): a, c, t, g, unknown or other
  misc_feature (442)..(442): n is a, c, g, or t
  modified_base (482)..(482): a, c, t, g, unknown or other
  misc_feature (482)..(482): n is a, c, g, or t
  modified_base (527)..(527): a, c, t, g, unknown or other
  misc_feature (527)..(527): n is a, c, g, or t
tcagactagcagtacacgaccggtgctcgatttagagtatacatattgggtttggggtagtcgtcggtcgtaggacgacagcatggacatgaggtcccgctcagctcctggggctcctgctctctggctccgaggtgccagatgtgacatcgagctgacccagtctccatcctccctagtctgcaaccgtggganacntgtcacntcacttgccgggnaagtcggacattgactacctatttaaatcggtatcaactatagaccgaggaccgcccctaagctaccgtaatctattgctgctactctagttncgaagtcgggtccagtcgaggttnacggtggccagtgggtatcgtaggggactacgtatttccgacttcttaccaccattcaagtttaaccttagacccgtaagtgtaagttctttgactaaccttagttntcgtaacaatactaattacagtttagttccgtagaacgtnaaccgtactaataaattaaacgacttgtaagctacgtacacgttntactagtctacctagtttccgtaccctctattcattaacg

SEQ ID NO: 141068 - DNA, 754 bp, Homo sapiens
  misc_feature: GYAE6OF02HKE8Q.46.67.G01.1.454.CMB.1.raw
  modified_base (177)..(177): a, c, t, g, unknown or other
  misc_feature (177)..(177): n is a, c, g, or t
  modified_base (393)..(393): a, c, t, g, unknown or other
  misc_feature (393)..(393): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgagggccttcggaacgaccctcgtccctcacctgcgctgtctcgtggtcncctccatctagtaggttcgtttcttcggtgggtcgtcgggtcccggcacgccgtaccggaggggaacgggtctaggaatacgtagttagggaagtcgttctctctaagtaggtgggtacggttcctaattacgacgttccgtctctacaaggtagtcgagtccacctatactctcgtcggaccacgtccagacaatcgtacgttttcccagaacgngtgtacgttctggtcgacccggccgtcgtgtaaccggaccgggtttacgttttaacttacggtgtacggacggaaggtacggaccgggttacttaagtttagttacggttaagtttttcgggaggtttaggtttacgtttcggaacctaacccgtagtacgtccggggacggggtccgttacccgtacccgggtcggggacccgtaagggtaacttacggtccggttaccgtacccgttaccgttacccgttccgtaccctacccgaacccgggtaacccggtccctacggttaccccgggttccccttccccccggtcggtacccctaccccctccccgtaccgacgtaccggtaccccg

SEQ ID NO: 141069 - DNA, 556 bp, Homo sapiens
  misc_feature: GYAE6OF02HMIK8.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtccctcacctgcgctgtctctggtgcctccatcagtagtggtttcttctggggctgggtccggcagctcccagggaaggggctgggaatacattggaagtgtctctcatagtggaggttcctattacagtccgtctctcaagagtcgagtcaccatatctctggacacgtccagcaatctagttttcccagaagatgtagttctagtcgaccgcgctgacacgggtcgtttatactgtgcgagagacgctatatgtagttttggagttgttattcgactaccctagctcggacggggtcctacgaccccgtggggaccgagggaactacgtcggtaccaccgtctccgttacgccctccaccgacggcccagtccgtcccttcccgcggccaccctcctaccagcgtcc

SEQ ID NO: 141070 - DNA, 574 bp, Homo sapiens
  misc_feature: GYAE6OF02FZ8F5.46.67.G01.1.454.CMB.1.raw
  modified_base (390)..(390): a, c, t, g, unknown or other
  misc_feature (390)..(390): n is a, c, g, or t
  modified_base (405)..(405): a, c, t, g, unknown or other
  misc_feature (405)..(405): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaagggctggaatacattggaagtgtctctcatagtggaggttcctattacagtccgtctctcaagagtcgagtcaccatatctctggacacgtccagcaatctacgttttccctgaagatgagttctgtcgaccgccgctgacgacgggtcgttttattactgtgcganagggggggggggacncgtattatgtagttttggtagttggttatttcgactaccctagactcggacggggtctcggacccgtcggggccgagggaacgtacgtcggtcaccgtctccgttacgcctccaccgaacggccctacgtccgtccttccccgtcggcctaccctccctaccacgagcc

SEQ ID NO: 141071 - DNA, 522 bp, Homo sapiens
  misc_feature: GYAE6OF02IKKW2.46.67.G01.1.454.CMB.1.raw
  modified_base (495)..(495): a, c, t, g, unknown or other
  misc_feature (495)..(495): n is a, c, g, or t
  modified_base (519)..(519): a, c, t, g, unknown or other
  misc_feature (519)..(519): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaatggtatcaacatagaccagggacgcccctaagctcctaatctatgctgcatccagtttgcaaagtcgggtcccatcgaggttcagtggcagtggatcgtgggacagatttcactctcacatcagtaatctagcaacgtgaaagtattttagactaactttattacttcgtacaacaagtaattacaattgtttcggaccgtaagggacaacgactaactaaaataaacgaaactgtagctagacaccatctntcttacattcctcccgactatctntac

SEQ ID NO: 141072 - DNA, 556 bp, Homo sapiens
  misc_feature: GYAE6OF02FVS7F.46.67.G01.1.454.CMB.1.raw
  modified_base (334)..(334): a, c, t, g, unknown or other
  misc_feature (334)..(334): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttcccngaagatgagttctgtgaccgcgctgacacgggcttttatactgtgcgagagacggctattatgtatttttggagttggttatttcgacaccctagatcggacggggtctccgaccccgtggggccagggaactacgtggtcaccgtctccttagcctccaccgaacgggcccagtcccggttccttcccccgtggcccacccctccctcccaacgcgtaccc

SEQ ID NO: 141073 - DNA, 587 bp, Homo sapiens
  misc_feature: GYAE6OF02GNV4J.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaattggtatcaacatagaccagggacggcccctaagctcctaatctatgctgcatccagtttgcaaagtggggtcccatcggaggttcagtggcagtggatcgtgggacaggtattcactctcaccatcagtaatctgcaagtgaagtatttcgactaacttattacttagtacaactaagtaattactaatttgttttaccggaaccgtaacgggtaactaaccgtaacttaaactaaaacgtttaaaacgaacgttagtacggtacgttacgactaaccctattccgtacgttactttaccgtaactttcccgttaccccgccttaacgttcctacgttaaccg

SEQ ID NO: 141074 - DNA, 532 bp, Homo sapiens
  misc_feature: GYAE6OF02H6ESP.46.67.G01.1.454.CMB.1.raw
  modified_base (217)..(217): a, c, t, g, unknown or other
  misc_feature (217)..(217): n is a, c, g, or t
  modified_base (420)..(420): a, c, t, g, unknown or other
  misc_feature (420)..(420): n is a, c, g, or t
  modified_base (429)..(429): a, c, t, g, unknown or other
  misc_feature (429)..(429): n is a, c, g, or t
  modified_base (498)..(498): a, c, t, g, unknown or other
  misc_feature (498)..(498): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacactatttaaattggtatcaacatagaccagggacggcccctaagctcctaatctatgctgcatcctagttttgctaaaaggtcggggtacccagtcgtaggttcagtggcagtgatcgtgggactagatttcatctcacatcagtaatctgtacaacgtagaagtattttgactaacttattacttntacaactanaattacaattgtttcggactaaggacaacgtactaactaaattaaacgaactgagctagacacactctnttacctctactcctacccgtccattcctgtaacc

SEQ ID NO: 141075 - DNA, 551 bp, Homo sapiens
  misc_feature: GYAE6OF02G5CTQ.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgcccctaagctcctaatctatgctgcatccagtttgcaaagtgggtcccatcgaggttcagtggcagtggatcgtgggacagatttcactctcaccatcagtaatctgacaacgtgaagtattttgactaacttattactagtacaacaagtaaattactaattgttttaccggaccgtaaagggtaccaacgtaacctaactaaaacttaaacgaaacttgtagactagacctaacctatctcgttcttactacttccttcccgtacctacttcgtagtaac

SEQ ID NO: 141076 - DNA, 554 bp, Homo sapiens
  misc_feature: GYAE6OF02GEDU8.46.67.G01.1.454.CMB.1.raw
  modified_base (211)..(211): a, c, t, g, unknown or other
  misc_feature (211)..(211): n is a, c, g, or t
  modified_base (319)..(319): a, c, t, g, unknown or other
  misc_feature (319)..(319): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttctcgtggggctgggtccgcagcctcccgagggagggctggaatacattggaagtgtctctcatagtggaggttcctattacagtccgtntctcaagagtcgagtcaccatatctctgacacgtccagcaatctagttttcccagaagtatgtagtttctgtcgaccgccgctgacacgggtctttaatacgtgtgcgagagacgtctagttatgtattttggagttgttactttcgactacctagagtcggcgggctccggtcccgtgggccgaagggtacttacgtcggtccgaccgttcgtaccgttacgtccctaacccgg

SEQ ID NO: 141077 - DNA, 564 bp, Homo sapiens
  misc_feature: GYAE6OF02FSKQ0.46.67.G01.1.454.CMB.1.raw
  modified_base (558)..(558): a, c, t, g, unknown or other
  misc_feature (558)..(558): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgagggaaggggctggaatacattggaagtgtctctcatagtggaggttcctattacagtccgtctctcaagagtcgagtcaccatatctctggacacgtccagcaatcagttttccctgaagatgagttctgtcgaccgccgctgacacgggtcttttattactgtgcgagagacggctattatgtattttggagttggttatttcgactaccctagagtcgacggggtcctccggacccgtggggaccgagggtaatacgtcgtcaccgtctccttacgcctccaccgaacgggcccagtccggttccttccccgtggccctaccccttccctaccacgngtaccc

SEQ ID NO: 141078 - DNA, 831 bp, Homo sapiens
  misc_feature: GYAE6OF02IB9CG.46.67.G01.1.454.CMB.1.raw
  modified_base (98)..(98): a, c, t, g, unknown or other
  misc_feature (98)..(98): n is a, c, g, or t
tcagactagcagtacacgaccggtgctcgatttagagtatacatattgggggtttggggagtctcggtcaggacacagcatggacatgagggtcccgntcagctcctggggctcctgctactctggctccgaggtcgccagatgtgacatcgagctgacccagtctccatcctccctgtctgcaaccgtggagcagtggtccaccatcgacttgccgggcaagttcggaacattgacacctattaaatggtatacaacatagaccagggaccggcccctaagctacctaactctagtgcctacgtaccacttccaggttttacgaccggtaaaacggttacgggggttccccaagtttccgggaacgggttttaccgaagggttcgggtacgtacgggttacgggtaaacgttccgttaggggggtaaccttaacggtaagttttttacccaacggttcccgttaaccctaaacccctaacgtttaaccgtaaacccggtttaaacgttacccgttaacgggtaccgtaaaaccgggtttgggtaaacgttacgttttttaccggaccgttaaactttttacgtttaacttcggttaaccgtaaacttaagtaaacttttaaccgttaagttacggtttttaccggaaccgtaaacggggaacccgtaacgtaaccgtttaaactaaaacgtttaaaacggtaaaccgttacggttaaggtaccgtacggtaaccgtaaccggttaacgttaccggttacgttaccgttttaaccgtaaccggtttacccttaccccggtaccctaaccgtttaccggttaagttaaccgg

SEQ ID NO: 141079 - DNA, 500 bp, Homo sapiens
  misc_feature: GYAE6OF02GB9CX.46.67.G01.1.454.CMB.1.raw
  modified_base (447)..(447): a, c, t, g, unknown or other
  misc_feature (447)..(447): n is a, c, g, or t
  modified_base (477)..(477): a, c, t, g, unknown or other
  misc_feature (477)..(477): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatctgggacagattcactctcaccatcagtaatctgcaacgtgaagtattttgactaacttattactgtacaacagtaattacattgtttcgacaaggacagactaanaaattaaacgaactgtagctagcacatctntcttcactctccgctatctgtac

SEQ ID NO: 141080 - DNA, 583 bp, Homo sapiens
  misc_feature: GYAE6OF02GFXER.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaaggtcggaacattgacacctatttaaatggtatcaacatagaccagggacgcccctaagctcctaatctatgctgcatccagtttgcaaagtgggtcccagtcgaggttcagtggcagtggatcgtgggacagatttcactctcacatcagtaatctgcaacgtgaagtattttagactaacttattactgtactaaacagtaaattacaattcggttttacggacgtaacgggtacctaacgggtaaccttaaactaaaactttaaaaccggaacttacgttacgggaccttaggacctaacctattccgttaggttacctttacgactttccgtttaccccgacctactttacctggttaacc

SEQ ID NO: 141081 - DNA, 598 bp, Homo sapiens
  misc_feature: GYAE6OF02HOLLT.46.67.G01.1.454.CMB.1.raw
  modified_base (285)..(285): a, c, t, g, unknown or other
  misc_feature (285)..(285): n is a, c, g, or t
  modified_base (332)..(332): a, c, t, g, unknown or other
  misc_feature (332)..(332): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccggcagctccgagggagggctggaatacattggaagtgtctctcatagtggaggttcctattacagtccgtctctcaagngtcgagtcaccatatctctggacacgtccagcaatctagttttcccngaacgatgtagttctgtcgaccgccgctcgacgacgggtcgtttattactgtcgcgagacgacggctattatgttatttggagttggtttattcgactaccctagtacgtcgggacgggtcgtaccgacccggtaggggcccgaagggtaactacgttcggtccgtaccgttctccgttagcccgtaccgaacccgaacggccctacgtccggttacccgttccccgtcggtaccctaccccttccctaccgtacgaccgtacccg

SEQ ID NO: 141082 - DNA, 555 bp, Homo sapiens
  misc_feature: GYAE6OF02GSKZ4.46.67.G01.1.454.CMB.1.raw
  modified_base (334)..(334): a, c, t, g, unknown or other
  misc_feature (334)..(334): n is a, c, g, or t
  modified_base (523)..(523): a, c, t, g, unknown or other
  misc_feature (523)..(523): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactgggtgaggccttcggagaccctgtccctcacctgcgctgtctctggtgcctccatcagtagtggtttcttctggggctgggtccggcagctcccagggaagggctggaatacattggaagtgtctctcatagtggaggttcctattacagtccgtctctcaagagtcgagtcaccatatctctggacacgtccagcaatcagttttcccngaacgatgagttctgtgaccgccgctgacacgggctttatactgtgcgagagacggctattatgtattttggagttggttattcgactaccctagatcgacggggctcgacccgtggggccagggaatacgtcggtcaccgtctccttagccttccaccgaacgggccctagtccggtccttcccccgnggtcccaccccgttccctacccacgcgacccg

SEQ ID NO: 141083 - DNA, 547 bp, Homo sapiens
  misc_feature: GYAE6OF02FIXJS.46.67.G01.1.454.CMB.1.raw
  modified_base (204)..(204): a, c, t, g, unknown or other
  misc_feature (204)..(204): n is a, c, g, or t
  modified_base (361)..(361): a, c, t, g, unknown or other
  misc_feature (361)..(361): n is a, c, g, or t
tcagactagcagtacacgaccggtgctcgatttagagtatacatattgggtttggggagtctcggtcaggacacagcatggacatgagggtccccgctcagctcctgggggctcctgctactctggctccgaggtgccagatgtgacatcgagctgacccagtctccatccctccctgtctgcaaccggtgggagacttttagngtcaccatcacttggccgggcaagtcggaacattgacaccttatttaaattggtatcaacatagaccagggtaccggccccctaagcctcctaatctatgctgcatccagtttgcaaagtgggtcccatcgaggttcagtgcagtggatctgggacngatttcactctcaccatccagtaactctgcaacgtgaagtattttgactaacttattactgtacaacagtaattacaattgttttacggacctaagggacaacgaactaacaaattaaacggactgtacgctgactaacctatcgtacgttaccttactacttccttaccccgcctactctgtaac

SEQ ID NO: 141084 - DNA, 543 bp, Homo sapiens
  misc_feature: GYAE6OF02F3DCT.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgccctaagctcctaatctatgctgcatccagtttgcaaagtgggtccatcgagttcagtgcagtgatctgggacagtattacactctcacatcagtaatctgacaacgtgaagtatttagacgtaacttattactagtacaacaagtaattacaattacgttttacggaccgtaaggacacgtaactaactaaacttaaacgaactagtaggtactacgcctaaccattacgttacgttccgttacacttccttacccgacctacttactgtaac

SEQ ID NO: 141085 - DNA, 525 bp, Homo sapiens
  misc_feature: GYAE6OF02I0WVU.46.67.G01.1.454.CMB.1.raw
  modified_base (386)..(386): a, c, t, g, unknown or other
  misc_feature (386)..(386): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaatgtatcaacatagaccagggacgcccctaagctcctaatctatgctgcatccagtttgacaaagtgggtcccatcgaggttcagtggcagtggatcgtgggacagtatttcactctcacatcataatctgacaacgtgaagtntttgactaacttattactgtacaactagtaacttacaattcgtttacgaccgtaagggacacgtactaactaaaattaaacgaagtgtagtctagactactatctgtacttcgtacttccttcccgacctatctagtac

SEQ ID NO: 141086 - DNA, 551 bp, Homo sapiens
  misc_feature: GYAE6OF02H8D47.46.67.G01.1.454.CMB.1.raw
  modified_base (288)..(288): a, c, t, g, unknown or other
  misc_feature (288)..(288): n is a, c, g, or t
  modified_base (335)..(335): a, c, t, g, unknown or other
  misc_feature (335)..(335): n is a, c, g, or t
  modified_base (340)..(340): a, c, t, g, unknown or other
  misc_feature (340)..(340): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccagggaagggctggaatacattggaagtgtctctcatagtggaggttcctattacagtccgtctctcaagngtcgagtcaccatatctctggacacgtccagcaatctagttttcccngaagntgagttctgtcgaccgcgctgacacgggtcgtttaatactgtgcgagacgacggctattatgtagttttggagttggttactttcgactacctagatcggacggggctcgacccgtgggaccagggaatacgtcgtcaccgtctccgttagcctccaccgaacggcccagtccggtccttaccccgcggcctccctcccaccacgacgccg

SEQ ID NO: 141087 - DNA, 738 bp, Homo sapiens
  misc_feature: GYAE6OF02G3R0P.46.67.G01.1.454.CMB.1.raw
  modified_base (219)..(219): a, c, t, g, unknown or other
  misc_feature (219)..(219): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggacacagtgtcaccatcacgttgcccgggnaagtcggaacagttgactacctatttaaatggtatcaacatagaccagggacgccctaagctacctaatctatgctgcatcctagtttcgactaaaggtcggggtacccagtccggaggttccagtggcagtggatcgtagggactagtactttacgactcttacgaacctataccgtaagttaactcgttacgaaccgttaaacggtgtaaacgttagtttttacggaaccttaaacgtttttaacgtttaaccgttagtttaaaccgtaaaacgtaacggtttaaaaactttaacgttaaacgttttacgggtttttaccgggaaacccgttaaacgggggtaacctaaaccggttaaactaaaccgtttaaaaaagtttaaaacccgtaaacggttacggttaacggtaccgttaacggtaccccgtaaactaacgtttaccgtttacgtttacccgtttacgtaaccgtttcccgtttacccccggtaccttaacgttccgttaaggttaacccg

SEQ ID NO: 141088 - DNA, 640 bp, Homo sapiens
  misc_feature: GYAE6OF02G7G4I.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggagacagtgtcaccatcacttgccgggcaagtcggaacattgacacctatttaaatggtatcaacatagaccagggacgccctaagctcctaatctatgctgcatccagtttgacgaaagtcggggtcccatcgaggttcaggtggctaggtgatcgtagggacaggtatttcactctacactatcaagtaactcgtgactaacgtgtaagtattttcgacttaacttattacgtacgttactaacgtaagtaacttacgtaattcggtttaccggaccgtaaagggtacctaaccggtaacttaaacgttaaaaacgttaaaccggtaaacgttacggtacggtacgttacggtaccgtaacccgtaagttaccgttacggttaacccgtttacgtaacccgtttcccgtttacccccggtaaccgtacgtttacccgttacggttaaccg

SEQ ID NO: 141089 - DNA, 513 bp, Homo sapiens
  misc_feature: GYAE6OF02I0ZB5.46.67.G01.1.454.CMB.1.raw
  modified_base (255)..(255): a, c, t, g, unknown or other
  misc_feature (255)..(255): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaanatagaccagggacgcccctaagctcctaatctatgctgcatccagtttgacaagtgggtcccatcgagttcagtggcagtggatcgtgggacagattcactctcaccatcagtaactctgcaacgtgaagtatttgactaacttattactgtacaatagtaattacaattgtttacgactaaggacacgactaactaaattaaacgaatgtgactgaccacatctgttcttactactccttcccgactattctagtac

SEQ ID NO: 141090 - DNA, 532 bp, Homo sapiens
  misc_feature: GYAE6OF02GO046.46.67.G01.1.454.CMB.1.raw
  modified_base (477)..(477): a, c, t, g, unknown or other
  misc_feature (477)..(477): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatgtatcaacatagaccagggacgcccctaagctcctaatctatgctgcatccagtttgacaaaggtggggtcccagtcgagttcagtggcagtgatcgtgggacagtatttcactctcacatcagtatctgacgtaacgtgaagtatttagactaacttattacttgtacaacagtaattactaattgtttcgacgtaaggacacgtaactaactaaactaaacgtaactagngtactgactactatctagtcctttacgacttccgttcccgtacctactctagtac

SEQ ID NO: 141091 - DNA, 705 bp, Homo sapiens
  misc_feature: GYAE6OF02H0RFL.46.67.G01.1.454.CMB.1.raw
  modified_base (246)..(246): a, c, t, g, unknown or other
  misc_feature (246)..(246): n is a, c, g, or t
  modified_base (303)..(303): a, c, t, g, unknown or other
  misc_feature (303)..(303): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtgtggtttctctggggctgggtccggcagctcccagggagggctggaatcagttggaagtgtctntcatagtggaggttcctattacagttccgctctcaagtagtcggatcaccatatctntggacacgccgagactaaatctaacgtttttccccgagaaaacggtattaggaatttacctgggttgtaacccggtccggctttacggaaaccgcggggtacggtttttaacttaaccgtaggtcggtccgaaggtacggacggtacgttataagttgtaatttttcgggaggtttcggtttacgtttagtaaccgttaacccctagtaaactcggggtaaccggggtctacccgggtaaccccgttccgggggacccgtaagggggtaaccgttaacggttcgggtacccggttaacgtaacccgttccgtttaccgcccgttacccaaccggaaacgggtcccctacgtaccgttcccgtacccgtcggaccctacccgtaccctacgacgacgtacccg

SEQ ID NO: 141092 - DNA, 544 bp, Homo sapiens
  misc_feature: GYAE6OF02F567Q.46.67.G01.1.454.CMB.1.raw
  modified_base (523)..(523): a, c, t, g, unknown or other
  misc_feature (523)..(523): n is a, c, g, or t
  modified_base (537)..(537): a, c, t, g, unknown or other
  misc_feature (537)..(537): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtacctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttccctgaagatgagttctgtgaccgccgctgacacgggtctttattactgtgcgagagacggctattagtgtattttggagttggttagtttcgtacacccttagacgtcggaccggggctccggacccgtggggccgagggatacgtgtccaccgtctcctgcctcacacggcccatcggtcctcccgtgccnccctcctccacgancctaccg

SEQ ID NO: 141093 - DNA, 503 bp, Homo sapiens
  misc_feature: GYAE6OF02HNF6R.46.67.G01.1.454.CMB.1.raw
  modified_base (485)..(485): a, c, t, g, unknown or other
  misc_feature (485)..(485): n is a, c, g, or t
  modified_base (500)..(500): a, c, t, g, unknown or other
  misc_feature (500)..(500): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattgtatcaacatagaccaggacggcccctaagctcctaatctatgctgcatccagtttgcaaagtggggtcccatcgaggttcagtggcagtggatctgggacagatttcactctcaccatcagtaatctgcaacgtgaagattttgctaacttattactgtcaactagaaattacaattgttttcggacctaagggacacgactaacaaattaaacgaactgtgctgcacatctgtcttnactctcccgcatctntac

SEQ ID NO: 141094 - DNA, 530 bp, Homo sapiens
  misc_feature: GYAE6OF02IWZXA.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaatgtatcaacatagaccagggacgcccctaagctcctaatctatgctgcatccagtttgactaaagtcgggtcccagtcgaggttcagtggcagtggatcgtgggacagtattcactctcaccatcagtaattgacaacgtgaagtatttgactaacttattacttagtactaatagtaattactaattgtttacgaccgaaggactaacgtactaactaaattaaacgaatagtacgtactcgacactatctagtcttacactccttccgactactctagtactacg

SEQ ID NO: 141095 - DNA, 615 bp, Homo sapiens
  misc_feature: GYAE6OF02HNZIA.46.67.G01.1.454.CMB.1.raw
  modified_base (356)..(356): a, c, t, g, unknown or other
  misc_feature (356)..(356): n is a, c, g, or t
  modified_base (452)..(452): a, c, t, g, unknown or other
  misc_feature (452)..(452): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtcgcctccatcagttagtggtttcttcgtggggctcggggtccggcacgcctccgaggggaacggggctaggaatacagttggaagtgtctctcatagtggagttcctattacagtccgtctctcaagagtcgagtcacatatctcngacacgtcagcaatctacgttttcccagtaagatgtacgttctgtgacccgccgctgacgtacgggtctttagttacgtgttcgcgagaggacgtnttattagtgttagttttggagttggttatttcgactacccgtagtacgtcgggaccggggtctacccggtaccccggttcggggacccgtaaggggtaactttaccggttcgggttacccgaaccccggtttccgtttacccgtttacgccccgttaacccgg

SEQ ID NO: 141096 - DNA, 705 bp, Homo sapiens
  misc_feature: GYAE6OF02HI35W.46.67.G01.1.454.CMB.1.raw
  modified_base (323)..(323): a, c, t, g, unknown or other
  misc_feature (323)..(323): n is a, c, g, or t
  modified_base (347)..(347): a, c, t, g, unknown or other
  misc_feature (347)..(347): n is a, c, g, or t
  modified_base (406)..(406): a, c, t, g, unknown or other
  misc_feature (406)..(406): n is a, c, g, or t
  modified_base (448)..(448): a, c, t, g, unknown or other
  misc_feature (448)..(448): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgccgctgtctctggtgcctccatcagtagtggtttctcgtggggctggggtccgcagcctcccgaggggaggggctgggaatacgagtttgggaagttggtctctacgaagttaggtcgggtagggtttcctaagtttaaccaggttcccgttcctcttacaaaggngtcgtaggtccaaccattatcctntggaaccaccggttccaagcaaatcgtaacgtttttccccagaagactgtaacgtttcnggttacgaccgtccgctagacgacggggtcgttttattacgnggtcgacgagacggacggcttatacgtgttagttttggaaggttggtttactttacggacctaacccgttagagttacgggacggggtctaccggacccccggttgggacccgtagggaaactaccgtcggtaccgaccgttcctaccgttacgtaccctcccggaaaccgtaccgggtacccaggttcccggtaccccgtttcccccgtcgggccctaacccccgttccccgttaccgaaccggtactaaccccgg

SEQ ID NO: 141097 - DNA, 543 bp, Homo sapiens
  misc_feature: GYAE6OF02HPDO0.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccaggacggcccctaagctcctaatctatgctgcatccagtttgcaaagtggggtcccatcgaggttcagtggcagtgatctgggacagatttcactctcacatcagtaatctgcaacgtgaagtattttgactaacttattacttagtcaaactagaattactaattgtttacggacctaaagggacaacgtaactaaactaaaacgttaaaacgaaacttagtggacttagaccaacctattctacgtctttactacttccttacccgcctacttctgtaac

SEQ ID NO: 141098 - DNA, 542 bp, Homo sapiens
  misc_feature: GYAE6OF02F22TB.46.67.G01.1.454.CMB.1.raw
  modified_base (376)..(376): a, c, t, g, unknown or other
  misc_feature (376)..(376): n is a, c, g, or t
  modified_base (406)..(406): a, c, t, g, unknown or other
  misc_feature (406)..(406): n is a, c, g, or t
  modified_base (422)..(422): a, c, t, g, unknown or other
  misc_feature (422)..(422): n is a, c, g, or t
  modified_base (432)..(432): a, c, t, g, unknown or other
  misc_feature (432)..(432): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgagggaaggggctggaatacattggaagtgtctctcatagtggaggttcctattacagtccgtctctcaagtagtcgagtcaccatatctctgacacgtccagcaatctagttttcccngaagatgagtttctgtcgaccgcgctgacncgggtctttatctgtncgagacgcgnttattatgtattttggagttggttattcgacacctagacgtcggacgggctaccggcccggtgggaccgagggtactcgtggtcctccgtcctccgttacgccctacccg

SEQ ID NO: 141099 - DNA, 521 bp, Homo sapiens
  misc_feature: GYAE6OF02HHLTM.46.67.G01.1.454.CMB.1.raw
  modified_base (497)..(497): a, c, t, g, unknown or other
  misc_feature (497)..(497): n is a, c, g, or t
  modified_base (509)..(509): a, c, t, g, unknown or other
  misc_feature (509)..(509): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtgatcgtggacagatttcactctcaccatcagtaatctagcaacgtgaagtattttgactaacttatacttgtacaacagaattacaatttgtttacggaccgaaaggacaacgaacttaacaaattaaacgaactgtaggctagcaaccatctgttcttnacttccttcccnctattctgtaac

SEQ ID NO: 141100 - DNA, 530 bp, Homo sapiens
  misc_feature: GYAE6OF02F0ZOC.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatcgtgggacagatttcactctcaccatcagtatctgacaacgtgaagtattttgactaacttattacttagtactaacagtaattactaattgtttcgacgaggacacgactaactaaataaacgaactagtagtctcgactaactatctcgttcttacgtacttccttacccgtacctactctagtac

SEQ ID NO: 141101 - DNA, 757 bp, Homo sapiens
  misc_feature: GYAE6OF02IQXN1.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggtcttggggtccggtcagtccttccccgaaggggaacggggccttgggaaacttacgagttgggaacgtgtccgtgttcagttagtggaggttcctattacgaggtccgtctctacgaagtacgtcgagtcgacctatacttctctaggacctacgtccagtacaacttaccgtacgtttttcccagaaagtactagtacgttctacggttcgacccgtaccgcgttagaccgtacgggttaccttttaattaccgtagtcgacggtaggacggtacggtacgttagtttacgtgttacgtttttaggtaacgtttagggtttaactttacggaaccgttacccgttaggtaacgttcggggtaacggggtccgttacccgggtaccccggtagggtacccgtaagggtaacgtaccgttacggtccgtaccgttacgtacccgtttaccgcccgttacccgaaccggtacccgggtacccctaggtccccggttcccgttacccccgtcgggtaccccctaaccccgttcccgtacccgtaacggtctaacccccgg

SEQ ID NO: 141102 - DNA, 545 bp, Homo sapiens
  misc_feature: GYAE6OF02IEQY6.46.67.G01.1.454.CMB.1.raw
  modified_base (285)..(285): a, c, t, g, unknown or other
  misc_feature (285)..(285): n is a, c, g, or t
  modified_base (303)..(303): a, c, t, g, unknown or other
  misc_feature (303)..(303): n is a, c, g, or t
  modified_base (383)..(383): a, c, t, g, unknown or other
  misc_feature (383)..(383): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccgcagctcccagggaggggctggaatacattggaagtgtctctcatagtggaggttctattacagtccgtctctcaagngtcgagtcaccatatctntggacacgtccagcaatcagtttttccctgaagatgagttctgtgaccgcgctgacacgggcgtttattactgtgcgagngacggctatatgtattttggagttggttatttcgactaccctagacgtcgacgggggctcgacccgtgggccagggaatacgtgcacgtctctacgcctccaccgaacggcccagtccggtccttccccgtcgcctaccccgtccctaccacgacgtacccg

SEQ ID NO: 141103 - DNA, 618 bp, Homo sapiens
  misc_feature: GYAE6OF02H5ZEM.46.67.G01.1.454.CMB.1.raw
  modified_base (303)..(303): a, c, t, g, unknown or other
  misc_feature (303)..(303): n is a, c, g, or t
  modified_base (342)..(342): a, c, t, g, unknown or other
  misc_feature (342)..(342): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaattggtatcaacatagaccagggacgcccctaagctcctaatctatgctgcatccagtttncaaagtgggtcccatcgagttcagtggcaggtggatcgngggacagtatttcactctcaccatcagttaatctgactaaacgtgtaagttagttttgacctaaacttttatttaacttcgttacaaactaagtaaatttaacgaattttacggttttaccgggaacctaaggggtaaccctaacggtaacctttaaactaaaacgtttaaaacgaaacgttacggttaggaccttcggaacctaaccgtattaccgttagttaccctttaccgtacctttcccgttacccccggtacctacttcctaggttaacc

SEQ ID NO: 141104 - DNA, 910 bp, Homo sapiens
  misc_feature: GYAE6OF02HCJSY.46.67.G01.1.454.CMB.1.raw
  modified_base (178)..(178): a, c, t, g, unknown or other
  misc_feature (178)..(178): n is a, c, g, or t
  modified_base (276)..(276): a, c, t, g, unknown or other
  misc_feature (276)..(276): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggcctttcggagaccctgtccctcacctgcgctgtctctggtgccctcntcgagtagttgtttctggtcggtcgtcgggtccgacgacgtcccgtaccggaaggggacgggtcgtagtaactacgtaggttaggtagttctctctanagttaggtggtacggttactagttacgacgttccgttctctacgaagtcgtcgtacgtcaccgtatactctcgtagacctaccgtacacgactaacgtacgtttaccgttttcccgaaggtaactcgttacggtacgttacgttaggtacccggtaacccgtccggtacgttacggaacccgggtaccggggttttaaccgtttttaacgttaccggttgggttacgggtacgaaacgggtacggtacccgggttaacttttaaggtttacgttacggtttttaacggttttggggtacggttttaacggttttaccggttaaccgtaaccccgtttaacccgtaggttaaccgttacccggggggtaccgggttcccttaccccggggtaccccgggttggggaacccggtaaacgggtaacgtttaccgggtccgtttaaacccggttaccccgttcccgttttaaccgtccggttaccccccgtttaaccgaaccccggggtaaccggggtaaccccctttcgggttaacccccggtttcccccctttacccccggggtacgggtaacccccctttaccccccggtttacccggttaaacccgggaacggtttaccccggttaacccccgg

SEQ ID NO: 141105 - DNA, 641 bp, Homo sapiens
  misc_feature: GYAE6OF02I8V3J.46.67.G01.1.454.CMB.1.raw
  modified_base (277)..(277): a, c, t, g, unknown or other
  misc_feature (277)..(277): n is a, c, g, or t
  modified_base (285)..(285): a, c, t, g, unknown or other
  misc_feature (285)..(285): n is a, c, g, or t
  modified_base (333)..(333): a, c, t, g, unknown or other
  misc_feature (333)..(333): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccgcagctccgagggagggctggaatacattggaagtgtctctcatagtggaggttcctattacagtccgtntctcaagngtcgagtcaccatatctctggacacgtccagcaatcagtttcctgaanatgtagttctgtgaccgccgctgacgacgggtcgttttattacgtgtgcgagagacgcgttatatgttagttttggaggttggttacgtttacgtacctaacccgttagtacgtcgggtaccggggaccttcccggaaccccggttgggggaccgagggtaaacgttacgtcgggttaccacccggttactaccttacggtcccctaccgtacccggaaacgggtccccgaagtttcccggttaccccttttacccccggtccggtaccctacccccgttaccccgtaccggtaacgacggtaccccg

SEQ ID NO: 141106 - DNA, 538 bp, Homo sapiens
  misc_feature: GYAE6OF02HIIK3.46.67.G01.1.454.CMB.1.raw
  modified_base (329)..(329): a, c, t, g, unknown or other
  misc_feature (329)..(329): n is a, c, g, or t
  modified_base (344)..(344): a, c, t, g, unknown or other
  misc_feature (344)..(344): n is a, c, g, or t
  modified_base (347)..(347): a, c, t, g, unknown or other
  misc_feature (347)..(347): n is a, c, g, or t
  modified_base (372)..(372): a, c, t, g, unknown or other
  misc_feature (372)..(372): n is a, c, g, or t
  modified_base (376)..(376): a, c, t, g, unknown or other
  misc_feature (376)..(376): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtcgcctccatcagtagtggtttcttcgtggggctgggtccggcagctcccagggaagggctggaatacattggaagtgtctctcatagtggaggttcctattacagtccgtctctcaagngtcgagtcaccatanctntggacacgtcagcaatcagtttccngaantgattctgtcgaccgcgctgacgacgggtcgtttattcgtggtgcgagacgacgctagttatgttagttttggagttgttatttcgactacctagactcggacgggctccggacccgtgggccaggactacgtcggtcaccggtctaccgttgccctacccg

SEQ ID NO: 141107 - DNA, 507 bp, Homo sapiens
  misc_feature: GYAE6OF02GHAI0.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatctgggacagatttcactctcacatcagtaatctgcaacgtgaagattttgcaacttattactgtacaacagaattactaatgttttcggacctaagggacacgactaacaaattaaacgaactagtagctgcaccatctcgtcttcatcttcccgcacttctgtac

SEQ ID NO: 141108 - DNA, 594 bp, Homo sapiens
  misc_feature: GYAE6OF02H2JIB.46.67.G01.1.454.CMB.1.raw
  modified_base (371)..(371): a, c, t, g, unknown or other
  misc_feature (371)..(371): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgcccctaagctcctaatctatgctgcatccagtttgcaaaggtcggggtcccagtcggaggttcggtggcagtggatcgtgggacagtatttcactctcaacntacagtatctgacaacgtagaagtattttgactaacttattacgtagttacaactagtaaattactaatttcggttttacggaccgtaaagggacctacgtaaacttaaaccgtaaaatttaaaaccggtaacgtagttacggactaggacctaaccgtattaccttcgttacctttactacgtttcccttaccccgtaccttacttacttcggtattaaccg

SEQ ID NO: 141109 - DNA, 520 bp, Homo sapiens
  misc_feature: GYAE6OF02JICT5.46.67.G01.1.454.CMB.1.raw
  modified_base (333)..(333): a, c, t, g, unknown or other
  misc_feature (333)..(333): n is a, c, g, or t
  modified_base (505)..(505): a, c, t, g, unknown or other
  misc_feature (505)..(505): n is a, c, g, or t
  modified_base (518)..(518): a, c, t, g, unknown or other
  misc_feature (518)..(518): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctgggctgggtccggcagctcccagggaaggggctggaatacattggaagtgtctctcatagtggaggttcctattacagtccgtctctcaagagtcgagtcaccatatctctggacacgtccagcaatcagttttcccngaagatgagttctgtgaccgcgctgacacgggcgtttatactgtgcgagagacggctattatgatttttggagtggttatttcgactaccctagatcgacggggctcgaccctggggccagggaatacgtggtcaccgtctcttagcctccacaagggccatcgtcttcccnggcacctctcagngc

SEQ ID NO: 141110 - DNA, 554 bp, Homo sapiens
  misc_feature: GYAE6OF02GFWP2.46.67.G01.1.454.CMB.1.raw
  modified_base (335)..(335): a, c, t, g, unknown or other
  misc_feature (335)..(335): n is a, c, g, or t
  modified_base (353)..(353): a, c, t, g, unknown or other
  misc_feature (353)..(353): n is a, c, g, or t
  modified_base (380)..(380): a, c, t, g, unknown or other
  misc_feature (380)..(380): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctcgtggtcgcctccatcagtagtggtttcttcgtggggctggggtccggcagcctcccgagggaaggggctggaatacatttggaagtgtctctcatagtggaggttcctattacagtccgtctctcaagngtcgagtcaccatatctntggacacgtcagcaatcagttttcccngagtatgagttctgtcgaaccgccgtctgacacgggctttaattacgttgtgcgtagagacggctattatgtagttttggagttggttatttcgactaccctagacgtcggacggggtctcggacccgtgggaccgagggactacgtggtcaccgttctccttacgcctacccg

SEQ ID NO: 141111 - DNA, 624 bp, Homo sapiens
  misc_feature: GYAE6OF02JOKA4.46.67.G01.1.454.CMB.1.raw
  modified_base (461)..(461): a, c, t, g, unknown or other
  misc_feature (461)..(461): n is a, c, g, or t
  modified_base (565)..(565): a, c, t, g, unknown or other
  misc_feature (565)..(565): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctcatcctcctgtctgaccaaccggtgggacactgtcgtaccacctatctacttcggcccgggataacggtccggaaactagttcgaacctacttaatttaaagtgtactacaactagtacgaccgagggacccgtaccctaagcctacctaatctaagtcgctgactactccgtagtttcgactaaggtccgggtacccagtccggtagttacaggttcggactagggtcgtactcggtacgggactagtactttcaacttctcacctatcaagtactctcgactaacgtgaaattntttacgaccttaagttattacgtatacaaactagtaaatactaagtttcgttaccgacgaacgtacaaccgtaactaacgtaaaattaccgaagttgacggtcngtaccaacctagtacttgtaccttactacgttcccttccgacttactaccgtagtaacc

SEQ ID NO: 141112 - DNA, 582 bp, Homo sapiens
  misc_feature: GYAE6OF02ITK82.46.67.G01.1.454.CMB.1.raw
  modified_base (216)..(216): a, c, t, g, unknown or other
  misc_feature (216)..(216): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccggnaagtcggaacattgacacctatttaaattggtatcaacatagaccagggacggcccctaagctcctaatctatgctgcatccagtttgcaaaggtcgggtcccagtcgaggttcaggtgcgaagtggatcgtaggacaggtattcactctcgacatacagtaatctagacaacgtgaaagtattttgactaactttattacttagttacaactaagtaatttaacaagtttagtttaccggactaaacggggtactaacgtaactaaacgtaaaacgttaaacgaacgttaggtacgtactcgtacgtacctattacgtcgttacttactcttacccgttccccgacgttaacttcgtagtaaccg

SEQ ID NO: 141113 - DNA, 564 bp, Homo sapiens
  misc_feature: GYAE6OF02JAJ4Y.46.67.G01.1.454.CMB.1.raw
  modified_base (532)..(532): a, c, t, g, unknown or other
  misc_feature (532)..(532): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaacgtgggagacagtgtcaccatcacttgccgggcaagtcggaacattgacaccttatttaaattggtatcaacatagaccagggacggcccctaagctcctaatctatgctgcactcctagtttgacaaaggtcggggtacccatcggaggttcaggtggcgagtggatcgtgggacagtatttccactctaccacctactactagtaactcgtagacaacgtagaagttagttttcgactaactttattacttagtacaaactaagtaaattacaatttcggtttacgaccgtaagggacacgtaactaactaaaataaaccgaattgtagctagaccaacacttcgtnttccttacacttcctcccactactctagtaac

SEQ ID NO: 141114 - DNA, 579 bp, Homo sapiens
  misc_feature: GYAE6OF02H2M43.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttcgctaaagtgggtcccatcgaggttcagtggcagtggatctgggacagtatttcactctacaccatcagttaatcgtagactaacgtgtaagtattttagactaactttattactgtacaactagtaattacattcggtttaccggaccgtaaagggactaacgtaacttaaacgtaaacgttaaaacgaacttaggtacgtactacggacctaaccgtaattccgtagttccttactactttcccgttaccccgtactaacgttcctagtaacc

SEQ ID NO: 141115 - DNA, 556 bp, Homo sapiens
  misc_feature: GYAE6OF02FZXGY.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagacagggacggcccctaagctacctaatctatgctgcatccagtttgcaaagtgggtcccatcgaggttcagtggcagtggatcgtgggacaggtatttcactctcaccatacagtaatctgacaacgtgtaagtattttagactaacttattacttgtactaacagtaattacaattgttttacgaccgaaggtaacaacgtaactaaactaaaacttaaacgaactagtagcgtacgactaacctatactcgttaccttactacttccgtttaccccgacctacttacctagtaac

SEQ ID NO: 141116 - DNA, 588 bp, Homo sapiens
  misc_feature: GYAE6OF02JLEBM.46.67.G01.1.454.CMB.1.raw
  modified_base (425)..(425): a, c, t, g, unknown or other
  misc_feature (425)..(425): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtgggagacagtgtcaccatcacttgccgggcaagtcggaacattgacacctatttaaatggtatcaacatagaccagggacggcccctaagctcctaatctatgctgcatccagtttgcaaagtgggtcccatcgagttcagtggcagtggatcgtggactagatttcgactctcaccatcagtaatctgactaagtagaagtattttgactaacttattactagtacaacataacgttnactaaagttcgttttacggaccgtaaagggacctaacgtactaacgtaaaactttaaacgaaccgttagtaggtaccgttacggaccctaaacgtacgttacgttacggttactttacctaacgttacccgttttaccccgaccgttacgttaccgttaacgg

SEQ ID NO: 141117 - DNA, 595 bp, Homo sapiens
  misc_feature: GYAE6OF02GXDM8.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtgcagtggatctgggacagtatttcactctcaccatacagttaatctgactaacgtagaagtattttagctaacttattactgtacaactagtaacttactaattgtttaccggacctaaaggggtacctaacggtaaccttaacaaaacgtttaaaacgtaaacttgttaacgggaccttaggacctaaccctaacgttaccttacggtttacctttacttaaccgttccctttacccccgacctaacttccgttaggtaacc

SEQ ID NO: 141118 - DNA, 560 bp, Homo sapiens
  misc_feature: GYAE6OF02HP7EV.46.67.G01.1.454.CMB.1.raw
  modified_base (332)..(332): a, c, t, g, unknown or other
  misc_feature (332)..(332): n is a, c, g, or t
  modified_base (390)..(390): a, c, t, g, unknown or other
  misc_feature (390)..(390): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccgcagctcccagggaagggctggaatacattggaagtgtctctcatagtggaggttcctattacagtccgtctctcaagagtcgagtcaccatatctctggacacgtccagcaatcagttttcccngaagatgagttctgtcgaccgccgctgacacgggtctttattactgtgcgagagacgntatatgtattttggagttggttattcgactaccctagatcggacggggctccggacccgtgggccagggactacgtcggtcaccgtctccttacgccctccgaaccgaacgggcccctagtccggttcccttcccccgtcggccctacccctccctaccacgcgtacccg

SEQ ID NO: 141119 - DNA, 557 bp, Homo sapiens
  misc_feature: GYAE6OF02IZKXW.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatgtatcaacatagaccagggacggcccctaagctcctaatctatgctgcatccagtttgcaaagtgggtcccatcgagttcagtggcagtggatcgtgggacagtatttcactctcaccatcagtatctgcaacgtgaagtattttagactaaacttatttaacttgtaccaaactaagtaatttacaattcgttttacggaccgtaagggactaacgtaactaacgtaaaattaaacgtaaactgtacgactagaccaacctaatcctagttaccttacgtacttccttaccccgactacttccgtagtaac

SEQ ID NO: 141120 - DNA, 528 bp, Homo sapiens
  misc_feature: GYAE6OF02HAZ3T.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgacaaagtgggtcccatcgaggttcagtggcagtgatcgtgggacagtatttcactctcaccatcagtaatctagcaacgtgaagtattttgactaacttattacttgtacaacagtaattacaattcgtttacgacctaagggacacgtactaactaaattaaacgaacttagtggactcgactacatctgtcttacacttccttacccgcctacttctgtac

SEQ ID NO: 141121 - DNA, 516 bp, Homo sapiens
  misc_feature: GYAE6OF02IB72Z.46.67.G01.1.454.CMB.1.raw
  modified_base (252)..(252): a, c, t, g, unknown or other
  misc_feature (252)..(252): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaatgtatcaanatagaccagggacgcccctaagctctaatctatgctgcatccagttttgcaaagtggggtcccatcgaggttcagtggcagtggatcgtgggacagatttcactctcacatcagtaatctgacaacgtgaagtatttgactaacgtttattacctgttacaactagtaattactaattgttttacgaccgtaaggacaacgactaacaaattaaacgaatgtgctagctacatctgtcttcgactcctcccgactactctgtac

SEQ ID NO: 141122 - DNA, 572 bp, Homo sapiens
  misc_feature: GYAE6OF02G14NC.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacacctatttaaatggtatcaacatagaccaggacggcccctaagctcctaatctatgctgcatccagtttgcaaagtgggtcccatcgagttcagtggcagtggatcgtgggacagatttcactctcaccatcagtaatctagcaacgtgaagtatttgactaacttattactgtacaactagtaattacaattcgttttacggaccgtaagggactaaccgtaacttaacgtaaaacgttaaaaccgaacttagtacggtacttacggacctaacctacttacctacgttacctttacacgtttccctttaccccgtacctacgttacctagttaaccg

SEQ ID NO: 141123 - DNA, 615 bp, Homo sapiens
  misc_feature: GYAE6OF02JV1CK.46.67.G01.1.454.CMB.1.raw
  modified_base (231)..(231): a, c, t, g, unknown or other
  misc_feature (231)..(231): n is a, c, g, or t
  modified_base (370)..(370): a, c, t, g, unknown or other
  misc_feature (370)..(370): n is a, c, g, or t
  modified_base (411)..(411): a, c, t, g, unknown or other
  misc_feature (411)..(411): n is a, c, g, or t
tcagactagcagtacacgaccggtgctcgatttagagtatacatattgggtttggggtagtctcggtcaggacacagcatggacatgagggtccccgctcagctcctggggctcctgctactctggctccgaggtgccagatgtgacatcgagctgacccagtctccatcctccctgtctagcaaccgtggagacagtgtcaccgatccacttgccgggcaagtcggaacnttgaccacttatttaaatgtatacaacatacgacaggacggacccctaagctacctaatactatcgctcgacactccagtttgacctaaaggttcgggtacccagttacggagtttacaggttcggactaggtgatcgngggactagtacttacgactctaccgactacgtactagtacncttcgaactaacgtagaacgttattttacgtaattacgttactgtaactaactaaggtaacttaacagtttagtttccgaaccgtaagggtaccacgtaacttaactaaaacttaacgggtaaattacggtagtacctagtaccgaacctagttactgttaacccttagtaccttcgttaccctcctattactacggtacctag

SEQ ID NO: 141124 - DNA, 559 bp, Homo sapiens
  misc_feature: GYAE6OF02G05AB.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaattgtatcaacatagacaggacgcccctaagctcctaatctatgctgcatccagtttgcaaagtggggtcccagtcgaggttcagtggcagtggatcgtgggacagtatttcactctcacctatcagtaactctgactaacgtgaagtatttgactaacttattactgtacaacagtaattacaattcgtttacggacctaaagggacaacgtaactaactaaaacttaaacgaacgtagtaggtactagtaccgaacctacttccgtagttaccttactactttccgtttacccgtacctacttcctagttaaccg

SEQ ID NO: 141125 - DNA, 563 bp, Homo sapiens
  misc_feature: GYAE6OF02FTN8O.46.67.G01.1.454.CMB.1.raw
  modified_base (395)..(395): a, c, t, g, unknown or other
  misc_feature (395)..(395): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccgcagctcccagggaagggctggaatacattggaagtgtctctcatagtggaggttcctattacagtccgtctctcaagagtcgagtcaccatatctctggacacgtccagcaatcagttttcccctgaagatgagttctgtcgaccgccgctgacgacgggtcgttttattactgtgcgagagacggntattatgtagttttggagttggttatttcgactaccctagactcggacggggctcggacccgtggggccagggactaccgtggtccacgttctccttacgcctccgaccgaacgggcccacgtccggtccttccccgtggccctacccctcctcccgacgcgtacccg

SEQ ID NO: 141126 - DNA, 580 bp, Homo sapiens
  misc_feature: GYAE6OF02HI3AB.46.67.G01.1.454.CMB.1.raw
  modified_base (249)..(249): a, c, t, g, unknown or other
  misc_feature (249)..(249): n is a, c, g, or t
  modified_base (328)..(328): a, c, t, g, unknown or other
  misc_feature (328)..(328): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccggnagctcccgagggaaggggctggaatacattggaagtgtctctcatagtggaggttcctattacagtccgtctctcaagngtcgagtcaccatatctctggacaccgtcagcaatctacgtttccctgaagtatgacgttctgtcgaccgccgctcgacgacgggtcgtttatctgtgcgagagacgtctattatgtagttttggtagttggtttatttccgaactaccctaagacgtccgggacggggtctaccggaccccggtcggggaccgtaagggtaactacggtcggtaccgtacccggttccttacccgttacgccctaacccgg

SEQ ID NO: 141127 - DNA, 588 bp, Homo sapiens
  misc_feature: GYAE6OF02H494G.46.67.G01.1.454.CMB.1.raw
  modified_base (254)..(254): a, c, t, g, unknown or other
  misc_feature (254)..(254): n is a, c, g, or t
  modified_base (304)..(304): a, c, t, g, unknown or other
  misc_feature (304)..(304): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtatccatcctccctgtctgcaaccgtgggagacagtgtcaccatcacttgccgggcaagtcggaacattgacactatttaaattggtatcaanatagaccagggacggcccctaagctcctaatctatgctgcatccagtttncaaagtgggtcccatcgagttcagtggcagtggatcgtgggaacagatttcaactctcaccattacagtaatctgactaaacggtgaaagtattttagactaaactttattaactgtacaaacagtaaattaacaattgtttaccggacgtaaagggacaacgtactaaacgtaaaactaaaacgtaaacgtagtaggacttcggacctaacgtacttaccttagtttaccgttacctaacgttcccgttaccccggtaacccctaattaccctaggttaaacc

SEQ ID NO: 141128 - DNA, 534 bp, Homo sapiens
  misc_feature: GYAE6OF02G7O1S.46.67.G01.1.454.CMB.1.raw
  modified_base (283)..(283): a, c, t, g, unknown or other
  misc_feature (283)..(283): n is a, c, g, or t
  modified_base (329)..(329): a, c, t, g, unknown or other
  misc_feature (329)..(329): n is a, c, g, or t
  modified_base (334)..(334): a, c, t, g, unknown or other
  misc_feature (334)..(334): n is a, c, g, or t
  modified_base (342)..(342): a, c, t, g, unknown or other
  misc_feature (342)..(342): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccgcagctccagggagggctggatacattggaagtgtctctcatagtggaggttcctattacagtccgtctctcaagngtcgagtcaccatatctctggacacgtccagcaatcagttttcccngaagntgagttcngtgaccgcgctgacacgggctttatctgtgcgagagacggctattatgtattttggagttggttatttcgactaccctagtatcgacggggtctcggaccctggggccagggatacgtgtcaccgtctccttagcctccaccgaacggccctagtccggtcttccccgtggcctacccgtcctccagcgtcc

SEQ ID NO: 141129 - DNA, 594 bp, Homo sapiens
  misc_feature: GYAE6OF02FYLR9.46.67.G01.1.454.CMB.1.raw
  modified_base (192)..(192): a, c, t, g, unknown or other
  misc_feature (192)..(192): n is a, c, g, or t
  modified_base (227)..(227): a, c, t, g, unknown or other
  misc_feature (227)..(227): n is a, c, g, or t
  modified_base (406)..(406): a, c, t, g, unknown or other
  misc_feature (406)..(406): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcgaacnttgacacctatttaatgtatcaacatagaccagggacggcccctaagctcctaatctatgctgcatccagtttgcaaaggtgggtcccatcgaggttcagtggcagtggatcgtgggacagtattcgactctcaccatcagtatctgctaacgtgaatatttagactaacttattactntacaactaagtaattactaatttacggttttaccggaacctaaggggtacctaaccggtaaccttaaacgtaaaactttaaaccgaacgttacgtacggtaccgttagacccgtaacctaacttaccgttcgttacctttaccgtactttcccctttaccccggacccttacgtttcctagttaaccg

SEQ ID NO: 141130 - DNA, 564 bp, Homo sapiens
  misc_feature: GYAE6OF02HGKCU.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgactaaaaggtcggggtacccagtcgaggttcagtggcaggtggatcgtagggacagtatttcactctcaccatacagtaatctagactaacgtgaagtattttagactaacttattactgttacaacaagtaattaacaatttcggttttacgaccgtaaggtacaacgtaactaactaaaattaaacgaacttgtaggtctagactaacctattctacgttactttactacttccttcccgacctacttacgtgtaac

SEQ ID NO: 141131 - DNA, 628 bp, Homo sapiens
  misc_feature: GYAE6OF02JIHON.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgagggaagggctggaatacagttggaagtgtctctcatagtggaggttcctattacagtccgtctctcaagagtcgagtcaccatatctctggacacgtccagcaatctacgttttccctagtaagatgtagttctgtgtaccgccgcgtcgaccgtacggggtcgttttattacgtgtgcgaggagacggtctattagtgttattttgggagtttggttatttacgtactacccgttagtacgtcggtacggggtcctaccggtacccgtcgggaccgagggtaacgtacgttcggtccacccgtcgttaccgttacgtccctaccgaacccgacgggtaccctacgttaccggttcccttcccccgtacggtcccctaccccgttaccctaccgtacgaccgtacccg

SEQ ID NO: 141132 - DNA, 666 bp, Homo sapiens
  misc_feature: GYAE6OF02HDHVJ.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttggccgggcaagtcggaacattgacaccttatttaaattggtatcaacatagaccagggacggcccctaagctacctaatctatgctgcatccagtttcgactaaaaggtcggggtacccagtcggaggtttcaaggttggacaggtggatcgtggggacagtatttcacttctcacctatcagtaatctgacaacgtgaaacgtattttggacctaaatttacttattacgtacctaaaacagtaaatttaactaaagttttacggttttacccgggaaccgttaaacggggaactaaaccggtaaccttaaaacgtaaaaacgttttaaaaacggaaaccttagggttacgggtacctcggtaaccctaaaccgtaacttcgtttaccggttaccttttacctactttaccccggtttacccccgaacccttaactttaccgtaggttaaaaccc

SEQ ID NO: 141133 - DNA, 901 bp, Homo sapiens
  misc_feature: GYAE6OF02J03SW.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtgggctgggtccgcagctcccgagggaacgggctggaatacagttggaagtgtctctcataggtgggtacgttctatacgcgtccgtctctagagtacgtacgacgtaccactagtactccttcgtacggaaccctaccgtaccgacgtaacctaacgttaccgttttaacccggtttttaccccgaaggtaaacgttaacgttacggttaccgttttacggtacgggttaacccggacccccggtccggtaccgttaaccgggaaccggggtttaacccggggttttaccgttttttaaactttaccgggttacgggtaccgggtaacgggaaacgggtaccgggtacccggtttaagttttaaacgtttacggtttaggttttaacgggttttttaggggtaagggtttttacggttttaccgtttaacccggaaccccgtttaaccggttaaggtacccggttaccggggggtacccgggtacccgttaacccccgggtacccggggttacggggaacccggtaaaaggggttaccgttaccgggttaccggtaccccgttacccgttacccgttaccggttacccgaccccgttacccgaacccgggtaacccgggtcccgtacggtttccccggttccccgttacccccggtcgaccccccgttacccgttacccgaacccggtaacggtccctaccccgg

SEQ ID NO: 141134 - DNA, 581 bp, Homo sapiens
  misc_feature: GYAE6OF02HKX9Z.46.67.G01.1.454.CMB.1.raw
  modified_base (191)..(191): a, c, t, g, unknown or other
  misc_feature (191)..(191): n is a, c, g, or t
  modified_base (347)..(347): a, c, t, g, unknown or other
  misc_feature (347)..(347): n is a, c, g, or t
  modified_base (373)..(373): a, c, t, g, unknown or other
  misc_feature (373)..(373): n is a, c, g, or t
  modified_base (380)..(380): a, c, t, g, unknown or other
  misc_feature (380)..(380): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtggganacagtgtcaccatcacttgccgggcaagtcggaacattgacacctatttaaatggtatcaacatagaccagggacggcccctaagctcctaatctatgctgcatccagtttgcaaagtgggtcccatcgagttcagtgcagtgatcgtgggacagntttcactctcacctatcagtaatctnacaagtntaagtattttacgactaacttattactagtactaacgtagtaattactaattacgtttacggacctaagggtacctacgtaacttaacgtaaacttaaacgtaacgttacgttacgggacttacgtaccgtaacctattaccttacggttacctttacgtaaccgttccgttccccgtacctaacgttccgtacgttaacg

SEQ ID NO: 141135 - DNA, 568 bp, Homo sapiens
  misc_feature: GYAE6OF02IIHT4.46.67.G01.1.454.CMB.1.raw
  modified_base (406)..(406): a, c, t, g, unknown or other
  misc_feature (406)..(406): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactgggtgaggccttcggagaccctgtccctcacctgcgctgtctctggtgcctccatcagtagtggtttcttcgtggggctgggtccggcagctcccgagggaaggggctggaatacattggaagtgtctctcatagtggaggttcctatacagtccgtctctcaagagtcgagtcaccatatctctggacacgtccagcaaatctaacgttttcccagaacgtatgtagttctggtcgaacccgcgtctaggacacgggtctttaatactgtgcgagagacgntatatgtatttggagttggttattcgactaccgtagagtacggacgggctcgtacccggtgggccgtagggaactacgtggtccacgtcctccttacgcctaccaccgaacggccacgtcggtcccttcccgtcgcctaccctcctaccgacgacgtacccg

SEQ ID NO: 141136 - DNA, 657 bp, Homo sapiens
  misc_feature: GYAE6OF02G3YMJ.46.67.G01.1.454.CMB.1.raw
  modified_base (438)..(438): a, c, t, g, unknown or other
  misc_feature (438)..(438): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctcgacccagtcctccatccctccctgtctgcaaccggtgggagacagtcgtaccaccatcacgttcggacccgggacaaggtcggaaactatttcgaacctaaccttaatttaaagttggtaatacaaacagtaacggaccgaacgggaccgacccctaagccttacctaactctatcgctgctatcctagtttcgacgtaagggtccgggtaccagtcggtaggttcaggtggacgtaggtggatcggtagggactagtattcactctacactatcaagttacnctagaactaaggtagtaattatttacgacttaaactttacttactacgtaacaacgtaataaactttacgaaagttttcggtttaaccggaccgtaaagggacctaacgtaacctaaactaaaagttaaacgaacgttgtacggtacttaggacctaacctagttaccttacgttaccttaccttacgttcccgttacccgacctacgttcctagtaac

SEQ ID NO: 141137 - DNA, 670 bp, Homo sapiens
  misc_feature: GYAE6OF02JR8Q8.46.67.G01.1.454.CMB.1.raw
  modified_base (174)..(174): a, c, t, g, unknown or other
  misc_feature (174)..(174): n is a, c, g, or t
  modified_base (444)..(444): a, c, t, g, unknown or other
  misc_feature (444)..(444): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgacctgggtgaggccttcggagaccctgtccctcacctgcgctgtctctggtcncctcatccagtagtggtttctcgtgggtctggggtccgcagcctccgagggagggctggaatacagttaggaagttcgtctcgtcagttaggtggtaggttcctattacgacgtccgtctctacaagtagtcgagtcaccatactctcgtaggacacgtaccagactaactctacgttttcccagaagtacgtagtacgttctgtcgaccgccgcgtggaccgtacggggttacttttaacgtcgtgttcgacgtagggacgtaccggtnttagttaagttggttagttttagggagttcggtttatttaccggaacctaccgtagtacgtaccgggacggggtcctaccggaccccggtgggaccgtaggggtaacttcggtacgtccgtacccggttcttaccgtaccgtcccttaccgaaccggtaccggtcctacggtcccggtacccttccccgtacgccctaccccgtccgtaccgtaccgccgtacccg

SEQ ID NO: 141138 - DNA, 643 bp, Homo sapiens
  misc_feature: GYAE6OF02IYOLU.46.67.G01.1.454.CMB.1.raw
  modified_base (254)..(254): a, c, t, g, unknown or other
  misc_feature (254)..(254): n is a, c, g, or t
  modified_base (359)..(359): a, c, t, g, unknown or other
  misc_feature (359)..(359): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaaggtcggaacatgacaccttatttaaatgtatcaanatagaccagggacggcccctaagctacctaatctatgctgcatccagtttgcaaagtcgggtccatcgaggttcagtgcagtggatgtggacagtattcgacttntaccactatacagtaactctagactaaacgtgtaaagttagttttaacgacttaaactttacgtttacttagttaaccaaactaaagtaaatttaactaaagtttacggttttaccggaccgtaaacgggaacgtaaccggaacttaaaccgtaaaaacgtttaaaccgtaaacgttacggtcggtaccgttaggaccctaaacccgttaactaccgtttccggttactttaaccgaccgtttaccccgtttaccccgaccctaacctttccgtaacttaaccg

SEQ ID NO: 141139 - DNA, 534 bp, Homo sapiens
  misc_feature: GYAE6OF02GKBVX.46.67.G01.1.454.CMB.1.raw
  modified_base (372)..(372): a, c, t, g, unknown or other
  misc_feature (372)..(372): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccgcagctccgagggaaggggctggaatacattggaagtgtctctcatagtggaggttcctattacagtccgtctctcaagagtcgagtcaccatatctctggacacgtccagcaatcagttttcccngaagatgagttctgtgaccgccgctgacacgggctttattactgtgcgagagacggctattatgtatttttggagttggttatttcgactaccctagagtcgacgggggctccggacccgtggggccagggatacgtggtcaccgtctccttagcctacccg

SEQ ID NO: 141140 - DNA, 673 bp, Homo sapiens
  misc_feature: GYAE6OF02I6J7B.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctgggctgggtccggcagctccagggaaggggctggaatacattggaagtgtctctcatagtggaggttcctattacagtccgtctctcaagagtcgagtcaccatatctctggacacgtccagcaatctacgttttcccagaagtactgacgttcgtgtcgacccgccgtcgtcgacgtacgggtcttttaagttacgtgtcgacgagtaacggacggtacttaagtttagttcgttaagtttttagggagtttaggtttactttccgtaacctacccgttaaggtacgttccgggaaccgggggtccttacccgggaccccggttggggacccgtaagggtaaacgttccggtacgggtacccgtaaccgttccgtaccgtttaacgcccttacccgaaccggtaacgggtcccctaggtcccggttccttaccccccgttggcccctaccccgttcctacccgaagtaccgtacccg

SEQ ID NO: 141141 - DNA, 657 bp, Homo sapiens
  misc_feature: GYAE6OF02FPYRV.46.67.G01.1.454.CMB.1.raw
  modified_base (198)..(198): a, c, t, g, unknown or other
  misc_feature (198)..(198): n is a, c, g, or t
  modified_base (379)..(379): a, c, t, g, unknown or other
  misc_feature (379)..(379): n is a, c, g, or t
tcagactagcagtacacgaccggtgctcgatttagagtatacatagttaggggtttggggagtctcggtcaggacacagcatggacatgaagggtccccgctcaagctcctggggctcctgctactctggctccgaggtgccagatgtgacatcgagctgacccagtctccatccctccctgtctgcaaccgtggganacagtgtccaccatcacttgccgggtcaaggtcggaacattcgactacctatttaaagtggtatcaacatacgacgagggaccggcccctaagcctcctaatctatgctgctatccagtttgactaaaggtcgggtaccagtcgaggttcagtcgcagtgatcgtggactagattcactcncacatacagtaactcgtacgactaacgtcgtaagtatttcgactaaacgtttacttacttcgtaccaaacgtaacgaaactttaacctaagttcggttttaccgggaaccgttaaacggggtaacctaaccgggtaactaaaaccgtaaaaacgtttaaaaccggtaaaccgtttaggttacgggacttacggacccttaaccctaaattaccgtacgtttaccttaccgtacgttacccgttaccccggtaccgtaccgttaccggtacgttaaccg

SEQ ID NO: 141142 - DNA, 554 bp, Homo sapiens
  misc_feature: GYAE6OF02FQF0F.46.67.G01.1.454.CMB.1.raw
  modified_base (335)..(335): a, c, t, g, unknown or other
  misc_feature (335)..(335): n is a, c, g, or t
  modified_base (534)..(534): a, c, t, g, unknown or other
  misc_feature (534)..(534): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagttccgtctctcaagagtcgagtcaccatatctctggacacgtccagcaatcagttttcccngaagatgagttctgtgaccgcgctgacacgggtcttttatactgtgcgagagacggctattatgtattttggagttggttatttcgacacccgttagatcggacggggtctcgaccccgtggggccgagggactacgtggtcaccgtctccgttacgcctccaccgaacgggcccagtccggtcccttccccgcgcccnccctcctaccacgctacccg

SEQ ID NO: 141143 - DNA, 544 bp, Homo sapiens
  misc_feature: GYAE6OF02HWGE0.46.67.G01.1.454.CMB.1.raw
  modified_base (248)..(248): a, c, t, g, unknown or other
  misc_feature (248)..(248): n is a, c, g, or t
  modified_base (286)..(286): a, c, t, g, unknown or other
  misc_feature (286)..(286): n is a, c, g, or t
  modified_base (332)..(332): a, c, t, g, unknown or other
  misc_feature (332)..(332): n is a, c, g, or t
  modified_base (475)..(475): a, c, t, g, unknown or other
  misc_feature (475)..(475): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtccctcacctgcgctgtctctggtgcctccatcagtagtggtttcttctggggctgggtccggcagctcccagggagggctggaatacattggaatgtctntcatagtggaggttcctattacagtccgtctctcaagngtcgagtcaccatatctctggacacgtccagcaatctattttcccngtaagatgagttctggtacgaccgccgctgacgacgggtcgttttaatacgtgtcgcgagagacggctattatgtagttttggagttggtttattcgactacctagtatcggacggggctcgacccgtggggccagggatcgngtcacgtctctagcctcaccgaggcccagtccgccttcccctggccctaccctccctaccacgcgtccc

SEQ ID NO: 141144 - DNA, 535 bp, Homo sapiens
  misc_feature: GYAE6OF02ITB94.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaatggtatcaacatagaccagggacggcccctaagctacctaatctatgctgcatccagtttgcaaaggtgggtcccagtcgaggttcagtggcagtgatcgtgggacagtatttcactctcaccatcagtaatctagacaacgtagaagtatttagactaacttattacgttagtacaactaagtaaacttacaagttgtttacggaccgtaagggacacgtaactaactaaactaaacgtaactgtagctagacactatcgtcgtcttcacttccgtcccgctactctgtac

SEQ ID NO: 141145 - DNA, 516 bp, Homo sapiens
  misc_feature: GYAE6OF02H38W0.46.67.G01.1.454.CMB.1.raw
  modified_base (512)..(512): a, c, t, g, unknown or other
  misc_feature (512)..(512): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgcccctaagctcctaatctatgctgcatccagtttgcgaaagtggggtcccatcgaggttcagtggcagtggatctgggacagtatttcactctcacatcagtaatctgacaacgtgaagtattttgactaacttattactgtacaaacagtaattacaattgtttacggacaaggacaacgactaacaaattaaacgaactgtagctagcaactatctgttctcacttcctcccgcctatctntaac

SEQ ID NO: 141146 - DNA, 633 bp, Homo sapiens
  misc_feature: GYAE6OF02I4AUK.46.67.G01.1.454.CMB.1.raw
  modified_base (394)..(394): a, c, t, g, unknown or other
  misc_feature (394)..(394): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccgcagctccagggagggctggaatacagttggaagtgtctctcatagtggaggttcctattacagtccgtctctcaagagtcgagtcaccatatctctggacacgtccagcaatctacgttttccctgaagatgtagttctgtcgaccgcgctgacgacggtcgtttattacgtgtgcgagagacgntattatgttagtttggtagttggttagtttacgtactacctacgtacgtacggtacggggtccgtccggtacccgtcggggaccggtacgggtaacgtacgttcggtaccgtaccgtccgttaccgttaccgtccctaccgaccggaaccggacccgtaccttcccggggggggggttcccctttcccccgttccggtcccgtaccccgttaccccgtacccgtaccgtaccgtacccg

SEQ ID NO: 141147 - DNA, 528 bp, Homo sapiens
  misc_feature: GYAE6OF02IVF9X.46.67.G01.1.454.CMB.1.raw
  modified_base (505)..(505): a, c, t, g, unknown or other
  misc_feature (505)..(505): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccaggacggcccctaagctctaatctatgctgcatccagtttgacaaagtgggtcccatcgaggttcagtggcagtggatcgtgggacagtatttcactctcacatcatatctagacaacgtgaagtatttgactaacttattactgtactaacagtaaattacaattgtttaccgacgtaagggacaacgactaactaaattaaacgaactgtacgctacgtacgaacctatccttagtccttnacttcctaccctcacttctatac

SEQ ID NO: 141148 - DNA, 540 bp, Homo sapiens
  misc_feature: GYAE6OF02INF74.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatcgtgggacagtatttcactctcaccatcagtaatctagcaagtagaagtattttgactaacttattactgtacaactagtaattaacaattgtttacggacgtaacgggacaacgaactaactaaaattaaacgaaacttgtagactagaccactacgtctacgtacttactacttccttcccgacctactctagtaac

SEQ ID NO: 141149 - DNA, 570 bp, Homo sapiens
  misc_feature: GYAE6OF02I5KF1.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggagacagtgtcaccatcacttgccggcaagtcggaacattgacacctatttaaatggtatcaacatagaccagggacgcccctaagctcctaatctatgctgcatccagtttgctaaagtgggtcccatcgaggttcagtgcagtggatcgtgggacagatttcacttctacaccatcagtaactctgactaacgtataacgttagtttacgacttaactttacttacttacgtacaaacgtagtaaattaacgtatttcggtttacggaccgtaagggtaaccaacgtactaaacttaaaagttaaacctaagtcgtagcgttacgacgaccttaattcgtacgttcttactaccttccgttcccgacttactctagtaac

SEQ ID NO: 141150 - DNA, 559 bp, Homo sapiens
  misc_feature: GYAE6OF02HFPLR.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaggggctggaatacattggaagtgtctctcatagtggaggttcctattacagtccgtctctcaagagtcgagtcaccatatctctggacacgtccagcaatctagttttccctgaagatgagttctgtcgaccgccgctgacacgggtcgtttattactgtgcgagagacggctagttatgtagttttggagttggttatttcgactaccctagatcggacggggctcgacccgtgggccgaggactacgtgtcaccgtctccttacgcctaccgacccgaagggccctagtccggttcccttccccgtcggccctaccctccctaccacgcgtaccc

SEQ ID NO: 141151 - DNA, 609 bp, Homo sapiens
  misc_feature: GYAE6OF02HWV08.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccgcagctcccgagggaggggctggaatacattggaagtgtctctcatagtggaggttcctattacagtccgtctctcaagagtcgagtcaccatatctctggacacgtccagacaatctagttttcccctagaagtatggtagttctgtcgaccgccgctcggacgtacgggtcgtttattacgtggtcgcggagaggacggtcttaagttatgtagtttttgggagttggttatttcgtactaccgtagtacgtcgggacggggcctccggaccccgtgggggaccgtaagggaactacgtgggtccacgtccttccttacgccctcccgaacgtaacgggcccctagtccgttcccttccccgtcggtccctaccccgtccctacccgacgacgtacccg

SEQ ID NO: 141152 - DNA, 557 bp, Homo sapiens
  misc_feature: GYAE6OF02G2QVY.46.67.G01.1.454.CMB.1.raw
  modified_base (331)..(331): a, c, t, g, unknown or other
  misc_feature (331)..(331): n is a, c, g, or t
  modified_base (377)..(377): a, c, t, g, unknown or other
  misc_feature (377)..(377): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgccgctgtctctggtgcctccatcagtagtggtttctcgtggggctgggtccggcagcctcccgagggaaggggctggaatacattggaagtgtctctcatagtggaggttcctattacagtccgtctctcaagngtcgagtcaccatatctctggacacgtcagcaatctagttttcccngaagtatgagttctgtcgaccgccgctgacgacgggtcgttttactactggtgacgagagacggtctattatgttagtttttggagttggtttattcgactaccctagatcggacggggtctccggcccgtgggaccgagggaactacgtcggtccgtaccgtctccttacgcctacccg

SEQ ID NO: 141153 - DNA, 603 bp, Homo sapiens
  misc_feature: GYAE6OF02JFML6.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattgtatcaacatagaccagggacggcccctaagctcctaatctatgctgcatccagtttgcaaagtggggtccatcgaggttcagtggcagtggatcaggacagatttcactctcaccatcagtaatctgctaaacgtgaagtattttacgactaacttaagtttacctgtactaaactagaaactttaacaatttacggttttaccggacccgtaaagggtaaccaaccggtaaccttaaacgtaaaactttaaaaaccggaacttaggttacggtacttcgtacgtaacctaacgttcgttacgttacctttactacgttcctttacccccgacccgtaacttaccgtagttaaccg

SEQ ID NO: 141154 - DNA, 533 bp, Homo sapiens
  misc_feature: GYAE6OF02H94ZP.46.67.G01.1.454.CMB.1.raw
  modified_base (250)..(250): a, c, t, g, unknown or other
  misc_feature (250)..(250): n is a, c, g, or t
  modified_base (371)..(371): a, c, t, g, unknown or other
  misc_feature (371)..(371): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccgnagctcccgagggagggctggaatacattggaagtgtctctcatagtggagttcctattacagtccgtctctcaagagtcgagtcaccatatctctggacacgtcagcaatctagtttcccngaagatgagttctgtcgaccgccgctgacgacgggtcgtttattacgtgtgcgagagcgctattatgtattttggagttggtttattcgactaccgtagagtcggacggggtctccgacccgtgggccaaggtatacgtgtcaccgtctcgttcgcctaccg

SEQ ID NO: 141155 - DNA, 605 bp, Homo sapiens
  misc_feature: GYAE6OF02JAQHO.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacaccttattaaatggtatcaacatacgaccgagggaccggcccctaagcctactaatctatgctgcatcctagtttgacgaaaggtcgggtacccagtcggtaggttcgagtcggcagtggactcgtagggactagtattcgactctaccacctatactagtaactctacgactaacgtgtaaagttattttcgacttaacttacttacgttatacaaactaagtaacttaacagtttcgttacggaccgtaagggacctacggtaactaaacgttaaaacgttaaacgtaacttgggtacgcctagaccctaactaagttccttacgttctttacctacgttcccttacccgacctacgttacctggtaacc

SEQ ID NO: 141156 - DNA, 556 bp, Homo sapiens
  misc_feature: GYAE6OF02HF4X7.46.67.G01.1.454.CMB.1.raw
  modified_base (410)..(410): a, c, t, g, unknown or other
  misc_feature (410)..(410): n is a, c, g, or t
  modified_base (450)..(450): a, c, t, g, unknown or other
  misc_feature (450)..(450): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcgaacattgacacctattaaatgtatcaacatagaccagggaccgcccctaagctactaatctatgctgcatcctagtttgcaaagtcgggtccatcgagttcagtgcagtggatcgtggacagtattcactcacacatcaagtaatctagacaacgtagaagtatttgactaacttatactgtacaanactaattacaatttgttacgacaaggacaacgtaactaanaaaattaaacgacgttgtacggcttacgaccgaaccgtacttcggttattaccgtttacctaacgtttccccgttacccgtacctaacgtttcccgtaggtaaacc

SEQ ID NO: 141157 - DNA, 652 bp, Homo sapiens
  misc_feature: GYAE6OF02IHZVQ.46.67.G01.1.454.CMB.1.raw
  modified_base (214)..(214): a, c, t, g, unknown or other
  misc_feature (214)..(214): n is a, c, g, or t
  modified_base (251)..(251): a, c, t, g, unknown or other
  misc_feature (251)..(251): n is a, c, g, or t
tcagactagcagtacacgaccggtgctcgatttagagtatacatattgggtttggggacctcctgtgcaagaacatgaagcacctgtggtttgtcctcctgctggtggcagctcccagatgggtcctgtccctggtgcaactgcaggagtcgggcccacgactggtgaggccttcggacgaccctgtcccctcacctgcgctgtctcgtggtcncctccatcagtagtgtttctcgtggggctgggtccgnagcctaccgagggaagggctaggtaatacgtagttggaagtgtctctcagttaggtcggtacgttacctagttacgacgttccgttactcgtacgtaagtacgtcgtaacgtccactagtactctcgtcggactacgtcagtactaacgtcttaacgttttcccagtaacgtatgtacgtttcgtgtacgaccgtccgtcgtagaccgtacgggttactttagttacgtgttcggacgagtacgtacggtcttagttagttgttagttttaggagtttgtttacttccgtaaccttaccgtagtacgtcgggtacgggtccgtaccggtcccggtcggggaccgtaagggtaactacggtcggtaccgtacccggttcctaccgttccgtacccgtacccg

SEQ ID NO: 141158 - DNA, 533 bp, Homo sapiens
  misc_feature: GYAE6OF02GAE1L.46.67.G01.1.454.CMB.1.raw
  modified_base (374)..(374): a, c, t, g, unknown or other
  misc_feature (374)..(374): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctccagggaaggggctggaatacattggaagtgtctctcatagtggaggttcctattacagtccgtctctcaagagtcgagtcaccatatctctggacacgtccagcaatctagttttcccngaagatgagttctgtcgaccgcgctgacgacgggtctttatactgtgcgagagacgctattatgtatttttggagttggttatttcgactacctagagtcgacggggctcggacccgtgggccaggatacgtggtcaccgtctccgttacgcctacccg

SEQ ID NO: 141159 - DNA, 558 bp, Homo sapiens
  misc_feature: GYAE6OF02FTRKL.46.67.G01.1.454.CMB.1.raw
  modified_base (377)..(377): a, c, t, g, unknown or other
  misc_feature (377)..(377): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccgcagctccagggagggctggaatacattggaagtgtctctcatagtggaggttcctattacagtccgtctctcaagagtcgagtcaccatatctctggacacgtccagcaatctacgttttcccagaagtntgagttctgtcgaccgccgtctggaccgtacgggtcgtttaatacgtgttcgcgagaggtcgtcttagttatgtagttttggagttggttattcgactaccgtagtcgtcggacggggtctccggtacccgtggggaccagggactacgtcggtcctaccggtctccgttacgccctaccg

SEQ ID NO: 141160 - DNA, 574 bp, Homo sapiens
  misc_feature: GYAE6OF02G0YWP.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccaggacggcccctaagctcctaatctatgctgcatccagtttgctaaaggtgggtcccagtcgaggttcagtggcgagtggatcgtaggggacaggactttcgactctaccacctatacagtaatctgcaacgtgaagtatttgactaactttattactgtacaactagtaattaacaagtttcgttttacggaccgtaagggtactaacgaacgttaactaaaagttaaaccgaaacttggtacggtacttaggacctaaccctattactcgttacttacctacttcctttccccgacctacttcctagtac

SEQ ID NO: 141161 - DNA, 505 bp, Homo sapiens
  misc_feature: GYAE6OF02H9DQI.46.67.G01.1.454.CMB.1.raw
  modified_base (192)..(192): a, c, t, g, unknown or other
  misc_feature (192)..(192): n is a, c, g, or t
  modified_base (414)..(414): a, c, t, g, unknown or other
  misc_feature (414)..(414): n is a, c, g, or t
  modified_base (477)..(477): a, c, t, g, unknown or other
  misc_feature (477)..(477): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcgaacattgacactatttaaattgtatcaacatagacagggacgccctaagctcctaatctatgctgcatccagtttgcaaagtgggtcccatcgagttcagtggcagtgatcgtggacagatttcactctcacatcagtatctgacaacgtagaagtatttgactaacttattactgtacaacagtaattanaattgtttacggactaaggacacgaactaataaacttaaacgaactgtagctagcaacatctnttactctactcctcccgctactctgtac

SEQ ID NO: 141162 - DNA, 561 bp, Homo sapiens
  misc_feature: GYAE6OF02H606N.46.67.G01.1.454.CMB.1.raw
  modified_base (375)..(375): a, c, t, g, unknown or other
  misc_feature (375)..(375): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccgcagctcccagggaaggggctggaatacattggaagtgtctctcatagtggaggttcctattacagtccgtctctcaagagtcgagtcaccatatctctggacacgtccagcaatctagttttcccngaagatgagtttctgtcgaccgccgctgacacgggtcgtttattactgtgcgagagacgtctattatgttatttttggagttggtttatttcgtactacctagtacgtcggacggggtctccggaccccgtggggccgaagggtaactacgtggtacctaccgttcctaccgttacgccctacccg

SEQ ID NO: 141163 - DNA, 572 bp, Homo sapiens
  misc_feature: GYAE6OF02H8896.46.67.G01.1.454.CMB.1.raw
  modified_base (192)..(192): a, c, t, g, unknown or other
  misc_feature (192)..(192): n is a, c, g, or t
  modified_base (218)..(218): a, c, t, g, unknown or other
  misc_feature (218)..(218): n is a, c, g, or t
  modified_base (306)..(306): a, c, t, g, unknown or other
  misc_feature (306)..(306): n is a, c, g, or t
  modified_base (400)..(400): a, c, t, g, unknown or other
  misc_feature (400)..(400): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgcccgggnaagtcggaacattgacacctatttaaattggtatcaacatagaccagggacggcccctaagctcctaatctatgctgcatccagtttncaaaggtgggtcccatcgaggttcagtggcagtggatcgtgggacagatttcacttctcaccatctagtaactctgaccgaacgttgaaagttnttttagactaaacttttattacttgtacaacagtaattactaattgttttcgaccgaaggacctaagaactaacgtaaaattaaacgaaacgttagtaggtacctagccgtaaccctattaccgttcgttcttacctacttcccttccccgtacctacctttcctgtaaccg

SEQ ID NO: 141164 - DNA, 587 bp, Homo sapiens
  misc_feature: GYAE6OF02H73YQ.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacacctatttaaattgtatcaacatagaccagggacggcccctaagctcctaatctatgctgcatccagttttgactaaaggtgggtcccagtcgaggttcagtggcgagtggatctgggacagatttcactctcaccatctaagtaatctagactaacgtagtaagtatttgaccttaactttaatttactgttaaccaaactaagttaaattaactaatttggttttaccggaccgaagggacctaacgaacctaaacgtaaaattaaaaccggtaaacttggtacggtactcgaccgtaacctacttcctagttcctcttacgtccgttccccgtactacttacctgttaacc

SEQ ID NO: 141165 - DNA, 596 bp, Homo sapiens
  misc_feature: GYAE6OF02IA4H5.46.67.G01.1.454.CMB.1.raw
  modified_base (208)..(208): a, c, t, g, unknown or other
  misc_feature (208)..(208): n is a, c, g, or t
  modified_base (245)..(245): a, c, t, g, unknown or other
  misc_feature (245)..(245): n is a, c, g, or t
  modified_base (286)..(286): a, c, t, g, unknown or other
  misc_feature (286)..(286): n is a, c, g, or t
  modified_base (303)..(303): a, c, t, g, unknown or other
  misc_feature (303)..(303): n is a, c, g, or t
  modified_base (332)..(332): a, c, t, g, unknown or other
  misc_feature (332)..(332): n is a, c, g, or t
  modified_base (358)..(358): a, c, t, g, unknown or other
  misc_feature (358)..(358): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgagggccttcggagaccctgtccctcacctgcgctgtctctggtgcctccatcagtagtgtttctctggggctgggtccgnagctccgagggagggctggaatcattggaagtgtctntcagtagtggaggttcctattacaggttcctctctcaaagngtcgagtcaccatatcnctgaccacgtccagcaatcagttttcccngaatatgagttctgtgaccgccgtcngacacgggtctttaatcgtgttcgacgtagagaacggcgtattatgtattttggtagtcggttaatttggaactacctagtactcggtacggggctcgtaaccccgtggggcccaggggtactaccgtggtcctaacgtcctccttaaggcccttacaccggaaacggtccccgtaatcccggttccttcccccgttcgggacccaaccccgttcccgtaccgtaccgtaaggccccc

SEQ ID NO: 141166 - DNA, 531 bp, Homo sapiens
  misc_feature: GYAE6OF02GZKFB.46.67.G01.1.454.CMB.1.raw
  modified_base (498)..(498): a, c, t, g, unknown or other
  misc_feature (498)..(498): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactattaattgtatcaacatagacagggacggcccctaagctcctaatctatgctgcatccagtttgcaaagtgggtcccatcgaggttcagtggcagtgatcgtggacagtattcactctcaccatacagtaactctgcaacgtgaagtatttacgactaacttattacttgtactaactagtaattactaattcgtttacggaccgtaagggtacacgaactaacgtaaacttaaacgtaactgtaggactgactacatcttntcttactacttcctcccgtacctactctagtac

SEQ ID NO: 141167 - DNA, 794 bp, Homo sapiens
  misc_feature: GYAE6OF02IK730.46.67.G01.1.454.CMB.1.raw
  modified_base (209)..(209): a, c, t, g, unknown or other
  misc_feature (209)..(209): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctcatcagtagtggttcttcgtggggctggggtccgnagctcccgagggagggctaggaatcgagttggaatgtctctacagtagtggtacgttctattacacgtccgtctcgtacaaggtagtcgagttaccacctatactcctcgtacggacacgtacacgactaaattcctacggttttcccgagtaacgtgtacgtacgttcgtacggttacggaacccgtccgtacggtacggtaaccggtaaccggggtttactttttaacgttaccgttaggtcgggtaacgtaaggtaacggtaccgggtaacgtttaagtttacggtaggtttaagtttttaggggtacggttacgggttttaacgtttaccgaaccgttaacccgttaaggtaccggttaccggggaccggggtccttaccgggtacccggttagggggtacccgaaaggggttaacttaccggtagggtttacccgtacggttaccctacggttaccgtcccttacccggaacccggtaaaccggggtcccctaacggtttccccggttaccccgtttccccggttaccggaccccgttaccccgttaacccggtacccgtaaccgggaccgttaccccgg

SEQ ID NO: 141168 - DNA, 965 bp, Homo sapiens
  misc_feature: GYAE6OF02F5BO9.46.67.G01.1.454.CMB.1.raw
  modified_base (93)..(93): a, c, t, g, unknown or other
  misc_feature (93)..(93): n is a, c, g, or t
  modified_base (184)..(184): a, c, t, g, unknown or other
  misc_feature (184)..(184): n is a, c, g, or t
tcagactagcagtacacgaccggtgctcgatttagagtatacatattgggtttgggagtctcggtcaggacacagcatggacatgaggtcccntcagctcctgggctcctgctactctaggctcgagtgccagatgtgacatcgagctggacccagtctcatcctcctgtctgcaaccgtgganacagtcgtcaccagtccaacttcggccgggtacaaggtcggaaactgttgacctaccttatttaaacgtggtaactcgaactagtacgtaccgagggtaccggtccccttaaaggccttaccgtaagttccgtaagttcggaccttaggaccgtactccgtaaggtttacgacgtaaacggtcgggttacccaagttccggtaaggtttccaacgggttcggaccgtaaggttacggtaacttcgttacggggaacctaacggttactttccgaagttccgtaccgtaaccgtaattaccgaaggttaactcgtacggtacgtaaccggtagtaacgtacgtttacgacgttaacgtacgttacgttacgtacgtaacgtacgtaacgttacgtacgttacggtttaccggaaccgtaagccccccggggggttttttaaaaaaccggttaacccgggttttaaaaccccggggtttaaaaacccgggttttaaaacccggggtttaaacccccggggttttaaaccggggttttaaccccggggtttaaaccccgggttttaaaccccggggtttaaaccccgggtttaaaaccccggggtttaacccgggttttaaaccccggggtttaaacccgggtttttaaaccccgggttttaaacccgggttttaaaccccgggttttaaccccgggttttaaacccccggggttaaaccccgggttttaaaccccgggtttaaccccggggtttaaaccccgggtttttaaaacccccggggg

SEQ ID NO: 141169 - DNA, 562 bp, Homo sapiens
  misc_feature: GYAE6OF02HAJIY.46.67.G01.1.454.CMB.1.raw
  modified_base (339)..(339): a, c, t, g, unknown or other
  misc_feature (339)..(339): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgaggggaagggctgggaatacagttggaagtgtctctcatagtggaggttcctattacagtccgtctctcaagagtcgagtcaccatatctctggacacgtccagcaatctacgttttcccngaagatgagttctgtgaccgccgctgacgacgggtcgtttattactgtgcgagagcggctatagtgtagttttgagttgttattcgtacacctagtacgtcggacgggctcgacccgtgggccgagggtactacgtcgtcaccgtctccgttacgcctccgaccgaacgggtcccaagtccgtccttccccgtcggaccctacccctcctccgacgctacccg

SEQ ID NO: 141170 - DNA, 554 bp, Homo sapiens
  misc_feature: GYAE6OF02GCOUW.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacgcccctaagctcctaatctatgctgcatccagtttgcaaagtgggtcccatcgaggttcagtggcagtggatcgtgggacagatttcactctcaccatacagtactctgacaacgtgaagtattttgactaacttattactagtacaacagtaattactaattgtttacggaccgaagggtacaacgtaacttaactaaaacttaaacgaacttagtagtcgtagtccgtaacctacttactacgttccttactacttccttaccccgtacctacttacctataacc

SEQ ID NO: 141171 - DNA, 717 bp, Homo sapiens
  misc_feature: GYAE6OF02GHV3Z.46.67.G01.1.454.CMB.1.raw
  modified_base (193)..(193): a, c, t, g, unknown or other
  misc_feature (193)..(193): n is a, c, g, or t
  modified_base (253)..(253): a, c, t, g, unknown or other
  misc_feature (253)..(253): n is a, c, g, or t
tcagactagcagtacacgaccggtgctcgatttagagtatacatattgggtttggggagtctcggtcaggacacagcatggacatgaggtccccgctcagctcctggggctcctgctactctggctccgagtgccagatgtgacatcgagctgacccagtctccatcctccctgtcctagccaaccgtggganacgagtgtcaccatcacttgccgggacaagtcggaacattgacaccttattaaatgtatnaacatagaccaggacgcccctaagctaccgtatctactgctagctatcccagtttcgactaagtcgggtcccaagtccggtaaggtttcgaagttggccaaggttcggacttcgtcggggaactagtactttacaccgttactaccaaccctagtacacggttaaactacttgacgtaaaccgttacggtaaggtaaccgtttttgaaccctaacctttaagtttaccgtaagttactaaaacccgtacgtaaaattttaacgtaaactttacggttttaccggaaccgttaaaccggggtaacctaaaccggtaaccttaaacgtaaaaaaccgtttaaaaccgtaaaccgttagggttaaccgggtaccttaacggaccttaaaacccggtcttaaccggttagttacccgtttaacttaactttcccggtacccccttacaacgttttccccgagttaacc

SEQ ID NO: 141172 - DNA, 535 bp, Homo sapiens
  misc_feature: GYAE6OF02IDQVB.46.67.G01.1.454.CMB.1.raw
  modified_base (481)..(481): a, c, t, g, unknown or other
  misc_feature (481)..(481): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcactccagtttgacaaagtggggtcccatcgaggttcagtggcagtggatcgtgggacagatttcactctcaccatcagtatctgcaacgtgaagtatttagactaacttattactgtacaactagtaattactaattcgtttacggacctaagggacacgtaactaactaaattaaacgaactagngtactacacactacttcgtgtctttacacttccgttccccgcctacttctgtac

SEQ ID NO: 141173 - DNA, 538 bp, Homo sapiens
  misc_feature: GYAE6OF02GF33M.46.67.G01.1.454.CMB.1.raw
  modified_base (347)..(347): a, c, t, g, unknown or other
  misc_feature (347)..(347): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaaggtcggaacattgacacctatttaaattggtatcaacatagaccagggacggcccctaagctcctaatctatgctgcatccagtttgcaaagtggggtacccagtcgaggttcagtgctgtggatcgngggacagatttcactctcacctatcagtaatctgcaacgtgaagtattttgactaacttatactgtacacagtaacttactaattcgtttacggaccgtaagggacaacgtactaaactaaattaaacgaatgtagcgtagactacctatcgtgttcttactacttccgttaccctactacttacgtgtac

SEQ ID NO: 141174 - DNA, 584 bp, Homo sapiens
  misc_feature: GYAE6OF02J18WC.46.67.G01.1.454.CMB.1.raw
  modified_base (193)..(193): a, c, t, g, unknown or other
  misc_feature (193)..(193): n is a, c, g, or t
  modified_base (218)..(218): a, c, t, g, unknown or other
  misc_feature (218)..(218): n is a, c, g, or t
  modified_base (229)..(229): a, c, t, g, unknown or other
  misc_feature (229)..(229): n is a, c, g, or t
  modified_base (406)..(406): a, c, t, g, unknown or other
  misc_feature (406)..(406): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgtcaccatcacttgccgggnaagtcggaacnttgactacctattttaaactggtatcaacatagaccagggaccgcccctaagctacctaatctatgctgcatccagtttgactaaaggtcgggtacccagtcggtaggttcaggtggcagtggatcgtagggactagtattcactcacaccatcagtaatcgtagcaacgtgaagtntttacgactaaacttattactgtactaacagtaaacttacatttacggtttacgaccgtaagggacctaacgtaaccttaaataaacttaaacgacttacggtaggtacctaggtaccaaccgtataccgttacgttccttactaccttccttacccggtcctacttccgtataaccg

SEQ ID NO: 141175 - DNA, 878 bp, Homo sapiens
  misc_feature: GYAE6OF02FHFFY.46.67.G01.1.454.CMB.1.raw
  modified_base (191)..(191): a, c, t, g, unknown or other
  misc_feature (191)..(191): n is a, c, g, or t
tcagactagcagtacacgaccggtgctcgatttagagtatacatattgggtttggggagtctcggtcaggacacagcatggacatgagggtcccgctcagctcctggggctcctgctactctggctccgaggtgccagatgtgacatcgagctgacccagtctccatcctccctgtctgcaaccgtggganacagtgtcaccatccacgttggcccgggacaacggtcggaacagtttcgaccaccctttaattttaaaacgttggttaactaccaaactattaacggaacccgaagggggtaacccggaccccccttaaaggtcccttacccttaaacttaccttaagtcggccttacgcctaacgttccctaaggttttacggaccgtaaaaagggttcgggggttacccctaagttccgggtaagggttttaccgaagggtttcgggaccgtaagggttacggggtaactttccggttagggggaaacctaaggttaactttttaccgaacctttaccgtacccaacccgtaattaccgtaaacggtttaaacttccgtacggtaccgtaaacggttacggtaaagttaacgtttttacggaaccttaaacttttaactttaaccgttacggttaacctaaacgtaaacgtaaacttttaaacctaaagttttacggtttttaacccgggaaccggtaaacggggtaaccctaaaccggttaaaccttaaaaccgtaaaaacgtttaaaaccggtaaacgttacggttacgggtactacggtacccgtaaacccgtacttaccgttacgtttaccctttacgttaacctttccccgtttaacccccgtacctaaccgttaccgttagttaacccg

SEQ ID NO: 141176 - DNA, 579 bp, Homo sapiens
  misc_feature: GYAE6OF02FP3E7.46.67.G01.1.454.CMB.1.raw
  modified_base (330)..(330): a, c, t, g, unknown or other
  misc_feature (330)..(330): n is a, c, g, or t
  modified_base (354)..(354): a, c, t, g, unknown or other
  misc_feature (354)..(354): n is a, c, g, or t
  modified_base (376)..(376): a, c, t, g, unknown or other
  misc_feature (376)..(376): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggcctttcggagaccctgtccctcacctgcgctgtctctggtgcctccatcagtagtggtttcttcgtggggctgggtccgcagctccgagggaaggggctggaatacattggaagtgtctctcatagtggaggttcctattacagttccgtctctcaagngtcgagtcaccatatctctggacncgtccagcaatctattttcccngaagatcgagtttctgtcgaccgccgctgacgacgggtcgttttatacgttgtcgcgagagacgtctattagtgtatttttggagtttggtttactttcgaactacccgtagacgttcggacggggtcctaccggtaccccgtggggacccaggggtaacttacgtcggtaccgtacccgttccgttccttacgccctacccg

SEQ ID NO: 141177 - DNA, 551 bp, Homo sapiens
  misc_feature: GYAE6OF02HAY57.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatgtatcaacatagaccaggacggcccctaagctcctaatctatgctgcatccagtttgcaaagtgggtcccatcgaggttcagtggcagtggatcgtgggacagattcactctcaccatcagtatctgacaagtgaagtatttagactaacttattactgtacaacagtaattactaagttgttttacggacctaagggactaacgtaacttaactaaaagtttaaacgaaacttagtacgtactagaccgtaacctaatccgttgttacttctacttcccttacccgtacctacttctagtaaccg

SEQ ID NO: 141178 - DNA, 588 bp, Homo sapiens
  misc_feature: GYAE6OF02II8KR.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatgtatcaacatagaccgagggaccggacccctaagctacctaatctatgctgcatcctagtttcgacaaacggtcgggtacccagtacgtaggtttcaggtggactaggtggtatcgtgggactagtactttcactctcacatcagtatctagctaacgtgtaagtatttagactaactttattaactgttaacaaactaagtaaacttactaagtttcggtttaccggaccgtaaagggactaacggtaacttaaacgtaaaattaaacgaagtacgtaggactacggaccacctaactcgttagttccttactacttccgttcccacctacgttctagtacg

SEQ ID NO: 141179 - DNA, 515 bp, Homo sapiens
  misc_feature: GYAE6OF02H1CNU.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatcgtgggacagtactttcactctacacatcagtaatctgactaacgtgaagtatttagctaacttattactgtacaacagtaattacaattgtttacgactaagggacacgactaactaaataaacgatagtgtctgacactatctgtcttcacttccttcccgctactctgtac

SEQ ID NO: 141180 - DNA, 548 bp, Homo sapiens
  misc_feature: GYAE6OF02G11V1.46.67.G01.1.454.CMB.1.raw
  modified_base (192)..(192): a, c, t, g, unknown or other
  misc_feature (192)..(192): n is a, c, g, or t
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggnaagtcggaacattgacacctatttaatggtatcaacatagaccaggacgcccctaagctcctaatctatgctgcatccagtttgacaaggtcgggtcccagtcgaggttcagtgcaggtgatcgtgggacagtatttcactctacacatcagtaatctgacaagtgaagtatttagactaacttattactgtacaactaagtaattactaagttcgttttacggaccgtaagggtactaacgtaacttaaactaaaacttaaacgaactagtagctacgacctaactattcgtcgttacttactacttccgttcccacctactctagtaac

SEQ ID NO: 141181 - DNA, 626 bp, Homo sapiens
  misc_feature: GYAE6OF02HXLIT.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactattaaatgtatcaacatagaccaggcggacccctaagctcctaatctaatgctgctactccagtttgactaaaggtcggggtcccaagtcgtaggttcaggtggacgagtggatcgtagggacaggtatttcacgtctcactatacaagtaatctgactaacggtgaagtatttgactaacgtttattaactgttacaaactagtaaattaactaaattcggttttacggaccgtaaagggacctaacggaacttaaactaaaacttaaaacgaaaccttaggtacgggtacttagaccgtaaccctaaagttcccgttacggttacccttttaacgaccgttttaccccgtttacccccggacccgttaacttaccctaggttaaaccg

SEQ ID NO: 141182 - DNA, 560 bp, Homo sapiens
  misc_feature: GYAE6OF02IGLAT.46.67.G01.1.454.CMB.1.raw
  modified_base (332)..(332): a, c, t, g, unknown or other
  misc_feature (332)..(332): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctccagggaggggctggaatacattggaagtgtctctcatagtggaggttcctattacagtccgtctctcaagagtcgagtcaccatatctctggacacgtccagcaatcagttttcccngaagatgagttctgtcgaccgccgctcgacgacgggtcgttttattactgtgcgagagacggctattatgtattttggagttggttatttcgactacctagagtcggacggggtctcggaccccgtggggacccagggaactacgtgtcaccgtctccttacgcctccaccgaacgggccctagtccggttcccttccccgtgccctacccctcctcacgtcgtcccg

SEQ ID NO: 141183 - DNA, 545 bp, Homo sapiens
  misc_feature: GYAE6OF02F20WZ.46.67.G01.1.454.CMB.1.raw
  modified_base (334)..(334): a, c, t, g, unknown or other
  misc_feature (334)..(334): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttcccngaagatgagttctgtgaccgccgctgacacgggtcgtttattactgtgcgagagacggctattatgtagttttggagttggttattcgtacacctagatcgacgggctcgcccgtgggccgagggatacgtgtccacgtctccttcgcctccaccgaacggccctagtccggtccttccccgtcggcctacccctcctccacgcgtacccg

SEQ ID NO: 141184 - DNA, 679 bp, Homo sapiens
  misc_feature: GYAE6OF02JHWNJ.46.67.G01.1.454.CMB.1.raw
  modified_base (149)..(149): a, c, t, g, unknown or other
  misc_feature (149)..(149): n is a, c, g, or t
  modified_base (219)..(219): a, c, t, g, unknown or other
  misc_feature (219)..(219): n is a, c, g, or t
  modified_base (242)..(242): a, c, t, g, unknown or other
  misc_feature (242)..(242): n is a, c, g, or t
  modified_base (417)..(417): a, c, t, g, unknown or other
  misc_feature (417)..(417): n is a, c, g, or t
tcagactagcagtacacgaccggtgctcgatttagagtatacatattgggtttggggaccgtcctgtgcaagaacatgaagcacctgtggtttgtcctcctgctggtggcagctcccagatgggtcctgtccctggtgcaactgcaggngtcgggcccacgactggtgaggcctttcgggagaccccgtgtcccctcaccgtgccgctgtctctggtcncctcatcagttagtgtttctcgnggggctgggtccgcagcctcccgaggaggtgctggaatacatggaagtgtctctcatagtggaggttcctaatttacgagttcccgtacgtcttcgaaacggtagtccgaaggttcctaaccattaatccgtcttgggacctacggtcccaggctaaacgtctaacgttttcccngtaaagactgtagttctagtcgtaaccgccgtcgtcgacgacgggtccgtttagttacgttaggttcgtacgagtagtacggtctaagtttagtagtacgttttttaggagtttagggttacttttcggtactaacccgttagtacgttccgggtaaccggggccgttaccggtacccccggttaggggtacccgaacggggttaacgtaccggtttacggtacccggttaaccggttccgttcccggttaacggttccccg

SEQ ID NO: 141185 - DNA, 532 bp, Homo sapiens
  misc_feature: GYAE6OF02I4AD7.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccgatcacttgccgggcaagtcggaacattgacacctatttaaattggtatcaacatagaccagggacgcccctaagctcctaatctatgctgcatccagtttgcaaagtgggtccatcgaggttcagtgcagtgatctggacagatttcatctcaccatcagtaatctagcaacgtgaagtatttgactaacttattaactgtacaacagtaacttacaattgtttacggacctaagggtacaacgaacttaacaaacttaaacgaaacttgtaggactagactaactattctagtcgttacagttccttaccgcctattcctagtaacg

SEQ ID NO: 141186 - DNA, 599 bp, Homo sapiens
  misc_feature: GYAE6OF02F7AGA.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctcctaatctatgctgcatccagtttgcgaaagtgggtcccagtcgaggttcagtggcagtggatcgtgggacagtatttcactctcacctatcagtaactctgacaacgtagaagtattttgactaacttattactgtactaaacaagtaactttaactaaagttcgttttaccggaccgtaaacgggtaccaacgtaacctaaacgtaaaacttaaaccgaaacgttacggttacggtactacgaccgtaacctaacttaccgtacgttacctttaccgtacttcccgttaccccgtaccctacgttacctagttaaccg

SEQ ID NO: 141187 - DNA, 636 bp, Homo sapiens
  misc_feature: GYAE6OF02I16VZ.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagacaggacgcccctaagctcaatctatgctgcatcctagtttgcgtaaagtgggtcccatcgaggttcagtgcagtggatcgtgggacagtatttacactcgtacaccgtatcgtaagtaactcgtagacgtaacgttagaaagtagtttttagacctaactttattacgttagtacgtaacgtaacgtaaactttaacaagtttacgttttaccggtaaccgtaaacgggtaccgaacggtaaccttaaacgtaaaacgttaaaaccggaaacttacggtacggtacttacgggtacctaacccgtacgtaccgttaggttacccttaccgttacgttaccccgtttacccggaccttaaccgttccgtaggttaacc

SEQ ID NO: 141188 - DNA, 583 bp, Homo sapiens
  misc_feature: GYAE6OF02G8TFH.46.67.G01.1.454.CMB.1.raw
  modified_base (336)..(336): a, c, t, g, unknown or other
  misc_feature (336)..(336): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccagggaaggggctggaatacattggaagtgtctctcatagtggaggttcctattacagtccgtctctcaagagtcgagtcaccatatctctggacacgtccagcaatctagttttcccngaagatgtagttctgtcgacccgcgctgacgacgggtcgtttatactgtgcgagagacgctattatgtagttttggagttgttattcgtactaccctagtactcggacggggctccgacccgtcgggaccgagggagtacgtcgtcgaccgtcgtccttacgtccgtaccacccgaacgggccctacgttcccggtcccgtttcccccgtcggtcccctacccgtcccctacccgacgacgtacccg

SEQ ID NO: 141189 - DNA, 623 bp, Homo sapiens
  misc_feature: GYAE6OF02JEU67.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtgggagacagtgtcaccatcacttgccgggcaagtcggaacattgacacctatttaaatggtatcaacatagaccagggacgcccctaagctcctaatctatgctgcatccagtttgctaaagtgggtcccatcgaggttcagtgcagtgatcgtgggacagtatttcactctcaccatcagtaactctagcaacgtgaagtatttgactaacttattactagtacaactaagtaattaactaagttcgttttacggacccgtaaagggtacctaaccggtaacttaaacgtaaaacgtttaaaaccggtaaacgttacgggttacggtaccgttacggacccgtaaccctaacgtttccttaacggtttaccctttaccgtaaccgttcccgttttaacccccggtacccgtacctttacccgttacgttaaacccg

SEQ ID NO: 141190 - DNA, 540 bp, Homo sapiens
  misc_feature: GYAE6OF02GPCAF.46.67.G01.1.454.CMB.1.raw
  modified_base (211)..(211): a, c, t, g, unknown or other
  misc_feature (211)..(211): n is a, c, g, or t
  modified_base (249)..(249): a, c, t, g, unknown or other
  misc_feature (249)..(249): n is a, c, g, or t
  modified_base (374)..(374): a, c, t, g, unknown or other
  misc_feature (374)..(374): n is a, c, g, or t
  modified_base (379)..(379): a, c, t, g, unknown or other
  misc_feature (379)..(379): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttctcgtggggctgggtccgnagctcccgagggaaggggctggaatacattggaagtgtctctcatagtggaggttcctattacagtccgtctctcaagagtcgagtcaccatatctctggacacgtccagcaatcagttttcccngaagntgagtttctgtgaccgcgctgacacgggtcgtttattactgttgcgagagacggtctattatgtatttttggagttggttatttcgactacctagatcggacggggtctccggacccgtgggccagggactacgtggtcaccgtctccttagccctacccg

SEQ ID NO: 141191 - DNA, 555 bp, Homo sapiens
  misc_feature: GYAE6OF02G6SGZ.46.67.G01.1.454.CMB.1.raw
  modified_base (339)..(339): a, c, t, g, unknown or other
  misc_feature (339)..(339): n is a, c, g, or t
  modified_base (498)..(498): a, c, t, g, unknown or other
  misc_feature (498)..(498): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagcctccgaggggaaggggctggaatacagttggaagtgtctctcatagtggaggttcctattacagtccgtctctcaagagtcgagtcaccatatctctggacacgtccagcaatctagttttcccngaagatgtagttctgtcgaccgcgctgacgacgggtctttaattctgtgcgagagacggcttattatgttagttttggagttgtttacttcgactacctagatcggacggggctccgacccgtgggccgagggaactacgtcgtccacgtcctcgtacncctccacgacggccctagtccgtccctcccgtcgcctaccctcctaccacgctcccg

SEQ ID NO: 141192 - DNA, 548 bp, Homo sapiens
  misc_feature: GYAE6OF02GWJ6R.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagacagggacgcccctaagctctaatctatgctgcatccagtttgactaaagtcgggtcccagtcgaggttcagtggcagtgatgtgggacagtattcactctacacatcagtatctgacaacgtgaagtatttgactaacttatttaactgtacaacagtaatactaattcgtttacgacgtaacgggacaacgtaactaacaaattaaacgaacgtgtgtactacggacctaactagttccttgttacctttcctaacttcccgttaccccgaccttacttctagtacc

SEQ ID NO: 141193 - DNA, 531 bp, Homo sapiens
  misc_feature: GYAE6OF02IFAUX.46.67.G01.1.454.CMB.1.raw
  modified_base (333)..(333): a, c, t, g, unknown or other
  misc_feature (333)..(333): n is a, c, g, or t
  modified_base (373)..(373): a, c, t, g, unknown or other
  misc_feature (373)..(373): n is a, c, g, or t
  modified_base (406)..(406): a, c, t, g, unknown or other
  misc_feature (406)..(406): n is a, c, g, or t
  modified_base (412)..(412): a, c, t, g, unknown or other
  misc_feature (412)..(412): n is a, c, g, or t
  modified_base (421)..(421): a, c, t, g, unknown or other
  misc_feature (421)..(421): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaatggtatcaacatagaccagggacgcccctaagctcctaatctatgctgcatccagtttgacaaagtggggtcccatcgaggttcagtggcngtgatcgtggacagatttcactctcaccatcataactctnacaacgtgaattatttgactaactttattactntacaanagtaattanaattgtttacggacgaaggacacgtaactaacaaattaaacgaacttgtacgtctacgactaaccattctcgttccttactacttccttaccccgccttatcctagtaac

SEQ ID NO: 141194 - DNA, 557 bp, Homo sapiens
  misc_feature: GYAE6OF02HF2RD.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcgaacattgacacctatttaaattggtatcaacatagaccaggacggcccctaagctcctaatctatgctgcatccagtttgcaaagtgggtccatcgagttcagtgcagtgatcgtggacagattcactctcacatcagtaatctgacaacgtgaagtattttgactaacttattaactgtacaacagtaaattaacaattcgtttacggaccgtaaggacaacgtaactaaactaaaagttaaaacgaacttagtaggacttagacctaaccacttactacggttacctttacaactttcccgttccccgtaccctacgttaccgttagtaacg

SEQ ID NO: 141195 - DNA, 528 bp, Homo sapiens
  misc_feature: GYAE6OF02IYOEK.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctcctaatctatgctgcatccagtttgcaaagtgggtcccatcgaggttcagtgcagtgatcgtgggacagattcactctcacctatcagtaatctgacaacgtgaagtattttgactaacttattactgtacaacagtaacttaacaagttgtttacgacgtaagggacaacgtaactaactaaataaacgaatagtagctagccaactattctgttccttacgacttcctacccgactactctagtaac

SEQ ID NO: 141196 - DNA, 711 bp, Homo sapiens
  misc_feature: GYAE6OF02HOD6X.46.67.G01.1.454.CMB.1.raw
tcagactagcagtacacgaccggtgctcgatttagagtatacatattgggtttggggagtctcggtcaggacacagcatggacatgagggtccccgctcagctccgtggggctcctgctactctggctccggaggtgccagatgtgacatcgagctgacccagtctccatccgtccctgtctgctaaccggtgggagacgagtcgtaccaccgagtccacgttggaccgggactaacggttccggaaactagttcggacctaaccttaattttaaaagttggtaactactaaactaagttaacggaaccgaaggggacccgtacccctaaaggtccttacctaataccgtaatcgactgacgtacttccgtagtttcgacgtaaacggtccgggtaccagttacggtaggttacgaggtcgactaggtagtattcggtagggactaagttactttacacgttcgtaccgacctatacctaagtaatcgtagactaacgtataagttattcgacttaattattactacgtacaagtaagttaactaacgtagtttacggttaccgaacgtaagggtaacctaacggtaacttaaactaaaacgttaaacgaacgttaggtacgactacggacctaaccgttacttaccgttacgtttacgttaacttaccgttcccggttaacccgtaccctacgtttccgtaagttaaccg

SEQ ID NO: 141197 - DNA, 595 bp, Homo sapiens
  misc_feature: GYAE6OF02I1RTX.46.67.G01.1.454.CMB.1.raw
  modified_base (212)..(212): a, c, t, g, unknown or other
  misc_feature (212)..(212): n is a, c, g, or t
  modified_base (246)..(246): a, c, t, g, unknown or other
  misc_feature (246)..(246): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtcncctccatcagtagtgttctctggggctggtccgnagctccgaggagggctggaatacagttggaagtgtctctcatagtggaggttcctattacaggttccgtctctcaagacgtcgagtcacctatatctcgtggacctaccgtccagactaatctacgttttcccaggaaacgtacttgtacgttctggtcgaccggccgtcgtcgacgacgggttcgttttactacgttggtgcgtagacgacggtctagttatgttagttttggagtttggttagtttcgacctacccttagacgtcggtacggggtcgtaccggtacccggttggggaccgtagggtaacttacgtcggtcgtaccgtcctccgttacgccctacccg

SEQ ID NO: 141198 - DNA, 703 bp, Homo sapiens
  misc_feature: GYAE6OF02G3PD6.46.67.G01.1.454.CMB.1.raw
  modified_base (420)..(420): a, c, t, g, unknown or other
  misc_feature (420)..(420): n is a, c, g, or t
tcagactagcagtacacgaccggtgctcgatttagagtatacatattgggtttgggggagtctcggtcaggacacagcatggacatgagggtccccgcctcagctcctggggctcctgctactctggctccgaggtgccagatgtgacatcgagctgacccagtcctcactccctcctgtctcgaccaaccggtgggagactagtcgtaccaccatctacttcggcccgggacaaggtaccggaactagttcgaacctaccttaatttaagttgtactacaactagtacgaccgagggacccgacccctaagccttacctaatctagtcgctcgactactccgtaggtttcgaacgtaagggttccggggtaccctagtccggtaggttcgagggtcggacgtaggtacggattccgggngggaactagttactttccaacttcctaccacgtatacgtaaagtacttcgtagaacctaaggtaagtaattagtttacaactttaactttacttacgtcgtaacctaaacgtaagttaaaccttaacgtaagttttccgggtttaccggaaaccgtaacgggtaacctaacgtaacctaaattaaaacggttaaacgtacgtagtacgtacgtacgaccgtaacctagttccgtactttaccttacgtacctttcccgtacccgtactcgttacgtagtaacc

SEQ ID NO: 141199 - DNA, 567 bp, Homo sapiens
  misc_feature: GYAE6OF02GFQ2M.46.67.G01.1.454.CMB.1.raw
  modified_base (345)..(345): a, c, t, g, unknown or other
  misc_feature (345)..(345): n is a, c, g, or t
  modified_base (375)..(375): a, c, t, g, unknown or other
  misc_feature (375)..(375): n is a, c, g, or t
  modified_base (379)..(379): a, c, t, g, unknown or other
  misc_feature (379)..(379): n is a, c, g, or t
  modified_base (436)..(436): a, c, t, g, unknown or other
  misc_feature (436)..(436): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccggcagctccgagggaggggctggaatacattggaagtgtctctcatagtggaggttcctattacagtccgtctctcaagagtcgagtcaccatatctntggacacgtccagcaatctacgttttcccngaanatgtattctgtcgccgcgctgacgtacgggtctttactacgtgtgcgagagacggtnttattagtgttattttggagttggttatttccgactaccgtagtacgtcggacggggtctcccggtacccggtcggggaccaagggtaactcggtcggtccgtacccgttcctccgttacgtccctacccg

SEQ ID NO: 141200 - DNA, 652 bp, Homo sapiens
  misc_feature: GYAE6OF02I7ITM.46.67.G01.1.454.CMB.1.raw
  modified_base (390)..(390): a, c, t, g, unknown or other
  misc_feature (390)..(390): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagcctcccgaggggaaggggctaggaatacgattggaagtgtctctacatagtggaggttcctattacagtccgtctctacaagtatcgagtcaccatatctctgacacgtcagacaatctacgttttccaggaatacgtgtagttcgtgtacgaccgtccgatacggacgtacgggtntttacttacgtgtcggacgaagacggacgtcttaagttagtagttagttttaggagttaggtttactttcgaactacccgttagacgtaccggtcggggtacctacccggtacccggtacgggccgtaaacgggtaattaccggtagtaccgttaccgtaccgttccgttaccgccctacccgtaaccgaacccgggtaccctaggttcccggttacccgtttcccccgcggccctacccctccgtacccaacgcgtacccg

SEQ ID NO: 141201 - DNA, 603 bp, Homo sapiens
  misc_feature: GYAE6OF02I6B5Z.46.67.G01.1.454.CMB.1.raw
  modified_base (279)..(279): a, c, t, g, unknown or other
  misc_feature (279)..(279): n is a, c, g, or t
  modified_base (333)..(333): a, c, t, g, unknown or other
  misc_feature (333)..(333): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgagggagggctggaatacattggaagtgtctctcatagtggaggttcctattacagtccgtntctcaagagtcgagtcaccatatctctggacacgtccagcaatctagtttcccngaacgatgtagttctgtcgaccgccgctgacgtacgggtctttattacgtgtcgacgagacgacggtactattagtgttagtttttaggagttggtttacgttcgaactacccgtagtacgtcggacgggcgttaccggacccgtggggaccgaagggtaactacgtacggtccgtaccgttccgttaccgttacgtccctccgaaccgtaccggtacccacgtcccggtccttccccgtcgcccgtaccctcctaccgacgcgtacccg

SEQ ID NO: 141202 - DNA, 573 bp, Homo sapiens
  misc_feature: GYAE6OF02I9KKI.46.67.G01.1.454.CMB.1.raw
  modified_base (430)..(430): a, c, t, g, unknown or other
  misc_feature (430)..(430): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaattggtatcaacatagaccagggacggcccctaagctctaatctatgctgcatccagtttgacaaggtcggggtacccagtcggtaggttcagtggcagtggatcgtgggacaggtactttcacttctcgaccatcagtaactctagacaacgtgtaagtatttgactacttatacttgtacactaanaattactaattcgtttacgccgtaaaggacaaccgtactaaactaaacttaaacgaacgttagtcggtactacgaccgtaacctattaccgttacgtactttaccctactttcccgttaccccgacctacttacgtcgtaacg

SEQ ID NO: 141203 - DNA, 632 bp, Homo sapiens
  misc_feature: GYAE6OF02IRJTJ.46.67.G01.1.454.CMB.1.raw
  modified_base (192)..(192): a, c, t, g, unknown or other
  misc_feature (192)..(192): n is a, c, g, or t
  modified_base (606)..(606): a, c, t, g, unknown or other
  misc_feature (606)..(606): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacacttatttaaagtggtatcaacatagacaggacgcccctaagctcctaatctatgctgcatcctagtttgctaaagtcgggtaccattcggagttcgagtggactaggtggatcgtaggggacaggtactttccgactcgtctaaccactacgtagtaactcttagactaagtagtaacgttattttgactaacgttttaatacgttcgtacgtaaacagttaattaactaactttgtttaccgggaccctaaagggtaccaaccggtaacctttaaacgtaaaattaaaaccggtaactaggttacggaccttaggtacccaaccgtaacttccgttaaacgtcctttaccgtacttaccccggtttacccncccttaacgtttactacggttaaccg

SEQ ID NO: 141204 - DNA, 554 bp, Homo sapiens
  misc_feature: GYAE6OF02JHIXA.46.67.G01.1.454.CMB.1.raw
  modified_base (211)..(211): a, c, t, g, unknown or other
  misc_feature (211)..(211): n is a, c, g, or t
  modified_base (374)..(374): a, c, t, g, unknown or other
  misc_feature (374)..(374): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttcttcgtggggctgggtccgcagcctccgagggagggctggaatacattggaagtgtctctcatagtggaggttcctatacagtccgtctctcaagagtcgagtcacatatctctgacacgtcagcaatcagttttcccagaatntgagttctgtcgaccgcgctgacgtacgggtctttattacgtgtcgcgagagacgtctattagtgtattttggagttgttatttcgactacctagacgtcggacggggctaccggtacccgtggggaccgtaagggtaactaccgtggtccgacccgttcgtcccgttacgccctacccg

SEQ ID NO: 141205 - DNA, 611 bp, Homo sapiens
  misc_feature: GYAE6OF02JPWTF.46.67.G01.1.454.CMB.1.raw
  modified_base (230)..(230): a, c, t, g, unknown or other
  misc_feature (230)..(230): n is a, c, g, or t
  modified_base (354)..(354): a, c, t, g, unknown or other
  misc_feature (354)..(354): n is a, c, g, or t
  modified_base (358)..(358): a, c, t, g, unknown or other
  misc_feature (358)..(358): n is a, c, g, or t
  modified_base (375)..(375): a, c, t, g, unknown or other
  misc_feature (375)..(375): n is a, c, g, or t
tcagactagcagtacacgaccggtgctcgatttagagtatacatattggtttggggtaggtctcggtcgaggtacacagcatggacatgaggtcccgctcagctcctggggctcctgctactctggctccgaggtgccagatgtgacatcgagctgacccagtctccatcctccctgtctgccaaccgtggagcagtgtcaccatcacttgcccgggtcaagtcggaacnttgacacctatttaacttggtatcaacatagaccagggacggacccctaagcctacctaatcttaatcgctagtcatccagtttgacaagtcgggccatcgtagtcagtgcagtgatcgagganagtnttcacttcactacactnacgtaatctagactacgtagtaagtagtttagaccgtaattacttacgttattaccgaaacgttactaaagttttaaccaactttgtttttaaccggaccgttaaagggtacgtaaccgtaaaccttaacgtaaaactttaaaccgtaaaccgtagttaccggtacttacgactaaccgttattcgtacgtttaccttagtactacgtttacccaccgtacgttacctacggtaac

SEQ ID NO: 141206 - DNA, 526 bp, Homo sapiens
  misc_feature: GYAE6OF02HKOJ2.46.67.G01.1.454.CMB.1.raw
  modified_base (343)..(343): a, c, t, g, unknown or other
  misc_feature (343)..(343): n is a, c, g, or t
  modified_base (373)..(373): a, c, t, g, unknown or other
  misc_feature (373)..(373): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccaggacgcccctaagctacctaatctatgctgcatccagtttgacaaaggtgggtcccatcgagttcagtggcagtgatcgngggacagtatttcactctcaccatcagtanctgcaacgtgaagtatttgactaacttattactgtacaacagtaattacaattgtttacgactaaggacacgactaactaaattaaacgacgtagtggactagacaactactctacgttctactacttacccttcccgtactacttctagtac

SEQ ID NO: 141207 - DNA, 631 bp, Homo sapiens
  misc_feature: GYAE6OF02I6J2Y.46.67.G01.1.454.CMB.1.raw
  modified_base (465)..(465): a, c, t, g, unknown or other
  misc_feature (465)..(465): n is a, c, g, or t
tcagactagcagtacacgaccggtgctcgatttagagtatacatattggggtttggggagtctcggtcaggacacagcatggacatgagggtccccgctcagctcctggggctcctgctactctggctcggaggtgccagatgtgacatcgagctcgacccagtctccactcctcctgtctgcaacggtggagacgtagtgtacacctatctacgttcggccgggacaacggtacggaaacattcgaactaaccttaatttaaaacgttggtaactacgaaacagtaacgaaccgacgggaaccggtacccctaagcctactaatcttaagtcgacgtcgacacgtcctagttgacgtaaacggttcgggtaccagtcggtagttcaggtcggacgtaggtagatcggagggactaagtcttcgactctacaccaatcaagtatctacgacgtaagtcgaagttnttacgactaacttatacgtagtacaagtaagtaacttagtaacgttgttaccgacgaacggtactaacgtaactaaataaacgttaactacgtagtgacgtacgtactaaccgtagttcctacgttactcgttaaccttcctcccgtatacgttacgttactaacg

SEQ ID NO: 141208 - DNA, 562 bp, Homo sapiens
  misc_feature: GYAE6OF02H18VU.46.67.G01.1.454.CMB.1.raw
  modified_base (250)..(250): a, c, t, g, unknown or other
  misc_feature (250)..(250): n is a, c, g, or t
  modified_base (327)..(327): a, c, t, g, unknown or other
  misc_feature (327)..(327): n is a, c, g, or t
  modified_base (350)..(350): a, c, t, g, unknown or other
  misc_feature (350)..(350): n is a, c, g, or t
  modified_base (374)..(374): a, c, t, g, unknown or other
  misc_feature (374)..(374): n is a, c, g, or t
  modified_base (437)..(437): a, c, t, g, unknown or other
  misc_feature (437)..(437): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtcccctcacctgccgctgtctctggtgcctccatcagtagtggtttctctggggctgggtccgnagctcccgagggaagggctggaatacatggaagtgtctctcatagtggagttcctagttacagtccgtctctcaagngtcgagtcacatatctctggacncgtcagcaatctagtttcccaganatgtattctgtcgaccgcgtctaggacgtacgggtactttattactgtacgcgagacgacgtntaagttagtgttagttttggagttgttagttcgactaccgtagacgttcggacgggtcctacggcccggtggggaccaagggtaacttcggtcggtaccaccggttctaccgtacgccctacccg

SEQ ID NO: 141209 - DNA, 554 bp, Homo sapiens
  misc_feature: GYAE6OF02HH2VW.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcgaacattgacactatttaaatgtatcaacatagacctaggacggcccctaagctcctaatctatgctgcatccagtttgacaaaggtcgggtcccagtcgaggttcagtggcaggtggatcgtgggactagtattcactctcaccatcagtaatctgacaacgtgaagtatttagactaacttattactgtacaactagtaattactaattcgtttacgaccgtaagggacacgtaactaactaaacgttaaacgaactagtagtactacgacctaacctattctcgttaccttactacttcccgttaccccgtacctacttccgtagtaac

SEQ ID NO: 141210 - DNA, 533 bp, Homo sapiens
  misc_feature: GYAE6OF02HDKWV.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacacctatttaaattggtatcaacatagaccagggacgcccctaagctcctaatctatgctgcatccagtttgctaaagtcgggtcccagtcgaggttcagtggcagtggatcgtgggacagtatttcactctcactatcagtaatctgacaacgtagaagtatttgactaacttattacttgtacaaacagtaattacaattgtttcggaccgtaagggacacgtactaactaaaattaaacgaacgttgtggtactcgcacgtatctagtccttacgtacttccttcccgctatctgtac

SEQ ID NO: 141211 - DNA, 575 bp, Homo sapiens
  misc_feature: GYAE6OF02IUV8V.46.67.G01.1.454.CMB.1.raw
  modified_base (250)..(251): a, c, t, g, unknown or other
  misc_feature (250)..(251): n is a, c, g, or t
  modified_base (329)..(329): a, c, t, g, unknown or other
  misc_feature (329)..(329): n is a, c, g, or t
  modified_base (443)..(443): a, c, t, g, unknown or other
  misc_feature (443)..(443): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactgggtgaggccttcggagaccctgtccctcacctgcgctgtctctggtgcctccatcagtagtggtttctcgtggggctgggtccgnngctcccgagggaaggggctggaatacattggaagtgtctctcatagtggaggttcctattacagtccgtctctcaagngtcgagtcacctatatctcgtgacacgtccagcaatctacgttttccctagaagtatgtagttctgtcgaccgccgctcgacgacgggtctttatacgtgtgcgagagacggtntattagtgttagttttggagttggttatttcgacctaccgtaagacgtcgggacggggtcctccggacccggtcggggaccgagggtaactacggtcggtaccgaccgttcctccgttacgccctaacccgg

SEQ ID NO: 141212 - DNA, 621 bp, Homo sapiens
  misc_feature: GYAE6OF02JL07W.46.67.G01.1.454.CMB.1.raw
  modified_base (195)..(195): a, c, t, g, unknown or other
  misc_feature (195)..(195): n is a, c, g, or t
  modified_base (231)..(231): a, c, t, g, unknown or other
  misc_feature (231)..(231): n is a, c, g, or t
tcagactagcagtacacgaccggtgctcgatttagagtatacatattgggtttggggtaggtctcggtcaggacacagcatggacatgagggtccccgctcagctcctggggctcctgctactctggctccgaggtgccagatgtgacatcgagctgacccagtctccatcctccctgtcctgcaaccggtgganacagtgtcaccatcacttgccgggcaagtcggaacnttgacacctatttaaatgtatcaacatagaccagggacgccctaagctcctaatctatgctgcatccagtttgacaagtcgggtcccatcgaggttcagtgcagtggatcgtgggacaggtatttcgaatcgtcaccgtatcaagttaactctagtactaacgtgtaaacgttagttttagactaacgttttattaacttgttaacctaacgtaagtaaactttaacctaaagtttcggttttaaccggttaccgaaacggggtaacctaaccgtaaaccgttaactaaaaactttaaaccggaaacgttagaacggtcgttaacaccgtaacgtaactcgttagtccttttaacgactttacccttacccgacctacttactacgtaac

SEQ ID NO: 141213 - DNA, 556 bp, Homo sapiens
  misc_feature: GYAE6OF02HOXJT.46.67.G01.1.454.CMB.1.raw
  modified_base (333)..(333): a, c, t, g, unknown or other
  misc_feature (333)..(333): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaagggctggaatacattggaagtgtctctcatagtggaggttcctattacagtccgtctctcaagagtcgagtcaccatatctctggacacgtccagcaatcagttttcccngaagatgagttctgtgaccgccgctgacacgggtcgtttatactgtgcgagagacggctattatgtattttggagttggttatttcgactaccctagtactcgacggggctccggaccccgtggggccagggaactacgtggtccaccgtctccttagcctccaccgaacgggcccagtccggtccttccccgtcggccacccctcctacccacgcgtacccg

SEQ ID NO: 141214 - DNA, 570 bp, Homo sapiens
  misc_feature: GYAE6OF02GLX1O.46.67.G01.1.454.CMB.1.raw
  modified_base (246)..(246): a, c, t, g, unknown or other
  misc_feature (246)..(246): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtgtttctctgggctgggtccgnagctccgagggagggctggatacattggaagtgtctctcatagtggaggttcctattacgagtccgtctctcaagagtcgagtcacatatctctggacacgtcagcaatctagttttcccagtaagtatgtagttctgtcgacccgccgctgacgacgggtctttagttactgtgcgagagacgtctattatgttagttttggagttggttactttcgactaccgtagagtcggtacggggtcctaccggtccccggtgggacccgaagggaacttcggtacggtccgtacccggttccttaccgttaccgcccgtaaccccgg

SEQ ID NO: 141215 - DNA, 510 bp, Homo sapiens
  misc_feature: GYAE6OF02H8NAO.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgcccctaagctcctaatctatgctgcatccagtttgcaaagtgggtcccatcgaggttcagtggcagtgatcgtgggacagtattcactctcaccatcagtaatctgacaacgtgaatatttgactaactttattactgtacaatagtaattacaattgtttacggaccgaagggacacggaactaactaaattaaacgaatgtagctgacacatctgtctcactcctccgactatctatac

SEQ ID NO: 141216 - DNA, 599 bp, Homo sapiens
  misc_feature: GYAE6OF02GK85Z.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattgtatcaacatagaccagggaccgcccctaagctcctaatctatgctgcatcctagtttgacaaaggtcggggtacccagtcggtaggttcaggtggcaggtggatcgtagggacagtatttcactctcacatcagtaatctgacaacgtagaagtatttagactaactttattaacttgtacaaactaagtaacttaactaagtttacggtttaccggaccgtaaaggggacctaaccgtaacttaaactaaaacgttaaacgaacgttagtacggtacgtacgacctaacctattccgttacgttacctttactacgttcccttaccccgaccttacgttacctagttaacc

SEQ ID NO: 141217 - DNA, 797 bp, Homo sapiens
  misc_feature: GYAE6OF02I30L7.46.67.G01.1.454.CMB.1.raw
  modified_base (287)..(287): a, c, t, g, unknown or other
  misc_feature (287)..(287): n is a, c, g, or t
tcagactagcagtacacgaccggtgctcgatttagagtatacatattgggtttgtcctcctgctggtggcagctcccagatgggtcctgtccctggtgcaactgcaggagtcgggcccacggactggtgaggccttcggagaccctgtccctcacctgcgctgtctctggtgcctccatcagtagtggtttcttctgggctgggtccgcagctccgagggaagggctggaatacagttggaagtgtctctcatagtggaggttcctattacagtccgtctctcaagngtcgagtcaccatatctctggacacgtccagcaaatctacgttttccccagaacgagttcggttacttcgttacggtaccggcccgtaccgtacgtaccgaccggttaccgggtttacttttaaccgttacgttcggttacggtacgaaggtaaccggttacggtaccgtttaagtttacgttaggttttacggttttagggttaacggtttacggttttaaaccgtttccggtaaacccgtttaaccggttaacgttaccgggttaccgggggtacccgggttccgttaaccccgggtaccgggtaccgggtaccggtaaacggggttaaccttacgggttaccggtacccgttacccggttaccttacccggttaccgtaccccgtacccggtaacccggtaacccggtaacccgtaccgggtttacccccgttacccccggttccccggttacggtaccccccttccggttaacccccgtaaccggtaaccggcccttaacccccgg

SEQ ID NO: 141218 - DNA, 565 bp, Homo sapiens
  misc_feature: GYAE6OF02I3U2D.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatgtatcaacatagaccagggacggcccctaagctcctaatctatgctgcatccagtttgcaaagtgggtcccatcgaggttcagtgcagtggatcgtgggacagatttcactctcacatcagtatctgcaacgtgaagtattttgactaacttattactgtacaacagtaaattacaagtttcgttttaccggactaagggtacctaacgtaacttaaacgaaaagtttaaacgaaacgttaggttacggactagtacctaacctacgttacttacgttcctttactactttaccttccccgacctacgttcctagttaac

SEQ ID NO: 141219 - DNA, 551 bp, Homo sapiens
  misc_feature: GYAE6OF02HYE6Z.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattgtatcaacatagaccagggacggcccctaagctcctaatctatgctgctatccagttttgactaaaggtcggggtacccagtccgaggttcagtggcagtggatcgtgggacagtatttcactctcaccatcagtaatctagcaacgtgaagtattttagactaactttattacttagtacaactagtaaattacaattggtttacgacgtaacggactacgtaactaactaaacttaaacgaactagtgactgacaacctatctcttacttactacttacccttcccgacctacttctagtaac

SEQ ID NO: 141220 - DNA, 560 bp, Homo sapiens
  misc_feature: GYAE6OF02HOA39.46.67.G01.1.454.CMB.1.raw
  modified_base (248)..(248): a, c, t, g, unknown or other
  misc_feature (248)..(248): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagaccctgtccctcacctgcgctgtctctggtgcctccatcagtagtggtttcttctggggctgggtccgcagctccagggagggctggaatacagttggaagtgtctntcatagtggaggttcctattacagtccgtctctcaagagtcgagtcaccatatctctgacacgtcagcaatctagtttccctagaagtatgtagttctgtcgaccgcgtctgacgacggtcgtttatacgtgtgcgagagacgctattatgttagtttggagttggttatttcgactacctagtacgtcggacgggctacgacccggtggggaccgagggaactacgtcggtccgaccgtcctccgttacgcctaccaccgacggcccacgtccggtaccttcccgtcgcccaccctcctacgacgcacccg

SEQ ID NO: 141221 - DNA, 548 bp, Homo sapiens
  misc_feature: GYAE6OF02ITB60.46.67.G01.1.454.CMB.1.raw
  modified_base (368)..(368): a, c, t, g, unknown or other
  misc_feature (368)..(368): n is a, c, g, or t
tcagactagcagtacacgaccggtgctcgatttagagtatacatattgggtttggggagtctcggtcaggacacagcatggacatgagggtccccgctcagctcctaggggctcctgctactctggctccgaggtgccagatgtgacatcgagctgacccagtctccatcctccctgtctgcaaccgtgggagacagtgtcaccatcacttgccgggcaagtcggaacattgacactattaatggtatcaacatagaccagggacgcccctaagctactaatctatgctgcatccagtttgcaaagtgggtcccatcgagttcagtgcagtgatcgtgggacagtatttcactctacacatcagtaanctgacaacgtgaagtattttgactaacttattactgtacaactataattacattgtttcggacaagggacacgaactaactaaaattaaacgaaactgtaggactacggtactaaccaattccttagttacctttaccaacgtttccctttaccccggacccttaacgttcctagtaacc

SEQ ID NO: 141222 - DNA, 505 bp, Homo sapiens
  misc_feature: GYAE6OF02FPU0F.46.67.G01.1.454.CMB.1.raw
  modified_base (408)..(408): a, c, t, g, unknown or other
  misc_feature (408)..(408): n is a, c, g, or t
  modified_base (486)..(486): a, c, t, g, unknown or other
  misc_feature (486)..(486): n is a, c, g, or t
  modified_base (502)..(502): a, c, t, g, unknown or other
  misc_feature (502)..(502): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctcctaatctatgctgcatccagtttgcaaagtgggtaccatcgaggttcagtggcagtggatctgggacagatttcactctcaccatcagtaatctgcaacgtgaagtattttgactaacttattacttntacaactagaattacaattgtttacggacgaaggacaacgactaactaaataaacgaactgtgctgcacatctgtctntactcttccgcatctntac

SEQ ID NO: 141223 - DNA, 717 bp, Homo sapiens
  misc_feature: GYAE6OF02GFL4I.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtctccatcctccctgtctgcaaccgtgganacagtgtcaccatcacttcggccgggacaaggtcggaactattgaccccacttaatttaaattggtaatacaacatacgaccgagggaccgacccctaagcctactaatctatcgctcgctactcctagtttcgacgaaaggtcggggtaccctagttcggaggttcgagtggacgtaggtggtatcggtaggggactaggttacttacaccttacctacacctagtacgtagtaactcgtagacgtaacgtaggtaaagttacgttttagaaccttaaacgtttacgttacgttacgtaaccgtaaacgtaagttaaacctttaattaaacgttttcggttttaaccgggaaccggtaacgggtaaccctaacggtaaaccttaaaacgttaaaaccgtttaaaaccggtacgttacgggtacgttaccgttaccgaaccgttaacccgttacgttccgtttacgttacccttttacgtacctttaccccgttacccgtacctaacgtttaccgtacgttaacg

SEQ ID NO: 141224 - DNA, 564 bp, Homo sapiens
  misc_feature: GYAE6OF02H8BKW.46.67.G01.1.454.CMB.1.raw
  modified_base (193)..(193): a, c, t, g, unknown or other
  misc_feature (193)..(193): n is a, c, g, or t
  modified_base (213)..(213): a, c, t, g, unknown or other
  misc_feature (213)..(213): n is a, c, g, or t
  modified_base (235)..(235): a, c, t, g, unknown or other
  misc_feature (235)..(235): n is a, c, g, or t
  modified_base (249)..(249): a, c, t, g, unknown or other
  misc_feature (249)..(249): n is a, c, g, or t
  modified_base (329)..(329): a, c, t, g, unknown or other
  misc_feature (329)..(329): n is a, c, g, or t
  modified_base (345)..(345): a, c, t, g, unknown or other
  misc_feature (345)..(345): n is a, c, g, or t
  modified_base (351)..(351): a, c, t, g, unknown or other
  misc_feature (351)..(351): n is a, c, g, or t
  modified_base (398)..(398): a, c, t, g, unknown or other
  misc_feature (398)..(398): n is a, c, g, or t
  modified_base (441)..(441): a, c, t, g, unknown or other
  misc_feature (441)..(441): n is a, c, g, or t
tcagactagcagtacacgaccggtgctcgatttagagtatacatattgggtttggggacctcctgtgcaagaacatgaagcacctgtggtttgtcctcctgctggtggcagctcccagatgggtcctgtccctggtgcaactgcaggagtcgggcccacgactggtgaggccttcggagacccctgtcccctnacctgcgcctgtcctctggncctcatcagtagtgtttctcgnggggctgggtccgnacgctcccgagggagggctggaatcagttggaagtgtctctcataggtggtaggttcctattacagtccgtctctcaagngtcgagtcacatatcnctgacncgtccagcaatctaagtttcccagatatgagttactgtcgaccgcgntcgacacgggtctttatactgtgacgagacgacgtctagttangttaagttttggagttggttagtttccgacgtacctagtacgtcggacggggtcctccgacccggtgggtccgaaggtaactacggtcggtcaccggttcctacgtttaccgccgttaacccg

SEQ ID NO: 141225 - DNA, 665 bp, Homo sapiens
  misc_feature: GYAE6OF02GKF0E.46.67.G01.1.454.CMB.1.raw
  modified_base (194)..(194): a, c, t, g, unknown or other
  misc_feature (194)..(194): n is a, c, g, or t
tcagactagcagtacacgaccggtgctcgatttagagtatacatattgggtttgggggagtctcggtcaggacacagcatggacatgagggtccccgctccagctcctggggctcctgctactctggctccgaggtgccagatgtgacatcgagctgacccagtctccatcctccctgtctgcaaccgtggganacagtgtcaccatcacttgccgggcaaggtcggaacattgacacctattaaatggtatcaactatagaccgagggaccgacccctaagcctacctaatctatcgactgctatcctagtttgacgtaaacggtcgggtaccctagtcggtaggttcgacggtcggacgtaggtcggtattcggtagggactaggtactttacgacttacgtcctaaccgtatacgtaagttaacttctacgtactaacggtagtaaagttacttttacgacttaactttattacgtcgtaacaaagtaacgttaaattaacttaagtttacggtttaccggaaccgtaaacgggtaactaaccgtaacttaaacgtaaaacttaaaccggaacgttaggtacgtacgttacgaaccgtaaccgtagttaccgtacgttacttacctacgttcccgttacccgacttcgttaccgtagtaacc

SEQ ID NO: 141226 - DNA, 568 bp, Homo sapiens
  misc_feature: GYAE6OF02INJN3.46.67.G01.1.454.CMB.1.raw
  modified_base (250)..(250): a, c, t, g, unknown or other
  misc_feature (250)..(250): n is a, c, g, or t
  modified_base (336)..(336): a, c, t, g, unknown or other
  misc_feature (336)..(336): n is a, c, g, or t
  modified_base (341)..(341): a, c, t, g, unknown or other
  misc_feature (341)..(341): n is a, c, g, or t
  modified_base (398)..(398): a, c, t, g, unknown or other
  misc_feature (398)..(398): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagaccctgtccctcacctgcgctgtctctggtgcctccatcagtgtggtttcttctggggctgggtccggcagctcccgagggaagggctggaatacattggaagtgtctntcatagtggaggttcctattacagtccgtctctcaagagtcgagtcaccatatctctggacacgtccagcaatctacgttttcccngaagntgtagttctgtcgaccgtccgctgacacgggtcttttaatactgtgcgagagacggnttatatgtagttttggagttggtttatttcgacctaccctagactcggacggggtctccggacccgtgggaccagggtaactcgtcgtccgacgtccgtaccttacgcccttaccaccgaacggccctagtccgtcctccccgtgcccaccctcctacccacgcgtaccc

SEQ ID NO: 141227 - DNA, 598 bp, Homo sapiens
  misc_feature: GYAE6OF02GQX1R.46.67.G01.1.454.CMB.1.raw
  modified_base (346)..(346): a, c, t, g, unknown or other
  misc_feature (346)..(346): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagcctcccgaggggaagggctggaatacagttggaagtgtctctcatagtggaggttcctattacagtccgtctctcaagagtcgagtcaccatatctcgtggacacgtccagcaatctacgtttcccagaacgntgtagttctgtacgaccgcgctgacgacgggtctttatacgtgtgacgagagacggctattatgttagttttgggagttaggttattacgacgtaccgtagtacgtcggaccgggtctaccggtacccgtgggaccgtagggtaacttacgtacggtcctaccgtccgtaccgttacgccctaccgaccgaacggtcctacgtccggttcccttccccgtcgtcccaccccgttccaccgtacgcgtacccg

SEQ ID NO: 141228 - DNA, 584 bp, Homo sapiens
  misc_feature: GYAE6OF02HJ3UT.46.67.G01.1.454.CMB.1.raw
tcagactagcagtacacgaccggtgctcgatttagagtatacatattgggtttggggagtctcggtcaggacacagcatggacatgagggtccccgctcagctcctgggggctcctgctactctggctccgaggtgccagatgtgacatcgagctgacccagtctccatcctccctgtctgcaaccgtgggagacagtgtcaccatcacttgccgggcaagtcggaacattgacactatttaaattgtatcaacatagaccagggacgcccctaagctctaatctatgctgcatcctagtttgactaaaggtcgggtacccatcggaggttcagtggcagtgatcgtgggacagtattcattctcacatacaagtaatctagacgtaaacgtagtaaagtattttacgactaactttattaacttacgtacaaactaagtaaattacaattacgttttacggaccgaaagggtacaacgtaacttaaactaaaattaaaacgtaaactagtacggtactacgtaccaacctacttacttcgttactttacacttcccttaccccgtacctaacttcctagtaac

SEQ ID NO: 141229 - DNA, 513 bp, Homo sapiens
  misc_feature: GYAE6OF02HCYEX.46.67.G01.1.454.CMB.1.raw
  modified_base (510)..(510): a, c, t, g, unknown or other
  misc_feature (510)..(510): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagattttgactaacttattacttgtacaacagtaattacaattgttttacggacctaagggacacgtactaacaaattaaacgaactagtgctgcgaccatctgtctcacttcctccgctatctntac

SEQ ID NO: 141230 - DNA, 550 bp, Homo sapiens
  misc_feature: GYAE6OF02HV1J6.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacgcccctaagctcctaatctatgctgcatccagtttgcaaagtgggtcccatcgaggttcagtggcagtggatcgtgggacagtatttcactctcaccatcagtaatctagactaacgtgtaagtattttgactaacttattactgtacaactagtaattacaattgtttacggtacaagggactaacgtaactaaactaaacttaaacgaactgtacgtacgttacgactaacctatcttacgttcttactacttcccttccccgacctattccgtataaccg

SEQ ID NO: 141231 - DNA, 550 bp, Homo sapiens
  misc_feature: GYAE6OF02FNEJ8.46.67.G01.1.454.CMB.1.raw
  modified_base (332)..(332): a, c, t, g, unknown or other
  misc_feature (332)..(332): n is a, c, g, or t
  modified_base (391)..(391): a, c, t, g, unknown or other
  misc_feature (391)..(391): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaggggctggaatacattggaagtgtctctcatagtggaggttcctattacagtccgtctctcaagagtcgagtcaccatatctctggacacgtcagcaatcagttttcccngaagatgagttctgtcgaccgccgctgacacgggtctttattactgtgcgagagacggntattatgtattttggagttggttatttcgactaccctagatcggacggggctcgacccgtggggccagggaatacgtggtcaccgtctccttacgcctccaccgaacggcccagtccggtccttccccgtcggcctacccctcctacccacgacgaccg

SEQ ID NO: 141232 - DNA, 560 bp, Homo sapiens
  misc_feature: GYAE6OF02HRE5C.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcacatcacttgccggcaagtcggaacattgacactatttaaatgtatcaacatagaccagggacgcccctaagctcctaatctatgctgcatcctagtttgacaaagtcggggtcccagtcgtaggttcagtggcaggtgatcgtgggacagatttcactctcacctatcataactctgacaacgtgaagtattttagctaaacttattacttagtacaactaagtaaattactaagtttcgttttaccggacctaaagggacctaacggtaaccttaaacgtaaagttaaaccgaacttaggtaggctagacctacctatcgtcttacttcacttccctcccgacctacttcgtataacg

SEQ ID NO: 141233 - DNA, 582 bp, Homo sapiens
  misc_feature: GYAE6OF02G6TXD.46.67.G01.1.454.CMB.1.raw
  modified_base (228)..(228): a, c, t, g, unknown or other
  misc_feature (228)..(228): n is a, c, g, or t
  modified_base (438)..(438): a, c, t, g, unknown or other
  misc_feature (438)..(438): n is a, c, g, or t
  modified_base (532)..(532): a, c, t, g, unknown or other
  misc_feature (532)..(532): n is a, c, g, or t
tcagactagcagtacacgaccggtgctcgatttagagtatacatattgggtttggggagtctcggtcaggacacagcatggacatgagggtccccgctcagctcctgggggctcctgctactctggctccgaggtgccagatgtgacatcgagctgacccagtctccatcctccctgtctgcaaccgtgggagacagtgtcaccatcacttgccggcaagtcggaacnttgacactattaaatggtatcaacatagaccagggaccggcccctaagcctacctaatctatgctgcatcctagtttgactaaaggtcggggtcccagtcggtaggttcgaaggtggcgtaggtggatcgtagggacaggtatttcactctcactatcagtaatctgactaacgtagtaagtattttagtaactttattactgtactaanagtaatactaattcgtttacggacgtaacggactaacgaacttaactaaagttaaacgtaactagttagacttacgacgacctaattaccgttnttaccgttacactttccgttaccccgtacctattccttagtacttaacgg

SEQ ID NO: 141234 - DNA, 597 bp, Homo sapiens
  misc_feature: GYAE6OF02HPY42.46.67.G01.1.454.CMB.1.raw
  modified_base (257)..(257): a, c, t, g, unknown or other
  misc_feature (257)..(257): n is a, c, g, or t
  modified_base (343)..(343): a, c, t, g, unknown or other
  misc_feature (343)..(343): n is a, c, g, or t
  modified_base (348)..(348): a, c, t, g, unknown or other
  misc_feature (348)..(348): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcgcctccatcagtagtggtttcttctggggctggggtccggcacgctcccgaggggaaggggctgggaatacagttggaagtgtctntcataggtggaggttctattacagttccgtctctcaagagtcgagtcaccgatatctctgacacgtccagcaatctagttttcccngaagntagtgttctcgtgaccgcgctgacgacggtctttatcgtgtgcgagagcggctattatgtattttggagttaggttattcgactaccgtagtacgtcggtacggggcctccggtaccccggtgggaccgagggtaactacgtcggtccgtaccgtccttaccttagccctaccgacccgaacggccctacgtcccggttcccttcccccgtcggtcccaccccgttcccgaccctacgtaccgtacccg

SEQ ID NO: 141235 - DNA, 535 bp, Homo sapiens
  misc_feature: GYAE6OF02H96R2.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtatccatcctccctgtctgcaaccgtgggagacagtgtcaccatcacttgccgggcaagtcggaacattgacacctatttaaattggtatcaacatagaccagggacggcccctaagctcctaatctatgactgcatccagtttgcaaagtcggggtcccatcgaggttcagtggcagtgatctgggacagatttcactctcaccatcagtaatctgacaacgtgaagtatttagactaacttattactagtacaacagtaaattacaattcgttttacggacgaaggacacgaactaaacaaattaaacgaactagtaggactagaccaacatctcgttacttactacttccttcccgcctacttcctgtaac

SEQ ID NO: 141236 - DNA, 610 bp, Homo sapiens
  misc_feature: GYAE6OF02JAL2B.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccggtgggagacagtgtcaccatcacttgccgggcaagtcggaacattgacacctatttaattggtatcaacatagaccagggacggcccctaagctcctaatctatgctgcatccagtttgcaaaggtgggtcccatcgaggttcagtgcagtggatcgtgggacagatttcactctcaccatcagtaatctagctaacgtgaagtattttgacttaaacttatttactagttaccaaactaagtaaattaactaagtttcggttttaccggtacccggtaaagggtaaccctaacggtaaccttaaacgtaaaacgtttaaaaccgaaacgttagtacgggaccttacggtaccgtaacctaacgttccgttacgttacctttacgtactttcccgttacccgacctacttacgtagttaaccg

SEQ ID NO: 141237 - DNA, 555 bp, Homo sapiens
  misc_feature: GYAE6OF02IL8S8.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgagggaaggggctggaatacattggaagtgtctctcatagtggaggttcctattacagtccgtctctcaagagtcgagtcaccatatctctggacacgtccagcaatctagttttccctgaagatgagtttctgtcgaccgccgctgacacgggtcgtttattacgtgttgcgagagacggtctattatgtagtttttggtagttggtttatttcgtactaccctagacgtcggacggggtctccggacccgtcgggccgagggatacgtcggtcaccgtctccgttacgcctacccg

SEQ ID NO: 141238 - DNA, 686 bp, Homo sapiens
  misc_feature: GYAE6OF02JYYD3.46.67.G01.1.454.CMB.1.raw
  modified_base (283)..(283): a, c, t, g, unknown or other
  misc_feature (283)..(283): n is a, c, g, or t
  modified_base (409)..(409): a, c, t, g, unknown or other
  misc_feature (409)..(409): n is a, c, g, or t
  modified_base (504)..(504): a, c, t, g, unknown or other
  misc_feature (504)..(504): n is a, c, g, or t
  modified_base (658)..(658): a, c, t, g, unknown or other
  misc_feature (658)..(658): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccctttcgggagaccctggtcccctcaccgtggccgcttcggtctcgtgggtcgccctccgatccaggttagtcggttttcttccgtggggggtccttgggggtccccgganacggtcccgttaccccggagggggaaacggggggtcctaggggaaacttaccgaagtttggggaaagttggtctcgttccaagtaggtgggaggttcctagttactaggtccgtctcgtactaagngtcgagttcaaccgtataactctcgtggaacctaccgttcagctaatctagtttttccccagaaagtattgacgtttctggttacgaccgtccgntacggagaccgggttagtttaagttaccgttggtacgtaccggagtaccggacgtacgttactttagtagttacgtttttaggacggttgtttacgtttacgaccgtacctagtactcggacgggtctcggacccggtggcgacggtactacgnggtacgccgttctcgtacgccttacccg

SEQ ID NO: 141239 - DNA, 555 bp, Homo sapiens
  misc_feature: GYAE6OF02F0TYA.46.67.G01.1.454.CMB.1.raw
  modified_base (329)..(329): a, c, t, g, unknown or other
  misc_feature (329)..(329): n is a, c, g, or t
  modified_base (548)..(548): a, c, t, g, unknown or other
  misc_feature (548)..(548): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctgggctgggtccgcagctccagggagggctggaatacattggaagtgtctctcatagtggagttcctattacagtccgtctctcaagagtcgagtcaccatatctctggacacgtccagcaatctagttttcccngaagatgagttctgtcgaccgccgctgacgacgggtctttatactgtgcgagagcgctattatgtattttggagttgttattcgactacctagactcggacggggtctccgacccgtggggccagggactacgtcggtccaccgtctccgttacgcctccaccgaacggccctacgtccggttccttccccgtcggaccctacccctccctaccgacgngtacccg

SEQ ID NO: 141240 - DNA, 568 bp, Homo sapiens
  misc_feature: GYAE6OF02GS038.46.67.G01.1.454.CMB.1.raw
  modified_base (337)..(337): a, c, t, g, unknown or other
  misc_feature (337)..(337): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtccctcacctgcgctgtctctggtgcctccatcagtagtggtttcttctggggctgggtccggcagctcccgagggaaggggctggaatacattggaagtgtctctcatagtggaggttcctattacagtccgtctctcaagagtcgagtcaccatatctctggacacgtccagcaatcagttttccccngaagatgagttctgtgacccgccgctgacacgggtcttttaattactgtgcgagagacggctattatgtattttggagttggttatttcgactacctagagtcgacggggctcgaccccgtggggccagggaactacgtgtccaccgtctccgttacgcctccaccgaacgggcccacgtccggttcccttcccccgtcggccctacccctccctacccgacgacgacccg

SEQ ID NO: 141241 - DNA, 561 bp, Homo sapiens
  misc_feature: GYAE6OF02GEIOE.46.67.G01.1.454.CMB.1.raw
  modified_base (216)..(216): a, c, t, g, unknown or other
  misc_feature (216)..(216): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccggnaagtcggaacattgacactatttaaatgtatcaacatagaccagggacgcccctaagctcctaatctatgctgcatccagtttgactaaaggtgggtcccagtcgaggttcagtggcagtggatcgtgggacagtatttcactctcacatcatatctgacaacgtgaagtatttgactaacttattacttgtactaacagtaattactaattcgtttcgacctaagggactaacgtaacctaactaaaacgttaaacgaaacgtgtacgtactacggacctacctaattccttagttacctttacgtaccttcccgttacccccgtactacgttccgtactaacg

SEQ ID NO: 141242 - DNA, 501 bp, Homo sapiens
  misc_feature: GYAE6OF02FXH9P.46.67.G01.1.454.CMB.1.raw
  modified_base (481)..(481): a, c, t, g, unknown or other
  misc_feature (481)..(481): n is a, c, g, or t
  modified_base (497)..(497): a, c, t, g, unknown or other
  misc_feature (497)..(497): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattgtatcaacatagaccaggacggcccctaagctcctaatctatgctgcatccagtttgcaaagtgggtcccatcgaggttcagtggcagtggatctgggacagattcactctcaccatcagtaatctgcaacgtgaagtattttgactaacttattactgtcaatagaattacaattgtttcgacgaaggacacgactaacaaattaaacgaactgtagactgcacatctgtcttnactcttcccgcatctntaac

SEQ ID NO: 141243 - DNA, 539 bp, Homo sapiens
  misc_feature: GYAE6OF02JF179.46.67.G01.1.454.CMB.1.raw
  modified_base (373)..(373): a, c, t, g, unknown or other
  misc_feature (373)..(373): n is a, c, g, or t
  modified_base (377)..(377): a, c, t, g, unknown or other
  misc_feature (377)..(377): n is a, c, g, or t
  modified_base (471)..(471): a, c, t, g, unknown or other
  misc_feature (471)..(471): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccgcagcctccgagggaaggggctggaatacattggaagtgtctctcatagtggaggttcctattacagtccgtctctcaagagtcgagtcaccatatctctggacacgtcagcaatcagttttcccngaantgagttctgtcgaccgccgtctgacacgggtctttattactgtgcgagagacgctattatgtatttttggagttggttatttcgactacctagntcggacggggtctccgacccgtgggccgagggtatacgttcggctaccgtctccttacgccctacccg

SEQ ID NO: 141244 - DNA, 588 bp, Homo sapiens
  misc_feature: GYAE6OF02HRP6O.46.67.G01.1.454.CMB.1.raw
  modified_base (256)..(256): a, c, t, g, unknown or other
  misc_feature (256)..(256): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgactacctatttaaattggtatcaanatagacagggaccgccctaagctctaatctatgctgcatccagtttcgacgtaaagtgggtcccagtcgaggttcaggtgcgagtggatcgtgggacagtacttcactctaccacctatctaagtaatctagacaacgtagtaagtattttacgactaactttattacttcgtacaataagtaaattataagttagttttaccggacctaaagggaactaacgtaactaaactaaaacgttaaacgtaaacgtgtaggtacctagtaccgaacctacttacttcgttacttactacttcccgttaccccgaccgtacttacgtacgttaacg

SEQ ID NO: 141245 - DNA, 531 bp, Homo sapiens
  misc_feature: GYAE6OF02JCZUH.46.67.G01.1.454.CMB.1.raw
  modified_base (193)..(193): a, c, t, g, unknown or other
  misc_feature (193)..(193): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgtccaccatcacttgccgggacaagtcggaacattgactacctaatttaaattggtatcaacatagaccagggaccggcccctaagctcctaatctatgactgcatcctagtttgacaaaggtcgggtcccagtcgagttcagtggcaggtgatcgtgggacagtatttcactactcaaccatcaagtaactctagctaacgtgaagtattttgactaacttattactgtacaacagtattaacattgtttacgaccaaggtacagtactaataaataacgaatgtacgctacgacactatctgttctctactcctacccgcacttctagtac

SEQ ID NO: 141246 - DNA, 666 bp, Homo sapiens
  misc_feature: GYAE6OF02H6JN1.46.67.G01.1.454.CMB.1.raw
  modified_base (343)..(343): a, c, t, g, unknown or other
  misc_feature (343)..(343): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtgggctgggtccggcagctccgagggagggctaggaatacagttggaagtgtctctcagtagtggaggttcctattacagttccgtctctacaagagtcgagtcacctatatctctggacacgtccagcaatctacgtttcccagaagntgtagttctgtcgaccgcgctcgacgtacgggtacttttactcgtgtcgacgagagacggcttaagttagtagttacgttttgggtagtttagggtttactttacgaccgtacccgttagacgttccggggacggggtcctacccggacccgggtcggggacccgtaaggggtaactaccggtcgggttaccgtacccggttccttacccgttacgcccttacccgaaccgtaaccgggtcccctaacggttcccggttaccccttcccccgtacggtaccccttacccccgttaccccgtaccgtaccggtaccgtaccccg

SEQ ID NO: 141247 - DNA, 555 bp, Homo sapiens
  misc_feature: GYAE6OF02IHVXV.46.67.G01.1.454.CMB.1.raw
  modified_base (245)..(245): a, c, t, g, unknown or other
  misc_feature (245)..(245): n is a, c, g, or t
  modified_base (329)..(329): a, c, t, g, unknown or other
  misc_feature (329)..(329): n is a, c, g, or t
  modified_base (342)..(342): a, c, t, g, unknown or other
  misc_feature (342)..(342): n is a, c, g, or t
  modified_base (392)..(392): a, c, t, g, unknown or other
  misc_feature (392)..(392): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggttctctggggctgggtccggcagctcccagggagggctggatacattggaagtgtctntcatagtggaggttcctattacagtccgtctctcaagagtcgagtcaccatatctctggacacgtccaagcaatcagttttccngaagatgagttcngtgaccgcgctgacaggggtctttaatactgtgcgagagacggctattangtattttggagtggttattcgaactcctagactcggcgggactcgacccgtgggcccgaggtaacgtacgtggtccgtaccgtcgttcctacgccttacccgaccgaacgggcccagtccggtaccttccccgtggcccacccgtcctccaacgacgtacccg

SEQ ID NO: 141248 - DNA, 524 bp, Homo sapiens
  misc_feature: GYAE6OF02IT19H.46.67.G01.1.454.CMB.1.raw
  modified_base (192)..(192): a, c, t, g, unknown or other
  misc_feature (192)..(192): n is a, c, g, or t
  modified_base (348)..(348): a, c, t, g, unknown or other
  misc_feature (348)..(348): n is a, c, g, or t
  modified_base (502)..(502): a, c, t, g, unknown or other
  misc_feature (502)..(502): n is a, c, g, or t
  modified_base (513)..(513): a, c, t, g, unknown or other
  misc_feature (513)..(513): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgtcgggcaagtcggaacattgacacctatttaaatggtatcaacatagaccagggacgcccctaagctcctaatctatgctgcatccagtttgacaagtgggtcccatcgaggttcagtggcagtggatcgtgggacngtatttcactctcacctatacagtaactctagacaacgtgaagtatttgactaacttattactgtacaactagtaattacaattcgtttacggactaagggacacgtaactaactaaattaaacgaactgtacgctagacactatctatcttanacttcttcccnctatcgtatac

SEQ ID NO: 141249 - DNA, 569 bp, Homo sapiens
  misc_feature: GYAE6OF02HYDFE.46.67.G01.1.454.CMB.1.raw
  modified_base (216)..(216): a, c, t, g, unknown or other
  misc_feature (216)..(216): n is a, c, g, or t
  modified_base (253)..(253): a, c, t, g, unknown or other
  misc_feature (253)..(253): n is a, c, g, or t
  modified_base (427)..(427): a, c, t, g, unknown or other
  misc_feature (427)..(427): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcacatcacttgccggnaagtcggaacattgactactaatttaatggtatacanatagacaggacgccctaagctcctaatctatgtctgctactccgtagtttgactaaaggtcgggtaccctagtcggtaggttcagtggactagtggtatcgtgggacagtattcactctacacatctatatctgacgaagtgaatatttacgactaacttattactgtacaaanataattacagttgtttaccggactaacgggaactacgtaacctaataaacttaaacgaacttggtacgtcgtacgacgtaacctacttcgtacgttaccttacgtaccttaccttccccgaccttacgtccttagtaacccg

SEQ ID NO: 141250 - DNA, 549 bp, Homo sapiens
  misc_feature: GYAE6OF02GV1F3.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactattaaatgtatcaacatagaccaggacggcccctaagctcctaatctatgctgcatccagtttgcaaaggtgggtcccagtcgagttcagtggcagtgatcgtgggacagtattcactctcaccatcagtatctgacaacgtagaagtatttgactaacttattactgtacaactagtaattactaagttcgttttaccggacctaaaggtacaaccgtaacttaaactaaacgttaaacgaacgttgtacgtactacgacctaactattctagttaccttacgacttccttacccgacctacgttctgtaac

SEQ ID NO: 141251 - DNA, 726 bp, Homo sapiens
  misc_feature: GYAE6OF02J13SG.46.67.G01.1.454.CMB.1.raw
  modified_base (213)..(213): a, c, t, g, unknown or other
  misc_feature (213)..(213): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggcccttcgggagaccctgtccctcacctgcgctgtctctggtncctccatcagtgtggtttctcgtggggcttggggtccggcagccttcccgaggggacggggctggaatacagttggaagttgtctctcgataggtggaggttcctattacgacggttccgtcttcgtctaagacgtccgtagttacaccattactcgtcctagggacctaacggtcctagacctaaattccgtacgtttttaccccgaggtaaagtaacgtttcggaacgttttcgtacgttacggaaccccggtccgtacggttacgaaccggtaccggggttaccggttttaacttaaccgttgttacggtaccggtaaggtacggtaccgggttacttaacgtttagttacggtttagttttttcgggaaggtttgggttttaactttcgggaaccttacccgtagttacgtcgggtaccggggtccttccgggaaccccggttcgggtaccggaggggttaaactcggttaccggtcgacccggttctttccggtacgtcccctaaccg

SEQ ID NO: 141252 - DNA, 504 bp, Homo sapiens
  misc_feature: GYAE6OF02GW8XB.46.67.G01.1.454.CMB.1.raw
  modified_base (337)..(337): a, c, t, g, unknown or other
  misc_feature (337)..(337): n is a, c, g, or t
  modified_base (425)..(425): a, c, t, g, unknown or other
  misc_feature (425)..(425): n is a, c, g, or t
  modified_base (477)..(477): a, c, t, g, unknown or other
  misc_feature (477)..(477): n is a, c, g, or t
  modified_base (500)..(500): a, c, t, g, unknown or other
  misc_feature (500)..(500): n is a, c, g, or t
tcagactagcagtacacgaccggtgctcgatttagagtatacatattgggtttggggagtctcggtcaggacacagcatggacatgagggtccccgctcagctcctggggctcctgctactctggcccaggtgccacgatgtgacatcgagctgacccacgtctccatcctccctcgtctgcaaccgtcgggaggacagtgtcaccactcacttgccgggcgaagtcggaacattgacacctatttaaattaggtatcaacatagaccagggacggccccctaagctcctaatctatgctgcatccagtttgcaaagtgggggtcccatcgaggttnagtggcagtggatctgggacagatttcactctcacatcagtatctgcaacgtgaagattttgcaacttattactgtcaacagaattanaattgtttcgacaacggtacacgactacaaattaaacgactgtgctgcaccntctgtcttcatctcccgcatctnatac

SEQ ID NO: 141253 - DNA, 823 bp, Homo sapiens
  misc_feature: GYAE6OF02J2ZDY.46.67.G01.1.454.CMB.1.raw
  modified_base (172)..(172): a, c, t, g, unknown or other
  misc_feature (172)..(172): n is a, c, g, or t
  modified_base (351)..(351): a, c, t, g, unknown or other
  misc_feature (351)..(351): n is a, c, g, or t
  modified_base (378)..(378): a, c, t, g, unknown or other
  misc_feature (378)..(378): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcncctccatcagtagttggtttcttcgtggggtctcggggtccgcagcctcccgagggagggctaggaatcgagttggagtgtctctcataggtggacgttcctattacagtccgtctctcgaagtgtcgagtccacatatctctaggacacggtccagcaatctacttttccgagaagtntgtagtttcgtgttcgacccggccgtntacggaacgaccggggttcttttaacgtactggttgaccgtaagacggaccgtcttaagttagttagtttaggttttaggttacggtttaggttttacgtttaccggtaaccttaaccccggttaaggttaccgtaccgggtaaccggggttcccgttaacccgggtaccccgggttaccggggacccggttaaacggggtaaacgtttacccggtttaccggggtaacccgtttaccccggttaccgtttaccccgtttaacccggacccccgtttacccggtaaacccccggggtaaccggggtaccccccgttaacgggtttccccccgggtttaaccccccggttttaacccccccggttcccgggtaccccccgttaaccccccggttttaccccccggtttaccccggaaaacccggtccccgggttaaacccccccgg

SEQ ID NO: 141254 - DNA, 778 bp, Homo sapiens
  misc_feature: GYAE6OF02HJ6IZ.46.67.G01.1.454.CMB.1.raw
  modified_base (254)..(254): a, c, t, g, unknown or other
  misc_feature (254)..(254): n is a, c, g, or t
tcagactagcagtacacgaccggtgctcgatttagagtatacataattgggggtttggggagtctcggtacacggacacgagccaagtggacactaggacgggtacccccgctcgagctcctgggggtcctccctcgcctacctcgtgggcctccggagggtggccgagagtgtaggaccatacgagctgacccagtctccatccctccctgtctgacaaccggtgggagacagtgcaccatcacttggccggnaagtcgaacatgacaaccttatttaaagttggtatacaactatagaccgagggaccgcccctaagcctacctaatactagtgcctgccaatcctagtttacgacgtaaaagggttcggggtccctaagttccggaaggtttccgaaggttgggctagggttacgagttccggtaggggaaccaggttaatttccgaactcctactaacctattacctaaggttaactcgtttacggaccgtaaagggtagtaaacggtttattttacggaacctttaaacgtttttattaaccgttacggtttaacctaaaaccgtaagttaaactttaaacgtaaacgtttttcgggtttaacccgggtaaccgtaaaacggggtaaccgtaaaccgttaaacgttaaaaccgtaaaaaacgtttaaaccgtaacgttacgggttacgaccttaacggcctaaacgtacctttcggtaacttaccgtttctaaccgtttccctaccccggtactacggtttaccagttaaccg

SEQ ID NO: 141255 - DNA, 564 bp, Homo sapiens
  misc_feature: GYAE6OF02IVKSB.46.67.G01.1.454.CMB.1.raw
  modified_base (392)..(392): a, c, t, g, unknown or other
  misc_feature (392)..(392): n is a, c, g, or t
  modified_base (404)..(404): a, c, t, g, unknown or other
  misc_feature (404)..(404): n is a, c, g, or t
  modified_base (448)..(448): a, c, t, g, unknown or other
  misc_feature (448)..(448): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctaatttaaatggtatcaacatagacgagggacggcccctaagctcctaatctatgctgcaatccagtttcgacaaaaggttcggggtacccagttccggaggtttacagtggactaggtggatcgagggacaggtattcactctcacatcagtaanctagacaacgtnagtatttgacaacttattatagtacaacagaatttaacaagttntttaggacctaaagggacaaacggtaactaaactaaattaaaacgtaaactagtaggactcgacacctaatccgtatacgtttacaagttcccttacccgcctaatcgttagtaac

SEQ ID NO: 141256 - DNA, 554 bp, Homo sapiens
  misc_feature: GYAE6OF02G2D36.46.67.G01.1.454.CMB.1.raw
  modified_base (247)..(247): a, c, t, g, unknown or other
  misc_feature (247)..(247): n is a, c, g, or t
  modified_base (373)..(373): a, c, t, g, unknown or other
  misc_feature (373)..(373): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctgggctgggtccgnagctcccgagggaaggggctggaatacgattggaagtgtctctcatagtggaggttcctattacagtccgtctctcaagagtcgagtcaccatatctctggacacgtccagcaatcagttttcccngaagatgtagttctgtcgaccgccgctgacgacgggtcgtttattactgtgcgagagacgtctattatgtagttttggagttggttatttcgactaccgtagtactcggacggggtcgtccggaccccgtcgggaccgagggtaactacgtcggtctaccgtcctccgttacgcctacccg

SEQ ID NO: 141257 - DNA, 502 bp, Homo sapiens
  misc_feature: GYAE6OF02FTX30.46.67.G01.1.454.CMB.1.raw
  modified_base (479)..(479): a, c, t, g, unknown or other
  misc_feature (479)..(479): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaatgtatcaacatagaccagggacggcccctaagctcctaatctatgctgcatccagtttgcaaagtggggtcccatcgaggttcagtggcagtggatctgggacagatttcactctcaccatcagtaatctgcaacgtgaagatttgactaacttattactgtacaacagaattacaattgttttcggacctaagggacacgactaacaaattaaacgaactgtagctgcacatctntcttcatcttccgcactctgtac

SEQ ID NO: 141258 - DNA, 597 bp, Homo sapiens
  misc_feature: GYAE6OF02G6HR2.46.67.G01.1.454.CMB.1.raw
  modified_base (217)..(217): a, c, t, g, unknown or other
  misc_feature (217)..(217): n is a, c, g, or t
  modified_base (226)..(226): a, c, t, g, unknown or other
  misc_feature (226)..(226): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccgtgggagacagtgtcaccatcacttgccggnagtcgaacntgacactatttaatggtatcaacatagaccagggaccgcccctaagctcctaatctatgctgctactccagtttgactaaaggtcggggtacccagtcgaggttcaggtgcgagtggatcgtgggacagtattcacttcacacctatacagtaatctagacaacgtgtaagtatttgactaacttattaactgtacaactaagtaacttaactaagttcgtttacggaaccgtaacgggtaacctaacgtaacgttaaactaaaacgtttaaacgtaacgttagttacggtacgtacgacctaacctagttacttacgttacctttactaaccgttcccttaccccgtaccgtacttacgtacgttaaccg

SEQ ID NO: 141259 - DNA, 574 bp, Homo sapiens
  misc_feature: GYAE6OF02GBCJ1.46.67.G01.1.454.CMB.1.raw
  modified_base (334)..(334): a, c, t, g, unknown or other
  misc_feature (334)..(334): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttcccngaagatgagttctgtcgaccgcgctgacacgggtctttatacgtgtgcgagagacggctattatgtattttggagttggttatttcgaactacccgtagtactcgggacggggtctccggtaccccgtggggccgaaggggactacgtggtccacggtctaccgttacgccctccgaccgaacggcccctagtccggttcccttcccccgtcggccctacccctcctccgagccgtaccc

SEQ ID NO: 141260 - DNA, 606 bp, Homo sapiens
  misc_feature: GYAE6OF02HK2SY.46.67.G01.1.454.CMB.1.raw
  modified_base (332)..(332): a, c, t, g, unknown or other
  misc_feature (332)..(332): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctccagggagggctggaatacattggaagtgtctctcatagtggaggttcctattacagtccgtctctcaagagtcgagtcaccatatctctggacacgtccagcaatctagttttcccngaacgatgagttctgtgaccgccgctgacacggggtcttttattactgtgcgtagagacggctattatgtattttggagttggtttatttcgactacccgttagtactcgggacggggtctccgaccccggttggggcccgaaggggtaatacgtggtcctaacccggtccttccgttacgccctaccgaacccgaacgggtcccctaagttcccggtacccgtttccccccgtggtcccctaccccgtcccttacccgaacgtaccgtacccg

SEQ ID NO: 141261 - DNA, 515 bp, Homo sapiens
  misc_feature: GYAE6OF02FQ9I3.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgagttcagtggcagtggatctgggacagatttcactctcaccatcagtaatctgcaacgtgaagtatttagactaacttattacttgtacaactagaattacaattgtttcggactaagggacaacgtactaacaaattaaacgaactgtgctgaccacatctgttcttcacttccttcccggctactctatac

SEQ ID NO: 141262 - DNA, 530 bp, Homo sapiens
  misc_feature: GYAE6OF02IKEMQ.46.67.G01.1.454.CMB.1.raw
  modified_base (483)..(483): a, c, t, g, unknown or other
  misc_feature (483)..(483): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatctgggacagatttcacttctcaccatcagtaatctgcaaacgtgaagtattttagctaactttattaactgtacaaacagaaattacaattgtttcggaccaagggacacgactaactaaaattaaacgaaacttgtaggntagacaccatctgttcttacactttccttcccgtccacttctgtaac

SEQ ID NO: 141263 - DNA, 611 bp, Homo sapiens
  misc_feature: GYAE6OF02JG5BB.46.67.G01.1.454.CMB.1.raw
  modified_base (380)..(380): a, c, t, g, unknown or other
  misc_feature (380)..(380): n is a, c, g, or t
  modified_base (391)..(391): a, c, t, g, unknown or other
  misc_feature (391)..(391): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctgggctgggtccggcagctccgagggagggctggaatacattggaagtgtctctcatagtggaggttcctattacagtccgtctctcaagagtcgagtcaccatatctctggacacgtccagcaatctagttttcccagaagatgtagttctgtcgaccgcgctgacgacgggtctttatactgtncgagagacgtntattatgtattttggagttaggttattacgactaccgtagtacgtacgggacggggtcctaccggacccggtacggggaccgtaaggggtaactaccggttacggtccgtacccggttcctaccgttacgtcccttacccgaccggtaacggaccctacgtccggttccctttcccccggtcggtccctaccccgttccctacccgtacggacgtacccg

SEQ ID NO: 141264 - DNA, 602 bp, Homo sapiens
  misc_feature: GYAE6OF02IU0DB.46.67.G01.1.454.CMB.1.raw
  modified_base (211)..(211): a, c, t, g, unknown or other
  misc_feature (211)..(211): n is a, c, g, or t
  modified_base (250)..(251): a, c, t, g, unknown or other
  misc_feature (250)..(251): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttcttcgtggggctgggtccgnngcctccgagggaagggctggaatacagttggaagtgtctctcataggtggaggttcctattacagtccgtctctcaagagtcgagtcaccatatctctcggacacgtccagctaatctagtttccctagaagatgtagttctgtcgaccgccgtctgacgacgggtcgttttaacttacgtggtgacgagacgacgtctagttatgttagttttggtagttggttactttcgactaccgtagtacgtcggtacggggtcctccggtaacccggtcggggaccgtaagggaacgttaaccggtcgggttaccgtacccggttcctttacccggttaccgtcccgtaccccgg

SEQ ID NO: 141265 - DNA, 623 bp, Homo sapiens
  misc_feature: GYAE6OF02HLB2B.46.67.G01.1.454.CMB.1.raw
  modified_base (333)..(333): a, c, t, g, unknown or other
  misc_feature (333)..(333): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccgcagctccgagggagggctggaatacattggaagtgtctctcatagtggaggttcctattacagtccgtctctcaagagtcgagtcaccatatctctggacacgtccagcaatctagttttcccngaatatgtagttctgtcgaccgccgctgacgacgggtctttatacgtgtcgcgagagacgtctatatgttattttggagttggttattcgactacctagacgtcggacggggtcctaccggaccccggtggggaccgaaggggtaacttacgttcggtaccgtaccgttccgttaccgttaccgacccttacccgaacccggtaacgggcccctaacgttcccggtttacccgtttccccccgtcggtacccctaccccgttaccccgtacccgaacgtaccgtaccccg

SEQ ID NO: 141266 - DNA, 560 bp, Homo sapiens
  misc_feature: GYAE6OF02FQG85.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccggcagctcccgagggaaggggctggaatacattggaagtgtctctcatagtggaggttcctattacagtccgtctctcaagagtcgagtcaccatatctctggacacgtccagcaatctacgttttcccagaagtatgagtttctgtgaccgccgctgacgtacgggtctttatacgtgtgcgagacgacgtcttattatgtattttggagttggttattcgactacctagtacgtcggacgggtcctccggacccgtggggccgtaagggtaactacgtcggtacgtacccgttctccgttacgccctacccg

SEQ ID NO: 141267 - DNA, 733 bp, Homo sapiens
  misc_feature: GYAE6OF02HEGTV.46.67.G01.1.454.CMB.1.raw
  modified_base (229)..(229): a, c, t, g, unknown or other
  misc_feature (229)..(229): n is a, c, g, or t
  modified_base (235)..(235): a, c, t, g, unknown or other
  misc_feature (235)..(235): n is a, c, g, or t
  modified_base (260)..(260): a, c, t, g, unknown or other
  misc_feature (260)..(260): n is a, c, g, or t
  modified_base (297)..(297): a, c, t, g, unknown or other
  misc_feature (297)..(297): n is a, c, g, or t
  modified_base (703)..(703): a, c, t, g, unknown or other
  misc_feature (703)..(703): n is a, c, g, or t
  modified_base (729)..(729): a, c, t, g, unknown or other
  misc_feature (729)..(729): n is a, c, g, or t
tcagactagcagtacacgaccggtgctcgatttagagtatacatattggtttggggtagtctcggtcaggacacagcatggacatgagggtccccgctcagctcctggggctcctgctactctggctccgaggtgccagatgtgacatcgagctgacccagtctccagtcctccctgtctgcaaccgtggagacagtgtccaccatcacttgccgggcaagtcggaacnttgacncctattaaaatggtatcgaacatanacaaggaccgaccctaagcctacctaagtactaactnacttacgacacgtacctaagttttacgacctaaaaggttcgggggttaacccaacgttaccggtaacggggtttacgtaccggttagggacccgttagggttagggaaacgttcgttacgggggtaacaacgggtaacttttccgaaacttccgttacgaacccgtacttaccaaggtttaaacttcgttcgaaccgtaaaccggttggtaaacgtaattttttacggaacctaaaaccttttaagtttaccgtaacggtttaacaaaccgtaagtaaaactttaacgtaaactttagggtttttcccggaacgttaaacggggaacttaccggaaaccttaacaaaacgtttaaaaccgaacttggttaggaccctaggtaccaacctaagtctattacccgttntacgttacctcccgtactactacgtntaac

SEQ ID NO: 141268 - DNA, 546 bp, Homo sapiens
  misc_feature: GYAE6OF02JF0B5.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatcctagtttgacaaagtcgggtacccagtcgaggttcagtggcagtgatcgtgggacagtatttcacttctacaccatcagtaactctgactaacgtgaagtatttacgactaacttattacgtgtacaactagtaattactaattgtttacggacctaagggacaacgtactaactaaaacttaaacgaacgtgtagctagacacctatcgttacgtcttacacttccttacccgctacttcctagtac

SEQ ID NO: 141269 - DNA, 657 bp, Homo sapiens
  misc_feature: GYAE6OF02I8KRJ.46.67.G01.1.454.CMB.1.raw
  modified_base (298)..(298): a, c, t, g, unknown or other
  misc_feature (298)..(298): n is a, c, g, or t
  modified_base (361)..(361): a, c, t, g, unknown or other
  misc_feature (361)..(361): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtggagacagtgtcaccatcacttgccggcaagtcggaacattgacacctatttaatggtatcaacatagacaggacgccctaagctacctaatctaatgctgcatccagtttnacaaagtcgggtccatcgagttcagtgacagtgatcgtggactagatttcgactctcaacctnacgtagtaatctacgacaacgtagaaagtattttagacctaaactttacttacgtacgtactaaaccaagttaaactttaacgaaacttttcgttttaccgggaccgtaaaacggggtaacctaaaccgggtaaacccgttaaactaaaaacgtttaaaacccggtaaaccgtaaggtttcggaccttaaccgggtaacctaaccccggttaaatttaccgggttaacgtttacccgtttaacgtacctttacccgtttcccccggaacccgtaactttccgttaacggttaaccg

SEQ ID NO: 141270 - DNA, 533 bp, Homo sapiens
  misc_feature: GYAE6OF02HBOWS.46.67.G01.1.454.CMB.1.raw
  modified_base (396)..(396): a, c, t, g, unknown or other
  misc_feature (396)..(396): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctccagggagggctggaatacattggaagtgtctctcatagtggaggttcctattacagtccgtctctcaagagtcgagtcaccatatctctggacacgtccagcaatcacgttttcccagaagatgagttctgtgaccgcgctgacacgggtctttatactgtgcgagagacgctattatgtnttttggagttgttatttcgactacctagagtcgacggggctccgacccgtgggccagggatacgtcgtcaccgtctccttacgcctcaccgaacggcctagtccgtcctcccgtcggcctccctcctccacgctccg

SEQ ID NO: 141271 - DNA, 575 bp, Homo sapiens
  misc_feature: GYAE6OF02GG20L.46.67.G01.1.454.CMB.1.raw
  modified_base (306)..(306): a, c, t, g, unknown or other
  misc_feature (306)..(306): n is a, c, g, or t
  modified_base (333)..(333): a, c, t, g, unknown or other
  misc_feature (333)..(333): n is a, c, g, or t
  modified_base (337)..(337): a, c, t, g, unknown or other
  misc_feature (337)..(337): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaagggctggaatacattggaagtgtctctcatagtggaggttcctattacagtccgtctctcaagagtcgagtcaccatatctcnggacacgtccagcaatcagttttcccngaantgagttctgtcgaccgccgctgacgtacgggtcgttttatactggtgcgagagacggcttatatgtagttttggagttggttatttcgactacccgttagactcgggacgggtcctccggacccgtggggaccgagggtaactacgtggtccaccgtctccgttagcctccgaccgaacgggccctacgtccggtcccttccccgcggccctaccccttccaccgtaacgccgtaccg

SEQ ID NO: 141272 - DNA, 600 bp, Homo sapiens
  misc_feature: GYAE6OF02JFKE1.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaggggctggaatacattggaagtgtctctcatagtggaggttcctattacagtcccgtctctcaagagtcgagtcaccatatctctggacacgtccagcaatcagttttcccctgaagatgtagttctgtcgaccgccgctgacacgggtcgttttattacctgtgcgagagacggctattatgtattttggagttggtttatttcgactacccgttagtacgtcgacggggctccggacccgtcggggaccgagggtaactaccgtggtccgtacccgttcttccgttacgccctaccgaccgaacgggccctacggtccggttcccgtttcccccgtcggtccctaccccgttccctacccgaacgaccgtaccccg

SEQ ID NO: 141273 - DNA, 539 bp, Homo sapiens
  misc_feature: GYAE6OF02HTXVX.46.67.G01.1.454.CMB.1.raw
  modified_base (514)..(514): a, c, t, g, unknown or other
  misc_feature (514)..(514): n is a, c, g, or t
  modified_base (535)..(535): a, c, t, g, unknown or other
  misc_feature (535)..(535): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgactacctatttaaattggtatacaacatagaccagggacgcccctaagctcctaatctatgctgcatccagtttgcaaagtcgggtccatcgaggttcagtggcagtggatcgtgggacaggattcactctcacctatcagtaatctagacaagtagaagtatttgactaacttattactgtacaactagtaattataattgttttacggacgtaagggtacacgtaactaactaaactaaacgtaaacgtgtaggactagtaccaaccatcttacgtcttanacttcctacccgacctatctntaac

SEQ ID NO: 141274 - DNA, 633 bp, Homo sapiens
  misc_feature: GYAE6OF02GILS7.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaattgtatcaacatagaccagggacgcccctaagctacctaatctatgctgctatccagtttgactaaagtcggggtcccagtcgtaggttcagtggcagtgatcgtgggactagtattcactctcacatacagtaatctagacaacgtagtaagtattttacgactaaactttattaacgttagtactaaactaagtaaactttaacctaagtttacggttttaccggaaccgtaaacgggtaacctaaaccggtaacttaaacctaaaacgtttaaaaacgaaacgttacggtacgggtactacggaaccgtaaccgtaatttccgtaaggttacctttaccgtacctttacccgtttacccccgaccttaacgttccgtacgttaaccg

SEQ ID NO: 141275 - DNA, 608 bp, Homo sapiens
  misc_feature: GYAE6OF02IRPYL.46.67.G01.1.454.CMB.1.raw
  modified_base (227)..(227): a, c, t, g, unknown or other
  misc_feature (227)..(227): n is a, c, g, or t
  modified_base (262)..(262): a, c, t, g, unknown or other
  misc_feature (262)..(262): n is a, c, g, or t
  modified_base (302)..(302): a, c, t, g, unknown or other
  misc_feature (302)..(302): n is a, c, g, or t
  modified_base (359)..(359): a, c, t, g, unknown or other
  misc_feature (359)..(359): n is a, c, g, or t
  modified_base (365)..(365): a, c, t, g, unknown or other
  misc_feature (365)..(365): n is a, c, g, or t
  modified_base (416)..(416): a, c, t, g, unknown or other
  misc_feature (416)..(416): n is a, c, g, or t
  modified_base (430)..(430): a, c, t, g, unknown or other
  misc_feature (430)..(430): n is a, c, g, or t
tcagactagcagtacacgaccggtgctcgatttagagtatacatattggggtttgggggacctccgtgtgcaagaaccatgaacgcacctgtggtttgtcctcctggctggtggcagctccagatgggtcctgtccctggtgcaactgcaggagtcgggcccacgacgtgggtagacggccctttacgggagacccctgtccctacacctgcgctgtctcgtggtcncctcaatcagtgtgttctcgtggggctgggtccgnagctccgagggaggctggaatacagttggaagtgtctctnagtagtggtaggttcctattacagttcctctctacgaagtacgttcgatcaacattntcgtcnggaactcgtcacgtacaattcgtaacgttttcccagaagtatcgtagttcngtacgaccgccgtntagacgtcgggtactttatcgtgtgacgaagcgtcgtattacgttatagttattttggaatttggttacttcgaaccctacgtagtacgtccgggtacgggtactaccgacccggttgggaccgtaaggtaacgtccgttgggccctacggttaccgttccgttacggcctaacccgg

SEQ ID NO: 141276 - DNA, 597 bp, Homo sapiens
  misc_feature: GYAE6OF02H9TVO.46.67.G01.1.454.CMB.1.raw
  modified_base (250)..(250): a, c, t, g, unknown or other
  misc_feature (250)..(250): n is a, c, g, or t
  modified_base (329)..(329): a, c, t, g, unknown or other
  misc_feature (329)..(329): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggnagctcccgagggaaggggctggaatacattggaagtgtctctcatagtggaggttcctattacagtccgtctctcaagngtcgagtcacatatctctgacacgtccagcaatctacgttttccctagaagattgtagttctgtcgacccgccgctgacgacgggtcgtttattacgtgtgcgagaggacgtctattagttagttagtttttggagttggtttatttcgtacctaccgtagtacgttcgggacggggtccgtaccggtaccccggtcgggtacccggaaggggtaactacggtacggtaccgtacccgttccgttacccgtttacgtcccctaccccg

SEQ ID NO: 141277 - DNA, 526 bp, Homo sapiens
  misc_feature: GYAE6OF02GLEYP.46.67.G01.1.454.CMB.1.raw
  modified_base (523)..(523): a, c, t, g, unknown or other
  misc_feature (523)..(523): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgacaaaggtcggggtcccatcgaggttcagtggcagtggatctgggacagtatttcactctcaccatcagtaatctgacaacgtgaagtattttgactaacttattacttagtactaacagtaattactaattgttttacggacgtaagggacacgtactaactaaattaaacgaactgtagtctgactacatctgtcttcacttcctccgctactctntac

SEQ ID NO: 141278 - DNA, 619 bp, Homo sapiens
  misc_feature: GYAE6OF02JOJ63.46.67.G01.1.454.CMB.1.raw
  modified_base (251)..(251): a, c, t, g, unknown or other
  misc_feature (251)..(251): n is a, c, g, or t
  modified_base (340)..(340): a, c, t, g, unknown or other
  misc_feature (340)..(340): n is a, c, g, or t
  modified_base (361)..(361): a, c, t, g, unknown or other
  misc_feature (361)..(361): n is a, c, g, or t
  modified_base (366)..(366): a, c, t, g, unknown or other
  misc_feature (366)..(366): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggnagcctcccgagggaacggggctggaatacgattgggaagtggtctctacataggtggaggttcctattacaggtccgtctctcgaaagngtacgagtcaaccatatctcnggacncgtccagactaatctacgttttccagtaagactgtagttctgtacgtaccgccgtctcggtaacgacgggttacgtttaattaaccgtggttcggacggtacgaaggtacggtacttatttaacgttggtttaacgtttttgggacgttggttttacttacgactaccgtagtactcggtacgggtctaccgtcccggtgggaccgtaaggtacgtccgtaggttccctacgtccttccgtacgtccctaccg

SEQ ID NO: 141279 - DNA, 722 bp, Homo sapiens
  misc_feature: GYAE6OF02IBE05.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctggggtccggcagctccagggagggctggaatacattggaagtgtctctcagtagtggaggttcctattacagtccgtctctcaagagtcgagtcaccatatctctggaccacgtccagcaatctacgttttcccagtaacgtatgtagttcgtgtcgacccgccgtcgtacggacgtacgggtcgttttaacttacgtggttcggacgtaggaaggtacggacttaagtttagttgttaagtttttgggtaggtttaggttttacgtttaccgtaacctaccccgttaaggaacgttcggggaaccgggggtcctacccgggtaccccgttcggggggacccaacgggggtaacttaccggttacgggttccgtaaccggttccgttacccgtttaccgtaccccgttacccgaacccggtaaccgggtacccctaacggttccccggtttcccgtttccccccggttacggtcccctaacccccgtttaccccctacgtaaccggtaccggtaaccccg

SEQ ID NO: 141280 - DNA, 598 bp, Homo sapiens
  misc_feature: GYAE6OF02JK95C.46.67.G01.1.454.CMB.1.raw
  modified_base (194)..(194): a, c, t, g, unknown or other
  misc_feature (194)..(194): n is a, c, g, or t
  modified_base (388)..(388): a, c, t, g, unknown or other
  misc_feature (388)..(388): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggagacngtgccaccatccacttgccgggcaagtcggaacattgaccacctatttaaattggtatcaacatagaccaagggaccgcccctaagctcctaatctatgctgctatccagttttcgacaaaggtcggggtccctaagtcgtacggttcaggtcgacgagtggaatcgtagggcacggatttcactctacacctntaccgagtactctcgacaacgtcgaagtatttagactaacttattacttgtactaatacgaattaccaagtttacgtttccggtaaccgtaagggtacctaacggtaaccttaaacgtaaacttaaacgtaaactaggttaacgcgttacgacgtaccgaattacgtcgttacttactacgttccttacccgcctacgttacctgtaacg

SEQ ID NO: 141281 - DNA, 749 bp, Homo sapiens
  misc_feature: GYAE6OF02HQE72.46.67.G01.1.454.CMB.1.raw
  modified_base (212)..(212): a, c, t, g, unknown or other
  misc_feature (212)..(212): n is a, c, g, or t
  modified_base (326)..(326): a, c, t, g, unknown or other
  misc_feature (326)..(326): n is a, c, g, or t
  modified_base (355)..(355): a, c, t, g, unknown or other
  misc_feature (355)..(355): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagacccctgtccctcacctgcgctgtctctggtncctccatcagtagtggtttcttcgtggggctgggtccgcagctccgagggagggctggaatacgattggaagtgtctctcagtagtggaggttcctattacgagtccgtctctnaagtagtcgagtcacatatctctaggacncgtccagctaactcgtacgttttcccaggtaatagtcgtagttcgttggtccgaaccccggtccggtaccgttacggtaacccgtaccggggtacgttttttaacgttaccgttgggttacggtaccgaaggtacgggaaccgggtactttaaagtttacgttagggtttacgtttttttaggggaggttttagggttttaacttttaccggtaaacccgttaaccccgttaaggttaaccgttaccggggacccggggggttcccttacccggggtaacccccgggttcgggggtacccggtaaacgggggtaaaccgtttaaccgggtccgggtttacccggaccccggttttaccgtttaccccgtttaccggtcccccgttaacccccgg

SEQ ID NO: 141282 - DNA, 666 bp, Homo sapiens
  misc_feature: GYAE6OF02GFFYN.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccggcagctccgagggaagggctggaatacattggaagtgtctctcatagtggaggttcctattacagtccgtctctcaagagtcgagtcaccatactctctggacacgtccagcaatctagttttcccagaagtatgtacgttctgtcgacccgtccggtctacggaccgacgggttctttacgttacgttggtcgacggtaggacggacggtactttaagttagttcgtttaagtttttagggtacgttttagggtttaaccttttacggaaccctaccgttaagtacggttaccgggtaccggggttcctacccgggttaaccccgggtacggggtacccggtaagggtaacgttaccggtaccggttacccgtacccggttacccgtttacccgttaccggaccccttaaccccggg

SEQ ID NO: 141283 - DNA, 543 bp, Homo sapiens
  misc_feature: GYAE6OF02HXYFJ.46.67.G01.1.454.CMB.1.raw
  modified_base (216)..(216): a, c, t, g, unknown or other
  misc_feature (216)..(216): n is a, c, g, or t
  modified_base (254)..(254): a, c, t, g, unknown or other
  misc_feature (254)..(254): n is a, c, g, or t
  modified_base (357)..(357): a, c, t, g, unknown or other
  misc_feature (357)..(357): n is a, c, g, or t
  modified_base (386)..(386): a, c, t, g, unknown or other
  misc_feature (386)..(386): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggcctttcggagacccctgtcccctcacctgcgcctgtctctggtcncctccatcagtagtgtttctcgtggggctgggtccggnaggctcccgagggaaggggctgggaatacagttggaagttgtctctcatagtggaggttcctagttacagtccgtctctcaagagtcgagtcaccatatcctntggacacgtccagcaatctagttttcccngaacgatgagttctagtgaccgcgctgacgacggtacgtttattacgtgtgtcgagagacgctatatgtatttgagtgttattgactactagtacgtcgacggggtctcggccctcgggcacgggaactacgtcgtcaccgtctcttacgcctaccg

SEQ ID NO: 141284 - DNA, 561 bp, Homo sapiens
  misc_feature: GYAE6OF02HC30U.46.67.G01.1.454.CMB.1.raw
  modified_base (210)..(210): a, c, t, g, unknown or other
  misc_feature (210)..(210): n is a, c, g, or t
  modified_base (304)..(304): a, c, t, g, unknown or other
  misc_feature (304)..(304): n is a, c, g, or t
  modified_base (543)..(543): a, c, t, g, unknown or other
  misc_feature (543)..(543): n is a, c, g, or t
tcagactagcagtacacgaccggtgctcgatttagagtatacatagttgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccgnagctccgagggagggctggaatacattggaagtgtctctcatagtggaggttcctattacagtccgtctctcagagtcgagtcaccatatctcnggcacgtccagcaatcagttttcccctgaacgatgagttctgtgaccgccgctgacgacgggtcgttttatactgtgcgagagacgctatatgtatttttggagttggttatttcgtactaccctagatcgacggggctcgcccgtggggccagggactacgtcgtcaccgtcctccttacgcctccgaccgaacggtcccacttaccggtccttccccgtcggaccctacccttcccncccgtaacgacgtacccg

SEQ ID NO: 141285 - DNA, 514 bp, Homo sapiens
  misc_feature: GYAE6OF02GHR02.46.67.G01.1.454.CMB.1.raw
  modified_base (511)..(511): a, c, t, g, unknown or other
  misc_feature (511)..(511): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctcctaatctatgctgcatccagtttgcaaagtggggtcccatcgaggttcagtgcagtggatctgggacagatttcgactctcaccatcagtaatctgcaacgtgaagattttgactaacttattactgtacaacagaattacaattgttttacggactaagggacacgactaacaaattaaacgaactagtgactgacaactatctagtcttcatccttcccgacctatctntac

SEQ ID NO: 141286 - DNA, 618 bp, Homo sapiens
  misc_feature: GYAE6OF02GIVUO.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccgtgggagacagtgtcaccatcacttgccgggcaagtcggaacattgacacctatttaaattggtatcaacatagaccagggacgcccctaagctcctaatctatgctgcatccagtttgcaaaggtcggggtcccagtcgaggttcagtggcaggtggatcgtgggacagtatttcacttctcaccatcagtatctgacaacgtgaagtattttgactaaactttattacttagtactaaactagtaaattaactaagttcggttttaccggaccgtaaacggggtaacctaacggtaaccgttaaacgtaaaaactttaaaaccggaaacgtttaggtacggtacttacggacctaaccgtaattccgttacgtttacctttacctaacgtttcccgttaccccgtacccttaacttcccgtagttaaccg

SEQ ID NO: 141287 - DNA, 570 bp, Homo sapiens
  misc_feature: GYAE6OF02GNCNS.46.67.G01.1.454.CMB.1.raw
  modified_base (212)..(212): a, c, t, g, unknown or other
  misc_feature (212)..(212): n is a, c, g, or t
  modified_base (321)..(321): a, c, t, g, unknown or other
  misc_feature (321)..(321): n is a, c, g, or t
  modified_base (325)..(325): a, c, t, g, unknown or other
  misc_feature (325)..(325): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggcccttggagaccctgtcccctcacctgcgctgtctctggtncctccatcagtgtgtttctctgggctgggtccgcagcctccgagggagggctggaatacagttggaagtgtctctcatagtggtaggttcctattacagtccgtctctnaagngtcgagtcacatatctctgacacgtcagcaatctacgttttccagaagtatgtagttctaggtcgaccgcgtctgacgtacgggtcgtttattactgtgcgagagacgtatagttagtgttagttttggagtttggttactttcgactacctaggacgtcgggacggggtcctccggtacccggtggggaccgaagggtaactacggtcggtaccgtaccgttccgttccttacgccctaccccg

SEQ ID NO: 141288 - DNA, 587 bp, Homo sapiens
  misc_feature: GYAE6OF02GKL93.46.67.G01.1.454.CMB.1.raw
  modified_base (362)..(362): a, c, t, g, unknown or other
  misc_feature (362)..(362): n is a, c, g, or t
  modified_base (377)..(377): a, c, t, g, unknown or other
  misc_feature (377)..(377): n is a, c, g, or t
  modified_base (389)..(389): a, c, t, g, unknown or other
  misc_feature (389)..(389): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaagggctggaatacagttggaagtgtctctcatagtggaggttcctattacagtccgtctctcaagagtcgagtcaccatatctctggacacgtccagcaatcagtttcccagaagatgagttctgtcgaccgcgctgacncggtctttatactgngcgagagacggntattatgtattttggtagtgttatttacgactacctagtactcggacgggctccggacccgtggggcctaaggggaacttacgtggtcctaccgtaccgtcgttaccgccctaccgaccgaacgggtccctacgttcccggttccgtttacccccgtcggtacccgtaccccttccctacccgtacggaccgtacccg

SEQ ID NO: 141289 - DNA, 595 bp, Homo sapiens
  misc_feature: GYAE6OF02JJ998.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggagacagtgtcaccatcacttgccgggcaagtcggaacattgacacctatttaaattggtatcaacatagaccagggacggcccctaagctcctaatctatgctgcatccagtttgcaaagtcggggtcccatcgaggttcagtggcagtggatctagggacaggtatttcgacttcgtacaccgatcagtaactctcgctaaacgtgaaagtattttacgactaaacgtttattactcgtacaactagtaacttaactaattgttttaccggaccgtaaaggggtaacctaacgtaacttaaacctaaaagttaaaaccgaacttagtacggtacttagaccgtaacctattccgtacgttccttactaccttccgttacccgaccctagttaccgtagttaaccg

SEQ ID NO: 141290 - DNA, 554 bp, Homo sapiens
  misc_feature: GYAE6OF02GOINR.46.67.G01.1.454.CMB.1.raw
  modified_base (334)..(334): a, c, t, g, unknown or other
  misc_feature (334)..(334): n is a, c, g, or t
  modified_base (394)..(394): a, c, t, g, unknown or other
  misc_feature (394)..(394): n is a, c, g, or t
  modified_base (480)..(480): a, c, t, g, unknown or other
  misc_feature (480)..(480): n is a, c, g, or t
  modified_base (489)..(489): a, c, t, g, unknown or other
  misc_feature (489)..(489): n is a, c, g, or t
  modified_base (547)..(547): a, c, t, g, unknown or other
  misc_feature (547)..(547): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttcccngaagatgagttctgtgacccgccgctgacacgggcttttattactgtgcgagagacggtntattatgtattttggagttggttatttcgactacccttagatcggacggggtctccggccccgtggggcccgagggatactggtcncgtctcctncctccaccgaggccctagtccggttcttccccctggcctaccccgtcctaccgaacgngtacccg

SEQ ID NO: 141291 - DNA, 577 bp, Homo sapiens
  misc_feature: GYAE6OF02I5AEL.46.67.G01.1.454.CMB.1.raw
  modified_base (335)..(335): a, c, t, g, unknown or other
  misc_feature (335)..(335): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgagggaaggggctggaatacattggaagtgtctctcatagtggaggttcctattacagtccgtctctcaagagtcgagtcaccatatctctggacacgtccagcaatcagttttcccngaacatgagttctgtgaccgcgctgacgcgggtcgtttatactgttgcgagagacggctattatgtatttttggagttggttatttcgactaccctagacgtcggacggggtctccgaccccgtggggccagggtactacgtcgtcgaccgttctccttacgtcctccaccggaacgggtcccagtcccggttcccttcccccgtcggcctaccccgttccctccgaacggtacgtaccccg

SEQ ID NO: 141292 - DNA, 552 bp, Homo sapiens
  misc_feature: GYAE6OF02FMJF7.46.67.G01.1.454.CMB.1.raw
  modified_base (333)..(333): a, c, t, g, unknown or other
  misc_feature (333)..(333): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagaccctgtccctcacctgcgctgtctctggtgcctccatcagtagtggtttcttctggggctgggtccggcagctcccagggagggctggaatacattggaagtgtctctcatagtggaggttcctattacagtccgtctctcaagagtcgagtcaccatatctctggacacgtccagcaatcagttttcccngaagatgagttctgtgaccgccgctgacacggggctttattactgtgcgagagacggctattatgtatttttggagttggttatttcgacaccctagatcggacggggctcgaccccgtggggccgagggaactacgtggtcaccgtctccttagcctccaccgaacgggcccagtccggtccttccccgtcggccacccctcctaccacgagtacccg

SEQ ID NO: 141293 - DNA, 562 bp, Homo sapiens
  misc_feature: GYAE6OF02F90M8.46.67.G01.1.454.CMB.1.raw
  modified_base (380)..(380): a, c, t, g, unknown or other
  misc_feature (380)..(380): n is a, c, g, or t
  modified_base (427)..(427): a, c, t, g, unknown or other
  misc_feature (427)..(427): n is a, c, g, or t
  modified_base (436)..(436): a, c, t, g, unknown or other
  misc_feature (436)..(436): n is a, c, g, or t
tcagactagcagtacacgaccggtgctcgatttagagtatacatattgggtttgggggacctcctgtgcaagaacatgaagcacctgtggtttgtcctcctgctggtggcaactcccacgatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgaggggaaggggctggaatacattggaagtgtctctcataggtggaggttcctattacagtccgtctctcaagagtcgagtccaccatatctctggacacgtccagcaatctagttttcccngaagatgattctgtgacccgcgctgacacgggtctttattactgtgngagagacgnttattatgtagttttggagttgttatttcgactaccctagacgtcggtaccggggctccgacccggtggggacctaagggaacttcgtggtccctaccgttcctccgttacgccctcccaacccgg

SEQ ID NO: 141294 - DNA, 552 bp, Homo sapiens
  misc_feature: GYAE6OF02JT53Z.46.67.G01.1.454.CMB.1.raw
  modified_base (289)..(289): a, c, t, g, unknown or other
  misc_feature (289)..(289): n is a, c, g, or t
  modified_base (397)..(397): a, c, t, g, unknown or other
  misc_feature (397)..(397): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacaccttatttaaattggtatcaacatagacagggacgcccctaagctcctaatctangctgcatccagtttgactaaagtcggggtcccagtcgaggttcagtggcaggtgatcgtgggacagtattcactctaccacatcagtaatctagactaacgtgtaatnttttagactaacgttattacctagtactaacagtaactataattggtttacgacaaggtactaacggtactaaactaaagttaaactaacgtagtacgactacgacacctattcctgttacttctacgttctaccccgtctactacttagtaacc

SEQ ID NO: 141295 - DNA, 604 bp, Homo sapiens
  misc_feature: GYAE6OF02IHOGH.46.67.G01.1.454.CMB.1.raw
  modified_base (335)..(335): a, c, t, g, unknown or other
  misc_feature (335)..(335): n is a, c, g, or t
  modified_base (340)..(340): a, c, t, g, unknown or other
  misc_feature (340)..(340): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctccagggaggggctggaatacattggaagtgtctctcatagtggaggttcctattacagtccgtctctcaagagtcgagtcaccatatctctggacacgtccagcaatctacgttttcccngaagntgagttctagtgaccgcgctgactacgggtcgttttattactgtgcgagacggacggctattatgttagttttggagttggttattcgactaccctagacgttcggacggggtctccggacccgtggggcccgtaaggggaacttacgtcggtaccacccggttctaccgttacgccctccgaacccgtaacgggcccctaaggttcccggttacccttcccccgtcggccctaccccttcccgtaccgtaacggcgtaccccg

SEQ ID NO: 141296 - DNA, 605 bp, Homo sapiens
  misc_feature: GYAE6OF02IRSHE.46.67.G01.1.454.CMB.1.raw
  modified_base (321)..(321): a, c, t, g, unknown or other
  misc_feature (321)..(321): n is a, c, g, or t
  modified_base (382)..(382): a, c, t, g, unknown or other
  misc_feature (382)..(382): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagacccctgtccctcacctgcgctgtctctggtgcctccatcagtagtggtttcttcgtggggctgggtccgcagcctcccgagggagggctggaatacattggaagtgtctctcatagtggaggttcctattacagtccgtntctacaagtagtcgagtcaccatactctctggacacgtccaggctaatctacgttttcccngaacgtatgtacgttctgtcgaccgcgctgcgacgggtcgtttattacgtgtgcgagacgacgtctattatgtagtttttaggtagttcggtttattaccgtactacccgttaagcgttacggaccgggggtctcccgggaaccccggtcggggtaccggtaacgggaacgttccggtacgggtccctaccggttcccttcccggttacgtcccgtaaccccg

SEQ ID NO: 141297 - DNA, 622 bp, Homo sapiens
  misc_feature: GYAE6OF02IH8DL.46.67.G01.1.454.CMB.1.raw
  modified_base (347)..(347): a, c, t, g, unknown or other
  misc_feature (347)..(347): n is a, c, g, or t
  modified_base (389)..(389): a, c, t, g, unknown or other
  misc_feature (389)..(389): n is a, c, g, or t
tcagactagcagtacacgaccggtgctcgatttagagtatacatattgggtttgggggagtctcggtcaggacacagcatggacatgagggtccccgctcagctcctggggctcctgctactctggctccggaggtgccagatgtgacatcgagctgacccagtcctccatccctccctgtctgacaaccggtgggagacagtgtcaccatcacttgccgggacaaggtcggaacattcgaacaccttatttaaattggtatacaacatagacgaggaccggaccctaagctacctaatctatgctgcatcctagttgactaaaggtcgggaccagtcggtaggttnaggtggctaggtgatcgtagggaacaggtactttcacttccncacctatactaacgtaactcgtagaccgtaaagtgtaaagttatttacgacttaaactttacttacgtacgtaacaaactaagtaactttaacaagtttcggtttaccggaaccgtaagggaacctaacggtaaccttaaataaaacggttaaaacgtacgttagtacggtactacgacctaacgattacgtacgttactacttactcccgttcccgactacttcgacgtaac

SEQ ID NO: 141298 - DNA, 602 bp, Homo sapiens
  misc_feature: GYAE6OF02I4XFO.46.67.G01.1.454.CMB.1.raw
  modified_base (192)..(192): a, c, t, g, unknown or other
  misc_feature (192)..(192): n is a, c, g, or t
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggnaagtcggaacattgacacctatttaatgtatcaacatagaccagggacgcccctaagctcctaatctatgctgcatccagtttgactaaagtcgggtcccagtcgaggttcagtggcagtggatcgtgggacagtatttcgactctcacatcagtaatctagcaagtgaagtatttgactaacttattactgtacaactaagtaattaacaagtttgttttaccggaccgtaaagggtacctaaaccggtaacttaaacgtaaaatttaaacgttagtaacgttacggttaggaccgttacggaccctaaccgtacgttaccgttacgtttacctttacgtacctttacccgttacccccgaacccgttacttacccgttaacgg

SEQ ID NO: 141299 - DNA, 579 bp, Homo sapiens
  misc_feature: GYAE6OF02GIT3E.46.67.G01.1.454.CMB.1.raw
  modified_base (287)..(287): a, c, t, g, unknown or other
  misc_feature (287)..(287): n is a, c, g, or t
tcagactagcagtacacgaccggtgctcgatttagagtatacatattgggtttgtcctcctgctggtggcagctcccagatgggtcctgtccctggtgcaactgcaggagttgggcccacgactggtgaggccttcggagaccctgtccctcacctgcgctgtctctggtgcctccatcagtagtggtttcttctggggctgggtccggcagctcccgagggagggctggaatacattggaagtgtctctcatagtggaggttcctattacagtccgtctctcaagngtcgagtcaccatatctctggacacgtccagcaatctacgttttcccagaagtatgagttctgtacgacccgccgctcgacgtacggggtcttttaatacgtgtgcgagacggacgtctattatgttagttttggagttggtttattccgactacccgtagagtcgggacggggtcctccggacccggtcggggaccgagggtaactacgtcgtcaccgttctccttacgccctccaccgaacggccctagtccgtccttccccgtgccctaccctcctaccacgcgtcccg

SEQ ID NO: 141300 - DNA, 681 bp, Homo sapiens
  misc_feature: GYAE6OF02G0RPB.46.67.G01.1.454.CMB.1.raw
  modified_base (194)..(194): a, c, t, g, unknown or other
  misc_feature (194)..(194): n is a, c, g, or t
  modified_base (219)..(219): a, c, t, g, unknown or other
  misc_feature (219)..(219): n is a, c, g, or t
  modified_base (229)..(229): a, c, t, g, unknown or other
  misc_feature (229)..(229): n is a, c, g, or t
  modified_base (283)..(284): a, c, t, g, unknown or other
  misc_feature (283)..(284): n is a, c, g, or t
  modified_base (290)..(290): a, c, t, g, unknown or other
  misc_feature (290)..(290): n is a, c, g, or t
  modified_base (326)..(326): a, c, t, g, unknown or other
  misc_feature (326)..(326): n is a, c, g, or t
  modified_base (370)..(370): a, c, t, g, unknown or other
  misc_feature (370)..(370): n is a, c, g, or t
  modified_base (379)..(379): a, c, t, g, unknown or other
  misc_feature (379)..(379): n is a, c, g, or t
tcagactagcagtacacgaccggtgctcgatttagagtatacatattgggtttggggtagtctcggtcaggacacagcatggacatgagggtcccgctcagctcctggggctcctgctactctggctcggaggtgccagatgtgacatcgagctggacccagtctccatcctccctgtctgacaaccgtggganacagtgtcaccatcattcgccgggnaagtcggaanttgacactattaaatggtatcaacatagacaggacgccctaagctctaatctannctgacnctacagtttgacaaggtcgggtaccagtcgtagttnaggttgactaggtagatcgtagggacaggtactttccaagttcncgaaacctntactacgttaatcgttacgacgtaacggtagtaaaggttacttttacggtaactaaactttagttaccttacgtaaccgtaaacgtaacgttaaagttaacctaaagttttacggttttaaccggaaccggttaaacgggtaacgttacgtaaaccgggttaacttaaaacgtaaaaacggttttaaaaccgaaacgtttggttacggtaaccgtttacggaacctaaaccgttagtttaaccgtacgtttacccgttaaccttacgttacccgttacccccgacgttaccttccgttaacg

SEQ ID NO: 141301 - DNA, 613 bp, Homo sapiens
  misc_feature: GYAE6OF02JAUU4.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacactatttaaatgtatcaacatagaccagggacggacccctaagctacctaatctatgctgcatccagtttgcaaagtcgggtccagtcgtaggttcagtggcagtggatcgtagggacagtattcactctacactatctagtaactctgacaagtagtaagtatttagactaacttatactagtacaaagtacgtaattaactagttacgttttacggaccgtaacgggtaacctaaccggtaacttaaaccgtaaaagttaaaaccggaaacgttacggtaacgggtaccttacggtaaccctaacccgtaacttaccgttacttaccgtttacctaacctttcccgttaccccgtacctaacttaccgtacgttaacc

SEQ ID NO: 141302 - DNA, 567 bp, Homo sapiens
  misc_feature: GYAE6OF02JKTPZ.46.67.G01.1.454.CMB.1.raw
  modified_base (333)..(333): a, c, t, g, unknown or other
  misc_feature (333)..(333): n is a, c, g, or t
  modified_base (479)..(479): a, c, t, g, unknown or other
  misc_feature (479)..(479): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggagggctggaatacattggaagtgtctctcatagtggaggttcctattacagtccgtctctcaagagtcgagtcaccatatctctggacacgtccagcaatcacgttttcccngaagatgagttctgtgaccgcgctgacgacgggtcgttttatactgtgcgagagacggctattatgtagttttggagttggttatttcgactaccctagactcggacggggctccggacccgtgggcctagggaattacgtgtccnccgtctccgttacgcctaccgaccgtaacgggccctagtccggttccttccccgtcggccctaccccttcctacccgagtcgtacccg

SEQ ID NO: 141303 - DNA, 661 bp, Homo sapiens
  misc_feature: GYAE6OF02I50FI.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctacctaatctaatgctagcactccagtttgacaaagtcggggtcccaatcgaggttcagtggacaggtggatcgtgggacaggattcactctcgacctatacaagtaatcctagtacaacggtgaaacgtagtttttcgacttaaactttactttacgtacgttacaaacgtaacgtaatttaaactaaacgttttcgggtttaacccggtaacccggtaaacggggtaaaccgtaagttaaacccttaaagtaaaaaccgtttaaaaccgaaacgttacgtacgggttacctaggtacccgtaacccgttaacttaccgtagttacctttactacgttttaccccgtttacccccggacctttactttacccgtagttaaccg

SEQ ID NO: 141304 - DNA, 512 bp, Homo sapiens
  misc_feature: GYAE6OF02FY457.46.67.G01.1.454.CMB.1.raw
  modified_base (502)..(502): a, c, t, g, unknown or other
  misc_feature (502)..(502): n is a, c, g, or t
  modified_base (509)..(509): a, c, t, g, unknown or other
  misc_feature (509)..(509): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgcccctaagctcctaatctatgctgcatccagtttgcaaagtgggtcccatcgaggttcagtgcagtggatcgtgggacagtatttcactctcaccatcagtaatctgcaacgtgaagtattttgactaacttattactgtacaacagtaattacaattgtttacggacctaagggacacgtactaacaaattaaacgaactagtcgctgcacatctgtcttcattccttcccnctatctntac

SEQ ID NO: 141305 - DNA, 596 bp, Homo sapiens
  misc_feature: GYAE6OF02IQLXP.46.67.G01.1.454.CMB.1.raw
  modified_base (171)..(171): a, c, t, g, unknown or other
  misc_feature (171)..(171): n is a, c, g, or t
  modified_base (366)..(366): a, c, t, g, unknown or other
  misc_feature (366)..(366): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttctcgtggggctgggtccggcagctccgagggagggctggaatacagttggaatgtctctcatagtggaggttcctattacagtccgtctctcaagagtcgagttcaccatatctctggacacgtccagcaatctagttttcccagaacgatgtaagttctgtcgaccgcgctgacncggtctttattacgtgtgcgagacgacgtcgttattatagttagttttaggagttggttatttcgacctacccgtagtacgtcggaccggggtctaccggcccggtacgggccgaagggaactacgtggtaccgaccgttctccgtacgtcccgtaccgaccgaacggtccctacgttccggtcccttccccgtacgtccctacccgttccctacccgacgacgtacccg

SEQ ID NO: 141306 - DNA, 574 bp, Homo sapiens
  misc_feature: GYAE6OF02G3OCV.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctgggctgggtccggcagctccgagggaagggctggaatacattggaagtgtctctcatagtggaggttcctattacagtccgtctctcaagagtcgagtcaccatatctctggacacgtccagcaatctagttttcccagaacgatgagttctgtcgaccgtcgctcgacgtacgggtctttatacgtgtcgcgagagacggcttattagtgtagttttggagttgttattcgactacccgtagactcggacgggtctccggtacccgtgggaccgaggtaactcgtggtacctaccgtctccgttacgcctaccgaccgaacggtcccacgtccggtacccttccccgtcggccctacccgtccctaccacgctacccg

SEQ ID NO: 141307 - DNA, 500 bp, Homo sapiens
  misc_feature: GYAE6OF02GK9YD.46.67.G01.1.454.CMB.1.raw
  modified_base (497)..(497): a, c, t, g, unknown or other
  misc_feature (497)..(497): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagtattttgcaacttattactgtcaacagaatacaatgtttcgccaagggacaacgactacaaattaaacgaactgtagctgcacatctgtcttcactcttcccgctatctntac

SEQ ID NO: 141308 - DNA, 552 bp, Homo sapiens
  misc_feature: GYAE6OF02IU5NX.46.67.G01.1.454.CMB.1.raw
  modified_base (336)..(336): a, c, t, g, unknown or other
  misc_feature (336)..(336): n is a, c, g, or t
  modified_base (392)..(392): a, c, t, g, unknown or other
  misc_feature (392)..(392): n is a, c, g, or t
  modified_base (488)..(488): a, c, t, g, unknown or other
  misc_feature (488)..(488): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgagggccttcggagaccctgtccctcacctgcgctgtctctggtgcctccatcagtagtggtttcttctggggctgggtccggcagctcccgagggaaggggctggaatacattggaagtgtctctcatagtggaggttcctattacagtccgtctctcaagagtcgagtcaccatatctctggacacgtccagcaatcagttttcccngaagatgagttctgtgaccgcgctgacacgggcgtttatactgtgcgagagacggntattatgtattttggagttgttattcgactaccctagagtcgacggggtctccgacccgtggggccagggatacgtgtcaccgtctccgtacgccnccaccgaacggcccagtccggttcccttccccgtcgccctaccctcccgtaccacgcgtacccg

SEQ ID NO: 141309 - DNA, 594 bp, Homo sapiens
  misc_feature: GYAE6OF02JCXRZ.46.67.G01.1.454.CMB.1.raw
  modified_base (227)..(227): a, c, t, g, unknown or other
  misc_feature (227)..(227): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtgggagacagtgtcaccatcacttgccgggcaagtcggaacnttgacacctatttaatgtatcaacatagaccagggacgcccctaagctcctaatctatgctgcatccagtttcgactaaaggtcggggtacccagtcgtaggttcaggtcggcagtggatcgtgggacaggtatttcactctacactatactagtaatcgtagactaaacggtgtaagttattttacgactaacttattactgtacaactaagtaattaactattacgtttacggacctaaagggacctaacgtaactaaactaaaacgttaaaccgtaacgtagtaggacttagaccgtaacctacgttacttcgttaccttaccttaccttcccgttaccccgtacctaacttccgtattaaccg

SEQ ID NO: 141310 - DNA, 605 bp, Homo sapiens
  misc_feature: GYAE6OF02F8M1T.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccggcaagtcggaacattgacacctatttaaattggtatcaacatagaccagggaccgcccctaagctcctaatctatgctgcatcctagtttgacaaaggtggggtcccagtcggtaggttcaggtggcagtggatcgtgggacagtatttcactctcacatcagtaatctagacaacgtgaagtattttagactaacttattactgtacaactagtaattactaatttcgttttccggaaccgtaacgggtaacctaacggtaacttaaacgtaaaattaaaaccgtaaacgttacggttacggtacgtacgaccgtaaccctacgtttaccgtagtttacctttacgtactttccccgttaccccgtaccctaacgtttccgtacgtaacg

SEQ ID NO: 141311 - DNA, 538 bp, Homo sapiens
  misc_feature: GYAE6OF02HA0EL.46.67.G01.1.454.CMB.1.raw
  modified_base (326)..(326): a, c, t, g, unknown or other
  misc_feature (326)..(326): n is a, c, g, or t
  modified_base (372)..(372): a, c, t, g, unknown or other
  misc_feature (372)..(372): n is a, c, g, or t
  modified_base (439)..(439): a, c, t, g, unknown or other
  misc_feature (439)..(439): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctcatcagtagtgtttctcgtggggctgggtccggcagcctccgagggaagggctggaatacattggaagtgtctctcatagtggaggttcctattacagtccgtctctcaagngtcgagtcaccatatctcgtgacacgtccagcaatcagttttcccngaagatgagttctgtgaccgcgctcgacgacgggtcgtttacttactgtgcgagaggacgtctattntgtattttggagttgttatttcgtactacctagatcggtacggggctcggcccgtggggaccgaggactagtcggtcgaccgtctccttacgcctaccg

SEQ ID NO: 141312 - DNA, 708 bp, Homo sapiens
  misc_feature: GYAE6OF02JEWBT.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaaccatcacgtttggcccgggacaaagtcggaaacattgacaccttatttaaattggtatcaacatagacaggacggccctaagctacaatctatgactgcatcctagtttcgacgaaaggtcggggtacccctagtccggtaggttacgagtggacgtacggtggtatcgttaggggacctaaggtacttttaccgacgttacctaccgtaccctagttaccgaaggtttaaacttccggtacgtaaccgtaaacgggttaggttaaaggttacgtttttacggaccttaaaaactttttacgtttaacgttcggtttaaacaaacgtaaaggtaaacttttaactaaagtttacggtttttaccgggaaccgaaacgggttaaccaacgtaaccgtttaaactaaaacgttaaaaccgtaacgtaggttacgtacgttaggtaccaacctaattcgttacgttacttacgtaccgttccttacccgactacgttactagttaaccg

SEQ ID NO: 141313 - DNA, 592 bp, Homo sapiens
  misc_feature: GYAE6OF02I2F50.46.67.G01.1.454.CMB.1.raw
  modified_base (334)..(334): a, c, t, g, unknown or other
  misc_feature (334)..(334): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtgggctgggtccggcagctcccgagggagggctggaatacattggaagtgtctctcatagtggaggttcctattacagtccgtctctcaagagtcgagtcaccatatctctggaccacgtccagcaatcagttttcccngaacgatgtagttctgtcgacccgccgctcgacacgggtctttattacgtgtgcgagacgacggtctattatgtagttttggagttggttatttcgactacccgttagacgtcggacggggtctccggaccccgtggggacccgtaggggaacttcgtcgtccaccgttccttccgttacgccctccgacccgacgggtcccagttcccggtccctttccccgtggccctaccctcccgtaccgaacgtccgtacccg

SEQ ID NO: 141314 - DNA, 504 bp, Homo sapiens
  misc_feature: GYAE6OF02JG08I.46.67.G01.1.454.CMB.1.raw
  modified_base (494)..(494): a, c, t, g, unknown or other
  misc_feature (494)..(494): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtgatctgggacagattcactctcaccatcagtaatctgcaacgtgaagtattttgcaacttattactgtacaacagtaattacaattgttttacggaccaagggacacgactaacaaattaacgaactgtgctagcactatctgtcttcatcttcccncactctgtac

SEQ ID NO: 141315 - DNA, 583 bp, Homo sapiens
  misc_feature: GYAE6OF02GT0L9.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgcccctaagctcctaatctatgctgctatccagtttgctaaaggtcgggtcccagtcgtaggttcagtggctaggtggatcgtagggacagtatttcactctacaccatacagtatctagacaacgtgaagtatttacgactaacttattactgtacctaactaagtaaattactaagttacgttttaccggacctaaagggtaccaacggtaacctaactaaaacgtaaacgtaactaggtacgacgtagaccgaacctattactcgttactttaccactttcccgttaccccgtactacgttcgtacgtaacg

SEQ ID NO: 141316 - DNA, 582 bp, Homo sapiens
  misc_feature: GYAE6OF02IDB27.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgccctaagctcctaatctatgctgcatccagtttgcaaagtgggtccatcgagttcagtggcagtggatcgtgggacagatttcactctcaccatcagtaatctgacaacgtgaagtatttagactaacttattactgttacaataagtaacttaactaattagttttaccggacgtaaacgggacctaacggtaacttaaacgtaaaacgtttaaacgaacttaggtacggtacttacgacctaaccctagttcctagtttaccttacgttacttacccgtttaccccggacctttaacgttcctacgtaacg

SEQ ID NO: 141317 - DNA, 553 bp, Homo sapiens
  misc_feature: GYAE6OF02F70S2.46.67.G01.1.454.CMB.1.raw
  modified_base (327)..(327): a, c, t, g, unknown or other
  misc_feature (327)..(327): n is a, c, g, or t
  modified_base (351)..(351): a, c, t, g, unknown or other
  misc_feature (351)..(351): n is a, c, g, or t
  modified_base (374)..(374): a, c, t, g, unknown or other
  misc_feature (374)..(374): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccgcagctcccgagggagggctggaatacattggaagtgtctctcatagtggaggttcctattacagtccgtctctcaagngtcgagtcaccatatctctggacncgtccagcaatctagttttcccngaagatgagttctgtcgacccgccgctcgacgacgggtcgtttattacgtgttgcgtagagacgtctattatgttagtttttggagttggttatttcgactacctagagtcggacggggtctccggcccgtcgggaccgaggtaacgtacgtcggtcaccgttctccttagccctaccg

SEQ ID NO: 141318 - DNA, 627 bp, Homo sapiens
  misc_feature: GYAE6OF02H6ZJJ.46.67.G01.1.454.CMB.1.raw
  modified_base (172)..(172): a, c, t, g, unknown or other
  misc_feature (172)..(172): n is a, c, g, or t
  modified_base (285)..(285): a, c, t, g, unknown or other
  misc_feature (285)..(285): n is a, c, g, or t
  modified_base (333)..(333): a, c, t, g, unknown or other
  misc_feature (333)..(333): n is a, c, g, or t
  modified_base (338)..(338): a, c, t, g, unknown or other
  misc_feature (338)..(338): n is a, c, g, or t
  modified_base (356)..(356): a, c, t, g, unknown or other
  misc_feature (356)..(356): n is a, c, g, or t
tcagactagcagtacacgaccggtgctcgatttagagtatacatattgggtttgtccctcctgctggtggcagctcccagatgggtcctgtccctggtgcaactgcaggagtcgggcccacgactggtgaggccttcggagaccctgtccctcacctgcgctgtctctggtncctccatcagtagtgtttcttcgtgggctgggtccgcagctccgagggagggctggaatacattggaagtgtctctcatagtggagttcctattacagttccgtctctcaagngtcgagtcaccatatctctggacacgtccagcaatctacgttttcccngaagntgagttctgtcgaccgcnctgacgtacggtcttttatactgtgacgagagacgcttattatgtagttttggagttggttatttacgactacccgtagtactcgggacggggtcctaccggacccgtcggggaccgaaggggtaacgttaccgtgggttccctacccggttccttcccgttacgcccttcccaacccggtaaccgggtcccctaacggttcccggttaccccgtttacccccgtccgggtaccctaccccccgttcccctaccgaacgtaccgaccccgg

SEQ ID NO: 141319 - DNA, 501 bp, Homo sapiens
  misc_feature: GYAE6OF02G4SFX.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgagttcagtgcagtgatctgggacagatttcactctcacatcagtaatctgacaacgtgaagatttgctaacttattactgtacaacagtaattacaattagttttcgactaagggacacgactaacaaattaaacgaactgtacgctgcacatctgtcttcatcttcccgcatctgtac

SEQ ID NO: 141320 - DNA, 623 bp, Homo sapiens
  misc_feature: GYAE6OF02JIS90.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacacctatttaaatggtatcaacatagaccaggacggccctaagctcctaatctatgactgcatccagtttagcaaagtgggtcccagtcgaggttcagtgcagtggatcgtgggacagtatttcgactctcacctatcataatctagactaacgtagaagtattttcgacttaaacttacttacgttacgtacgtaaactaagtaaatttacgtaaagtttcggttttaccggaccgtaaacgggtacctaaaccggtaacttaaacctaaaacgtttaaaaccggtaaacttggttaacgggtacttacggaaccgtaccctaaagtccgttacgttacctttacaacctttcccgtttaccccggaccctaacgtacccttagtaaccg

SEQ ID NO: 141321 - DNA, 603 bp, Homo sapiens
  misc_feature: GYAE6OF02H0ZKG.46.67.G01.1.454.CMB.1.raw
tcagactagcagtacacgaccggtgctcgatttagagtatacatattggggtttggggagtctcggtcaggacacagcactgggacatggacgggttccccgctcagctcctggggctcctgctactctggcctcgaggtgccaggatgtgacagttcgagctgacctagtctcatctcctgtctgcaaccgtgggagactagtggtcaccgtatcacttggccgggacaagtcggaacagttgactacctattaaatggtatcactatagacctagggaccggtaccctaagcttacctaattctaagtgcgtcgcatacctagtttaggacgtaaaggtcgggtaccctagtcgaggttacgagtacggactaggtaggtaatacgtagggactagtatttcacttctacaaccatactaagtaactctacgactaagtagaagtatttacgactaacttattacttagtactaacaataataactaattagttaccgacgtaaggactaacgaactaaactaaactaaacgtaatagtacgtactacgtacaacgtactatacgtacttactcttaccgttccctacttacttctatacg

SEQ ID NO: 141322 - DNA, 597 bp, Homo sapiens
  misc_feature: GYAE6OF02GR5CC.46.67.G01.1.454.CMB.1.raw
  modified_base (97)..(97): a, c, t, g, unknown or other
  misc_feature (97)..(97): n is a, c, g, or t
  modified_base (226)..(226): a, c, t, g, unknown or other
  misc_feature (226)..(226): n is a, c, g, or t
  modified_base (369)..(369): a, c, t, g, unknown or other
  misc_feature (369)..(369): n is a, c, g, or t
tcagactagcagtacacgaccggtgctcgatttagagtatacatattgggtttggggagtctcggtcaggacacagcatggacatgagggtccccgntcagctcctggggctcctgctactctggctccgagtgccagatgtgacatcgagctgacccagtctccatcctccctgtctgcaaccgtggacacagtgtcaccatcacttgccggacaagtcggaacnttgacacctattaaatgtatcaacatagaccagggaccgccctaagctctaatctatgctgctatcctagtttgacgaaaggtcgggtcccagtcgtaggttcaggtcgcagtgatcgtgggactagtattcactctacactntactagtatcgtgactacgtagtaagtactttgactaacttagtacgttcgtactaacgtagtaacttacgtaagttcgttttaccggacgtaacgggtactaacgtaacttaacgtaaacttaaaccgtaaacgttcggtacggttacgtacgtaccgtaacgtaacgttcgttacgttaccgtttacgacgtttccgtacccggtactaccgttacgtacgtaccg

SEQ ID NO: 141323 - DNA, 694 bp, Homo sapiens
  misc_feature: GYAE6OF02HBNSY.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgagggagggctggaatacagttggaagtgtctctcatagtggaggttcctattacagttccgtctctcaagagtcgagtcaccatatctctggacacgtccagcaatctacgttttcccagaacgtatgtagttctgtcgaccgccgctacgacgtacgggtacttttaattacgtggtcgacggagtacggaaccggtcttaagtttaattggttaagtttttgggtaggtttaggtttatttaccgtaacctacccgttaagtacgtaccgggtaccggggtcctacccggtaccccggtcggggacccgtaaggggtaacttacggttcggtccgtaacccgttccgttacccgttaacggccctaacccgaacccggtaaccgggtccccgtacgttcccggttaccccgtttccccccggtacggtcccctacccccgtccccgttaacccgaacggtacccgtaccccgg

SEQ ID NO: 141324 - DNA, 548 bp, Homo sapiens
  misc_feature: GYAE6OF02GZYZZ.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgagttcagtggcagtgatcgtgggacagtatttcactctcaccatcagtatctgcaagtgaatattttgactaacttattacttgtacaactagtaattacaattgttttacggaccgtaagggtacaacggtaactaaaccgtaaaattaaaccgaacttagtagactggacctaaccattccgtagttacctttcacttccttacccgacctacttcttagtaac

SEQ ID NO: 141325 - DNA, 756 bp, Homo sapiens
  misc_feature: GYAE6OF02JTJ56.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagcctccgagggagggctggaatacgattggaagtgtctctacagtacgtggaggttcctagttacagtcccgtctcgtcaagtgtcgagtcaccatacgtctctggacacgtcgagcaatctacgttttcccagtaaagtatgtaacgtttctggtcgaacccgtccgtcgtacggaaccgtacggggtccttttaagttaccgttgtacggacgagacggacgtcgttaagtttagtaggtttagttttggaggtttaggttactttacggaaccttacccgttaaggtacgttaccggggtacggggtcccttaccggtaccccggttggggaccgtaacggggtaacgttacccgttcgggttaaccgtacccggttaccgtttacccgtttaccggtacccctttaacccggaaccccggtaaccggggtaccccgtaccggttttaccccgggtttacccctttaccccccccggttccggttaacccttacccccccggttaccccgttaacccggtaaccggtaacccgtaccccgg

SEQ ID NO: 141326 - DNA, 533 bp, Homo sapiens
  misc_feature: GYAE6OF02GXY5T.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctctaatctatgctgcatccagtttgcaaaggtgggtcccagtcgagttcagtggcagtggatcgtgggacagtatttcactctcaccatcagtaatctgacaacgtgaagtattttgactaacttatacttgtacaactagtaattacaattgtttacggaccgtaaggtacacgtaacttaactaaattaaacgaacgtgtagctgacctaactatactgtcttacacttccttcccgacctacttctagtac

SEQ ID NO: 141327 - DNA, 601 bp, Homo sapiens
  misc_feature: GYAE6OF02JFJWK.46.67.G01.1.454.CMB.1.raw
  modified_base (405)..(405): a, c, t, g, unknown or other
  misc_feature (405)..(405): n is a, c, g, or t
tcagactagcagtacacgaccggtgctcgatttagagtatacatattgggtttgtcctcctgctggtggctagctcccagatgggtcctgtccctggtgcaactgcaggagtcgggcccacgacgtgggtgaggccttcgggagaccctggtccctcacctgcgctgtctctggtgcctccatcagtagtggtttcttctggggctgggtccggcagcgtcccgaggggaaggggctgggaatacagttggaagtgtctctcatagtggaggttcctattacagtccgtctctcaagagtcgagtcaccatatctctggacacgtccagctaatctagttttcccagaagatgagttctgtcgaccgcgctgaccacgggtctttatacgtgtgcgagagacgtntatatgtagttttggagtggttattcgactacctagtactcggtacggggtccgtccgacccggtgggccgagggtactacgtggtccaccgttcctccgttacgccctaccgacccgtacgggccctacgtcccggttcccgttacccccgtcgggaccctaccccgttccctacccgaaccggtaccgtacccg

SEQ ID NO: 141328 - DNA, 522 bp, Homo sapiens
  misc_feature: GYAE6OF02H0ZNH.46.67.G01.1.454.CMB.1.raw
  modified_base (302)..(302): a, c, t, g, unknown or other
  misc_feature (302)..(302): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaatgtatcaacatagaccagggacggcccctaagctcctaatctatgctgcatccagtttnctaagtgggtcccatcgtaggttcagtggcagtggatcgtgggacagtattcactctcaccatcagtaatctgactaacgtgaagtatttgactaacttattaactgtacaacagtaattacaattgtttaccgacgtaaggacacgactaactaaattaaacgaactgtgactgaccactactctacgtcttctacttccttcccgacctatctagtac

SEQ ID NO: 141329 - DNA, 554 bp, Homo sapiens
  misc_feature: GYAE6OF02G6Y5R.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctcctaatctatgctgcatccagtttgacaaagtcgggtcccatcgaggttcagtggcaggtggatcgtgggacagtatttcactctcaccatcagtaatctgacaacgtgaagtattttgactaacttattacttagtacaaacagtaaattactaatttggttttaccggaccgtaagggacctaacgtaactaactaaaagttaaacgaacgttgtagacgttagaccaactatcttgtacttactacttccttcccgcctacttcctagtacg

SEQ ID NO: 141330 - DNA, 582 bp, Homo sapiens
  misc_feature: GYAE6OF02JBG5I.46.67.G01.1.454.CMB.1.raw
  modified_base (192)..(192): a, c, t, g, unknown or other
  misc_feature (192)..(192): n is a, c, g, or t
  modified_base (349)..(349): a, c, t, g, unknown or other
  misc_feature (349)..(349): n is a, c, g, or t
  modified_base (353)..(353): a, c, t, g, unknown or other
  misc_feature (353)..(353): n is a, c, g, or t
  modified_base (400)..(400): a, c, t, g, unknown or other
  misc_feature (400)..(400): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttcggccgggcaagtcggaacattgacacttatttaaatggtatcaacatagaccagggaccgcccctaagctacctaatctatgctgacactcctagtttagacgaaggtcgggtccagtcgagttcagtgcagtgatgngganagtattcactctcactatctagtaatcgtagactaacgtagaagttntttacgacttaacttagttaactgtaactaactagtaaacttactaagttcgtttaccgacgtaagggtaccaacgtaactaaacgtaaacttaaacgtaacgtgtacgtacttagaccctaacgttattaccgttagttaccttacgtaccttaccgttcccgactacgttctacgtaacg

SEQ ID NO: 141331 - DNA, 845 bp, Homo sapiens
  misc_feature: GYAE6OF02JZ8UJ.46.67.G01.1.454.CMB.1.raw
  modified_base (437)..(437): a, c, t, g, unknown or other
  misc_feature (437)..(437): n is a, c, g, or t
  modified_base (823)..(823): a, c, t, g, unknown or other
  misc_feature (823)..(823): n is a, c, g, or t
tcagactagcagtacacgaccggtgctcgatttagagtatacatattgggtttggggagtctcggtcaggacacagcatggacatgagggtccccgctcagctcctgggggccctctgctactcgtcggtcctaccggtaggtcgaccgagtagtggtacgaactagtcggactcgtaccgaacccgtagttccctacctaccttcccccgtcccgttcgtaccgtcggaacccgtaaccgggggtaggggaacctaaccggtaggtccgttaacccgaacctacttaccgtacggttccgggacccggtacgtaacggtaccggaaattcgttacggaaccttaactttaaagtttaaggttacgtaactaacgaactaagtaacgaccggacggggtacccctaccgtagtcctacgtaatacgtagtcgcgtanactactccgttagtacgaacggtaacgggtccggtaccaggtggtacgtgtacggtcgacgtagggtacgtacgttggacgggactaaggtttacttacccacgttccaccgtaattacctaggtaaacgttacgttaccgacgttaacgttaaacgggtattaaacggttttctaacgttaaacctttaacggtttagtaaccgttaactaaacgtaacctaaaggtttaaactacggtttaaggtttccggtaacggtaccgggaaacgtacgtaacttaaccgtaaaacgtttaaacgtaacggtaacgtgttaaccggtactacgtaacccgtaacggttacttgttacccgttaacgtccgttaaccttcccggtaacccncgttcgtttaacggcttaaccg

SEQ ID NO: 141332 - DNA, 512 bp, Homo sapiens
  misc_feature: GYAE6OF02IW182.46.67.G01.1.454.CMB.1.raw
  modified_base (429)..(429): a, c, t, g, unknown or other
  misc_feature (429)..(429): n is a, c, g, or t
  modified_base (489)..(489): a, c, t, g, unknown or other
  misc_feature (489)..(489): n is a, c, g, or t
  modified_base (503)..(503): a, c, t, g, unknown or other
  misc_feature (503)..(503): n is a, c, g, or t
  modified_base (509)..(509): a, c, t, g, unknown or other
  misc_feature (509)..(509): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacgcccctaagctcctaatctatgctgcatccagtttgcaaagtggggtcccagtcgaggttcagtggcagtggatcgtgggacagtatttcactctcaccatcagtaatctgcaacgtgaagtattttagactaacttattacttgtacaacaagtaacttanaattgtttacgccaaggacacgacttaacaaattaaacgaactgtagctgcaactatctntcttcactcctccncatctntac

SEQ ID NO: 141333 - DNA, 557 bp, Homo sapiens
  misc_feature: GYAE6OF02IL3O8.46.67.G01.1.454.CMB.1.raw
  modified_base (278)..(278): a, c, t, g, unknown or other
  misc_feature (278)..(278): n is a, c, g, or t
  modified_base (341)..(341): a, c, t, g, unknown or other
  misc_feature (341)..(341): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctccgagggagggctggaatacattggaagtgtctctcatagtggaggttcctattacagtccgtntctcaagatcgagtcaccatactctcgtaggcacgtccagcaatcacgttttcccagaaacgntagattctgtgtacccgcgctgacgacgggtctttagtactgtgcgagtagacggtctattatggttaattttggacgttggttattcgactaccttagactcggacgggctacgacccgtgggccagggtactactggtcctacgtccgtcttagcctcacgaacggcctagttcccgtcttccccgtggaccctccctccgtcgaacgctaccg

SEQ ID NO: 141334 - DNA, 543 bp, Homo sapiens
  misc_feature: GYAE6OF02FSDJO.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatcgtgggacagtatttcactctcaccatcagtaatctgcaacgtgaagtattttgactaacttattactgtacaacagaattacaattgtttacgaccgtaagggacaacgtactaaacaaaacttaaacgaacttagtaggtctaggacctaacctattactcgttcttacctacttccttccccgcctactccttgtaacc

SEQ ID NO: 141335 - DNA, 578 bp, Homo sapiens
  misc_feature: GYAE6OF02H6WKC.46.67.G01.1.454.CMB.1.raw
  modified_base (417)..(417): a, c, t, g, unknown or other
  misc_feature (417)..(417): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgagggccttcggagacccctgtccctcacctgcgctgtctctggtgcctccatcagtagtggtttcttcgtggggctggggtccggcagctcccgagggagggggctggaatacattggaagtgtctctcatagtggaggttcctattacagtccgtctctcaagagtcgagtcaccatatctctggacacgtccagcaatcagttttccctgaagtatgtagttctggttcgaccgccgctgacgacggggtcgttttattacgtgtgcggagagacggctattatgtnttttaggagttggttattcgactacccgtagcgtcggacggggtctccggtacccgtggggaccgagggaatacgtggtccaccgttctccgttacgccctaccaccgacggccctagtccggtcctccccgtcgccctaccctcccgtaccacgcgaccg

SEQ ID NO: 141336 - DNA, 930 bp, Homo sapiens
  misc_feature: GYAE6OF02HGZNR.46.67.G01.1.454.CMB.1.raw
tcagactagcagtacacgaccggtgctcgatttagagtatacatattgggtttgggggagtcctcggtccagggactaccagcattggacatgaggtcccgctcagctctgggctcctgctactctgctcgaggttgccagatgtggtactattcgagcttagaccctagtctccatccgtcctgtctgcgtaaccggtgggacggacgagttgtcaccacgtcggtaccttggaccgggactaacggttaccggaactagttcgaacctaccctttaattttaaaagttggttaacttacctaaacctagttacggaaccctaaggggtacccggtaccccttaaaggccttaccgttaaacgtcccgttaactacggtccttcggaaccggtaacggttcccgttagggttttcggaaccggtaaaacggtttccgggggtaaccccttaaagttaccgggttaaggggttttaccaacgggttggggaccgtaagggttcggaaacgttcggtacggggtaaccgtacggtaaccgttttaccgaacggttacccggtacctaacccgttaacctaccgtaaacgtttaaaccgtccggtaaggtaacccgtaaaaccggttacgaaaacggttaaacgttttttaaccggtaaacctttttaacgtttaaccggtacgtttaaaccgaaaccgttaaacgtaaaaacgttttaccgtaaacgttttcgggttttaaccgggaaacccggtaaaggggtacccgaaaccggttaaaccggttaaaacgtaaaaccggttttaaaccgggtaaacgttacggttacggttaccgtacgttacgaaacccctaaggtccgttaggttaccctttaccgaacgtttccccgttacccgtacgttaacgttccggttagtaccgttaccgg

SEQ ID NO: 141337 - DNA, 542 bp, Homo sapiens
  misc_feature: GYAE6OF02H3WKN.46.67.G01.1.454.CMB.1.raw
  modified_base (249)..(249): a, c, t, g, unknown or other
  misc_feature (249)..(249): n is a, c, g, or t
  modified_base (372)..(372): a, c, t, g, unknown or other
  misc_feature (372)..(372): n is a, c, g, or t
  modified_base (376)..(376): a, c, t, g, unknown or other
  misc_feature (376)..(376): n is a, c, g, or t
  modified_base (428)..(428): a, c, t, g, unknown or other
  misc_feature (428)..(428): n is a, c, g, or t
  modified_base (433)..(433): a, c, t, g, unknown or other
  misc_feature (433)..(433): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggcctttggagaccctgtccctcacctgcgctgtctctggtgcctccatcagtagtggtttctctggggctgggtccggnagctcccgagggaaggggctggatacattggaagtgtctctcatagtggaggttcctattacagtccgtctctcaagagtcgagtcacatatctctgacacgtccagcaatctagttttcccngaantgtattctgtgaccgcgctgacgcgggtcgtttattactgtgcgagagacgntattntgtagttttggagttgttatttcgactacctagacgtcgacggggtctaccggcccggttgggccgtaggtactacgtcggtctaccgttctaccgttacgcctacccg

SEQ ID NO: 141338 - DNA, 594 bp, Homo sapiens
  misc_feature: GYAE6OF02IQBBF.46.67.G01.1.454.CMB.1.raw
  modified_base (215)..(215): a, c, t, g, unknown or other
  misc_feature (215)..(215): n is a, c, g, or t
tcagactagcagtacacgaccggtgctcgatttagagtatacatattgggtttgggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccggnaagtcggaacattgacactatttaaatggtatcaacatagaccaggacggcccctaagctcctaatctatgctgcatccagtttgctaaagtcgggtccagtcgtaggttcagtggcagtggactcgtgggacagtattcacgtctacaccatcaagtaatctgacaaacgtgtaagtatttgactaaacttattaactgtacaaactacgtaaacttacaacttggttttaccggaaccgtaagggaactaaccggtaacttaaacaaaacgttttaaaacgaacgttacgttacggacgttacgaccgtaaccgtacttacgtacgttaccttactaacgtttccttaccccggtactacgttacgttacgtaaccg

SEQ ID NO: 141339 - DNA, 598 bp, Homo sapiens
  misc_feature: GYAE6OF02G5Y50.46.67.G01.1.454.CMB.1.raw
  modified_base (363)..(363): a, c, t, g, unknown or other
  misc_feature (363)..(363): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctgggctgggtccgcagctccagggaagggctggaatacattggaagtgtctctcatagtggaggttcctattacagtccgtctctcaagagtcgagtcaccatatctctggacacgtccagcaatctacgttttcccagtaagatgtagttctgtcgaccgcgctgacncgggtctttatactgtgcgagagcgcttattatgttagttttggagttggttatttcgacctacccgtagactcgggaccggggtctcccgacccggtcggggaccgagggaacttacgtcggtcctaccgttccttccgttacgccctaccgacccgaacgggtccctagttcccggttcccgtttccccgtccggtcccctaccccttccccgtaccgtaacgacgtaccccg

SEQ ID NO: 141340 - DNA, 604 bp, Homo sapiens
  misc_feature: GYAE6OF02HN20T.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcacatcacttgccgggcaagtcggaacattgacacctatttaaatggtatcaacatagaccagggacgcccctaagctcctaatctatgctgcatccagtttgcaaagtgggtcccatcgagttcagtggcagtgatcgtgggacagtatttcactctacaccatacagtaactcgtgacaacgtgaagtatttagactaacgttatacttagtacaaactagtaaacttacaagtttcgtttaccggaccgtaaacggggtacaacggtaaccttaaaccgtaaaacgtttaaaaccgaaactttagtacgggtacttacggtacctaaccctattaccgttacgttacctttacctaacgtttcccgttaccccggtaccttaacgtttccgtacgttaaccg

SEQ ID NO: 141341 - DNA, 789 bp, Homo sapiens
  misc_feature: GYAE6OF02IAX8Z.46.67.G01.1.454.CMB.1.raw
  modified_base (255)..(255): a, c, t, g, unknown or other
  misc_feature (255)..(255): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccagtcagtagtggtttcttgtggggctggggtccggcagctcccgaggggaagggctggaatacgagttggaagtgtctntcagtagtggaggttcctattacagtccgtctctacaagacggttcgacgtacaccatatctctaggacaacgtccacgcaaatctaacgtttttccccagaaacgtatcgtaacgtttcctaggttcgaacccggtcccgacttacggacctacgggggtactttttaagttaccgtaggttcgacgacggtaacgacggacgttattacgtaggttaagttttacgggaaggtttgggtttaatttacgggtaacctaaccccgttaagtacgtacgggtaaccggggtccgttacccgggtaccccggtagggggtacccgaaagggggtaacctttaaaccggtcgggttacccggtaacccggttaccgtttacccgggttaaccgtacccccgtttaccgaaaccccgggtaaaccgggtacccccggttaacgttacccgggtttaacccccgtttcccccggttacgggtacccccgtaaccccccgtttaccccgtaccccgtaaccggtacccgtaacccccgg

SEQ ID NO: 141342 - DNA, 630 bp, Homo sapiens
  misc_feature: GYAE6OF02H69SO.46.67.G01.1.454.CMB.1.raw
  modified_base (192)..(192): a, c, t, g, unknown or other
  misc_feature (192)..(192): n is a, c, g, or t
  modified_base (259)..(259): a, c, t, g, unknown or other
  misc_feature (259)..(259): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtcgtcaccatcacttggccgggcaagtcggaacattgacctactatttaaattggtatacaanatagacgaggaccgaccctaagctcctaatctatgctgcatcctagtttgacaaaggttcgggtccagtcggtaaggttcaggtcggacaggtggatcgagggaacagtaactttcaactctaccaccatcgaagtaactcgtagacgtaacgtagaagttatttacgacttaacttattactagtacaaatagttaaattacgaaagtttcggttttaccggaaccgtaacggtaaccgaaccgtaaacttaaaccgtaaaaagttaaaaccgtaacgttaggtacggtactacgtaccgtaaccgtaattaccgttacgttacctttaccgtacttacccgttacccgtactacgttacgtacgtaacg

SEQ ID NO: 141343 - DNA, 586 bp, Homo sapiens
  misc_feature: GYAE6OF02HPX05.46.67.G01.1.454.CMB.1.raw
  modified_base (386)..(386): a, c, t, g, unknown or other
  misc_feature (386)..(386): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccgtgggagacagtgtcaccatcacttgccgggcaagtcggaacattgacacctatttaaatgtatcaacatagaccagggacgcccctaagctctaatctatgctgcatccagtttgcaaagtgggtcccatcgagttcagtggcagtggatcgtgggacagatttcactctcacatcagtaatctgacaacgtgtaagtnttttagactaactttatacttgtacaactagtaaattaactaatttgttttaccggaaccgtaaaggggtaacctacggtaaccttaaactaaaaagtttaaacgaacgttaggtacggacttacgtacctaacctaacttcctacggttacctttactaaccttccctttaccccggaccttaacgttcctagttaacg

SEQ ID NO: 141344 - DNA, 645 bp, Homo sapiens
  misc_feature: GYAE6OF02HWIV6.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggacaagtcggaacattgacacctatttaaattggtatcaacatagacagggacgcccctaagctctaatctatgctgcatccagtttgacgaaaggtcggggtacccatcggaggttcagtggcaggtggatcgtgggaactagtatttcactctacacctatcataatctgactaagtgaagtagtttagactaacttatactacgtacaaactagtaaacttaactaagttcggttttaccgacgtaaacgggtactaacggtaaccttaaacgtaaaaacgttaaaaccggtaaacgtttcgggtacggttaccgtacggtaccctaaaccccgttaacttcccgtttaccgtttacccttttacccttaaccgttccccggttttaacccccggaaccccttaacgtttcccttaggttaaacccg

SEQ ID NO: 141345 - DNA, 621 bp, Homo sapiens
  misc_feature: GYAE6OF02GJFJS.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctcctaatctatgctgcatccagtttgcaaagtgggtcccatcgaggttcagtggcagtggatcgtgggacagtattcactctcaccatcagtaatctgacaacgtgaagtattttgactaacttattactgtacaaactagtaaattactaagttcgttttaccggaccgtaaacgggacctaaacgtaaccttaaacgtaaaaactttaaaaccggtaaacgttacgggttacggtaccgttacggtacccgtaaccgtaactttaccttaaggtttaacgtttaacctaacgtttaccccgttttcccccgtacccgtaacctttaccgttaagttaaccg

SEQ ID NO: 141346 - DNA, 540 bp, Homo sapiens
  misc_feature: GYAE6OF02IKSOV.46.67.G01.1.454.CMB.1.raw
  modified_base (247)..(247): a, c, t, g, unknown or other
  misc_feature (247)..(247): n is a, c, g, or t
  modified_base (331)..(331): a, c, t, g, unknown or other
  misc_feature (331)..(331): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccgcagctccgagggagggctggaatacattggaagtgtctntcatagtggaggttcctattacagtccgtctctcaagagtcgagtcaccatatctctggacacgtccagcaatcagttttcccngaagatgagttctgtgaccgcgctgacgacgggtcgtttattactgtgcgagagacggctattatgtattttggagttggttattcggactacctagatcggacggggctcgacccgtgggccaggatacgtgtcacgtctcctagcctccaccgaggcccagtccggtccttccccgtcggccctacccgtcctaccacgactacccg

SEQ ID NO: 141347 - DNA, 626 bp, Homo sapiens
  misc_feature: GYAE6OF02HPHW1.46.67.G01.1.454.CMB.1.raw
  modified_base (436)..(436): a, c, t, g, unknown or other
  misc_feature (436)..(436): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacgttcggccgggacaaggtcggaacattacgaacctaccttaatttaaagttggtaattacaaactataacgaccgaagggaccgacccctaagccttacctaatctatgctgcatcctagtttcgacgtaaggtcgggtacccagtcgtagttcgaggtcggacgtaggtggtacgtcggtaggactacgtactttacactactaccacctagtacaagttatcgtanacgtaagtagtattatttacacttaacgttactacgtactaacgaacttaagtaacttacgtagttcgtaccggaacgtaacgtacaacgttaactaacgtaaaacgttaacgagttagacgtacgactaccgtaacttactcgttacgttacttacgttacctccttaccgtactacttcgtacttacg

SEQ ID NO: 141348 - DNA, 543 bp, Homo sapiens
  misc_feature: GYAE6OF02JHXS5.46.67.G01.1.454.CMB.1.raw
  modified_base (344)..(344): a, c, t, g, unknown or other
  misc_feature (344)..(344): n is a, c, g, or t
  modified_base (347)..(347): a, c, t, g, unknown or other
  misc_feature (347)..(347): n is a, c, g, or t
  modified_base (416)..(416): a, c, t, g, unknown or other
  misc_feature (416)..(416): n is a, c, g, or t
tcagactagcagtacacgaccggtgctcgatttagagtatacatattgggtttggggagtctcggtcaggacgcagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccaggacggcccctaagctcctaatctatgctgcatccagtttgcaaggtgggtcccatcgagttcagtgcagtgatctggganagnttcactctcacatcagtatctgcaacgtgaagtattttgactaacttattactgtacaatagtaattanattgtttacggaccgtaaggactacgtaacctaataaacttaaacgtaagtagtacgacttacgacctaaccacttactcgttacgtttacctacgttcccgttacccgacctacttacgtagtaac

SEQ ID NO: 141349 - DNA, 536 bp, Homo sapiens
  misc_feature: GYAE6OF02IYOTO.46.67.G01.1.454.CMB.1.raw
  modified_base (373)..(373): a, c, t, g, unknown or other
  misc_feature (373)..(373): n is a, c, g, or t
  modified_base (378)..(378): a, c, t, g, unknown or other
  misc_feature (378)..(378): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccgcagctcccagggaaggggctggaatacattggaagtgtctctcatagtggaggttcctattacagtccgtctctcaagagtcgagtcaccatatctctggacacgtccagcaatcagttttcccngaagntgagttctgtgaccgccgctgacgacgggtcgtttattacgtgtgcgagagacgctattatgtatttttggagttggttatttcgactacctagatcgacggggctcggacccgtgggccagggatacgtcggtctaccgtctccgttagcctacccg

SEQ ID NO: 141350 - DNA, 1060 bp, Homo sapiens
  misc_feature: GYAE6OF02IMQYD.46.67.G01.1.454.CMB.1.raw
tcagactagcagtacacgaccggtgctcgatttagagtatacatattggggtttgtcctcctcgactacggtggcacgtctcccagatgggtccctgtccctggtggactaactgcaggagtccgggcccacgacgtgggtgtaggccttcggagaccctggtccctcacctgccgcgtgtctcgtcggtcgccgttccatcgagttaggttcggttttacgttccggtggggtcgttcggggtcccggacgaacggtaccgtccccggaagggggaacgggggtctagggtaacttaacgtaggttttacgggtaaacgttcggtaccttacgtacctagttaaggtaggggtaacggtttacccttaacgtttaacccaaccggttccccgtccttaccttaccgaaaggtacggttaccgaacggttacccgtaaccccgtagttaacgttccggttcggtacggaaccttaaccggtcctaaggtacctaaaacttccgttaaccgttttttccccgaggtaaacgtacgttacggttacgtttacgtttacggtaccgaacccgtccggtacgtacggaaccgtacggggttaaccgtttttaacgttacccgttaggtctaaccgggggggggggaactaacgggtaaccggtaccgtttaaacgtttacggttaggtttaacgttttttagggtaacgggtttttacggtttaaacgtttttaccggtaaacccggttaaccccggttaaacggtaaccggttaccggggtaaacccgggggggtacccgttacccggggtaaaccccccgggtttacggggggtaaccccggtaaacgggggttaaaaccgttaaccgggttacccgggttaacccgttaacccggttaaccgttttacccgtttaaccggtacccgttaacccggtaacccggtaaccgggttaccccgtaacggtttacccggtttaccccgttttacccccggttacccggttaccccgttaacccgttacccccgtttaacccggtaaccggtacccgtaaccccggg

SEQ ID NO: 141351 - DNA, 571 bp, Homo sapiens
  misc_feature: GYAE6OF02H65JD.46.67.G01.1.454.CMB.1.raw
  modified_base (390)..(390): a, c, t, g, unknown or other
  misc_feature (390)..(390): n is a, c, g, or t
  modified_base (522)..(522): a, c, t, g, unknown or other
  misc_feature (522)..(522): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaatggtatcaacatagaccaggaccggccctaagctcctaatctatgctgcatccagtttgcaaagtgggtccagtcgagttcagtggcagtgatcgtggactagattcactctcacatacagtaactctacgacgtaacgtgtaagtnttttagactaacttattactgttacaactaataattaactaagttcgtttacggaccgaaggtactaacgacttaaactaaaagttaaaccgtaaacgttacggtagtaccgttagaccgtaacctaacttnttacgttctttcctacttcctttaccccgtacctaccttcctagtaacc

SEQ ID NO: 141352 - DNA, 610 bp, Homo sapiens
  misc_feature: GYAE6OF02HBXM0.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagaccctgtccctcacctgcgctgtctctggtgcctccatcagtagtggtttcttcgtggggctgggtccggcagcctcccgaggggaaggggctgggaatacagttaggaagttgtctctcatagtggaggttcctatttacagtccgtctctcaagagtcgagtcaccatatctctggactacgtccagacaatctacgtttttcccagaagtatgtagttctgtcgaccgtccgctcggacgacgggtctttattacgtgtgcgagagacggtattattatgtagttttggtagttgtttatttcgacgtacctagtacgtcggacggggcctaccggacccgtggggcccgaagggacttacgtcgtccgtaccgttcctccgttcgccctaccgaaccggacggtccctacgtcccggttcccttccccgtcggtaccctcccctaccctaccgacgacctacccg

SEQ ID NO: 141353 - DNA, 600 bp, Homo sapiens
  misc_feature: GYAE6OF02G0V5T.46.67.G01.1.454.CMB.1.raw
  modified_base (417)..(417): a, c, t, g, unknown or other
  misc_feature (417)..(417): n is a, c, g, or t
  modified_base (513)..(513): a, c, t, g, unknown or other
  misc_feature (513)..(513): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgccgctgtctctggtgcctccatcagtagtggtttcttcgtggggctgggtccggcagcctcccgaggggaagggtctaggaatacagttggaagtgtctctcgataggtggaggtttcctaattacagtccgtctctcaagagtcgagtcacatatctctggactacgtcagcaactctacgttttccctagaagatagtagttcttgtcgaccgtccgctgacgtacgggtctttatacgtgtcgcgagtacgacggtntattagtagttagttttggaggtttgttacttcgtactaccgtagacgtcgggacgggctccgacccggtcgggaccgaggtactacgtcggtacncgtccttcgtacgtcccgtaccaccgacggtccctacgttccggtcccttcccgtcggccctaccctcccgaccgagaccgtacccg

SEQ ID NO: 141354 - DNA, 623 bp, Homo sapiens
  misc_feature: GYAE6OF02IHFRD.46.67.G01.1.454.CMB.1.raw
  modified_base (192)..(192): a, c, t, g, unknown or other
  misc_feature (192)..(192): n is a, c, g, or t
  modified_base (217)..(217): a, c, t, g, unknown or other
  misc_feature (217)..(217): n is a, c, g, or t
  modified_base (278)..(278): a, c, t, g, unknown or other
  misc_feature (278)..(278): n is a, c, g, or t
  modified_base (286)..(286): a, c, t, g, unknown or other
  misc_feature (286)..(286): n is a, c, g, or t
  modified_base (293)..(294): a, c, t, g, unknown or other
  misc_feature (293)..(294): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggnaagtcggaacattgacaccttatttaaattggtatcaacatagaccagggacgcccctaanctacctanctatgcnncatccagtttgacaaaggtcgggtccagttacggtaggtttcagttggactaggtaggtatcgtagggacagtactttcactcgtcaccgtatcaagtaatcctaggacctaagtgaattatttcgacttaacttattacttagtactaacaggtaacttaacgtaagtttcgttttacggaacccgtaaaggtaccgtaacgtaacttaaacttaaaacgttaaaccgtaaacttggttacgggtcttacggaccctaaccggttaattcccgtaagttaccgtttacaccgtttccgtttaccccacttacgttaccttacgttaac

SEQ ID NO: 141355 - DNA, 580 bp, Homo sapiens
  misc_feature: GYAE6OF02G74KU.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagaccctgtccctcacctgcgctgtctctggtgcctccatcagtagtggtttcttcgtggggctgggtccggcagcctcccgaggggaaggggctggaatacagttgggaagtgtctctcagtagtggaggttcctattacagttccgtctctcaagagtcgagtcacatatctctggacacgtcagcaatctagttttcccagaacgatgtagttctgtcgaccgccgctgacacgggtcttttatacgtgtgcgagagacggctattatgtattttggagttgttatttcgactacctagactcggacgggctcggacccgtgggccgagggactacgtcggtccgacgtctccgttacgccctaccgaccgaacgggcccctaggtccgttcccttccccgtggccctaccccgttccgtaccgaaggtccgtacccg

SEQ ID NO: 141356 - DNA, 584 bp, Homo sapiens
  misc_feature: GYAE6OF02HC0ML.46.67.G01.1.454.CMB.1.raw
  modified_base (192)..(192): a, c, t, g, unknown or other
  misc_feature (192)..(192): n is a, c, g, or t
  modified_base (379)..(379): a, c, t, g, unknown or other
  misc_feature (379)..(379): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccggcaagtcggaacattgacacctatttaaatgtatcaacatagaccaggacggcccctaagctcctaatctatgctgcatccagtttgcaaagtgggtcccatcgagttcagtggcagtggatcgtgggacagatttcactctcaccatcagtaatctgcaacgtnaagtattttagctaaacttattaactgtacaacaagtaacttactaaattgttttacggacctaaacgggtaaccaaccggtaacttaaaccgtaaaagttaaaaccggaaacttaggtacggtacgttagacctaaccctaattaccgttaggttacctttccgaactttcccgttacccgacccgtaacttccgtagtaaccg

SEQ ID NO: 141357 - DNA, 723 bp, Homo sapiens
  misc_feature: GYAE6OF02JT1UW.46.67.G01.1.454.CMB.1.raw
  modified_base (211)..(211): a, c, t, g, unknown or other
  misc_feature (211)..(211): n is a, c, g, or t
  modified_base (213)..(213): a, c, t, g, unknown or other
  misc_feature (213)..(213): n is a, c, g, or t
  modified_base (235)..(235): a, c, t, g, unknown or other
  misc_feature (235)..(235): n is a, c, g, or t
  modified_base (286)..(286): a, c, t, g, unknown or other
  misc_feature (286)..(286): n is a, c, g, or t
  modified_base (445)..(445): a, c, t, g, unknown or other
  misc_feature (445)..(445): n is a, c, g, or t
tcagactagcagtacacgaccggtgctcgatttagagtatacatattgggtttggggtagtcgtcggtcaggacgacagcatggacatgagggtcccgctcagctcctgggctcctgctactctggctccgaggtgccagatgtgacatcgagctgacccagtctccatcctccctgtctgacaaccggtgggagacagtgttccaaccgntnacttgccggtcaagtcggaacnttgcacctattaaattgatcaacatagacaggacggccctaagctcctaanctatgactcgtcaatcctagtttacgacgtaaagttccggggtacctacgtaccggtaacgggtttacaacggttagggaccgttagtagggtacgttaacggttcggggaaaccaacgggttaattttccggaccgtttacctaccctaaaaccggtntttaacccgtaagttacgtacgtaccgtacgtaacggtacgttaaagttacgtttaacgtaaccttaaacgtttacttaaccgttagtaacctaacgtaacgttaaacttacgttaacgttacgtttaaccggaaccggtaacgtaaccgtaacgtaacctaaaccgttaaacgtaaacgtaacgttacgtaacgtacgttacgaacgtaaccgtaagttaccgttaccgttacgtaccttacgttaccttacccgaccttacgttacgttacgtaac

SEQ ID NO: 141358 - DNA, 543 bp, Homo sapiens
  misc_feature: GYAE6OF02GV2RA.46.67.G01.1.454.CMB.1.raw
  modified_base (517)..(517): a, c, t, g, unknown or other
  misc_feature (517)..(517): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaatggtatcaacatagaccagggacgcccctaagctcctaatctatgctgcatccagtttgacaaggtcgggtcccagtcgaggttcagtgcagtggatcgtgggacagtatttcactctcaccatacagtaatcgtgacaacgtagaagtattttagactaacttattacttagtacaacaagtaattactaagttgtttacggtaccgaaaggggtaccaacggtactaaactaaattaaaccgaattgtagactgactacattctgttccttnacttccttcccgacctatctagtaac

SEQ ID NO: 141359 - DNA, 515 bp, Homo sapiens
  misc_feature: GYAE6OF02HKFHA.46.67.G01.1.454.CMB.1.raw
  modified_base (385)..(385): a, c, t, g, unknown or other
  misc_feature (385)..(385): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgcccctaagctcctaatctatgctgcatccagtttgcaaagtggggtcccatcgaggttcagtggcagtggatctgggacaggatttcaactctcaccatcagtaatctgcaacgtnaagtatttgactaacttattactgtacaacagaattacaattgttttacggcctaaggacacgaactacaaattaaacgaactgtagctacgcaaccatctgtacttcactcttcccgcctactctgtac

SEQ ID NO: 141360 - DNA, 528 bp, Homo sapiens
  misc_feature: GYAE6OF02FILRI.46.67.G01.1.454.CMB.1.raw
  modified_base (251)..(251): a, c, t, g, unknown or other
  misc_feature (251)..(251): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatnaacatagacagggacggcccctaagctcctaatctatgctgcatccagtttgcaaagtggggtcccatcgaggttcagtggcagtggatctgggacagatttcactctcaccatcagtatctgcaacgtgaagtattttgctaacttattactgtacaatagaatttactaattgttttaccggacctaaagggactaacgactaactaaacttaaacgaactagtggtactgacctaaccatactgtctttacacttccttcccgactctctgtac

SEQ ID NO: 141361 - DNA, 600 bp, Homo sapiens
  misc_feature: GYAE6OF02JAJR4.46.67.G01.1.454.CMB.1.raw
  modified_base (316)..(316): a, c, t, g, unknown or other
  misc_feature (316)..(316): n is a, c, g, or t
  modified_base (323)..(323): a, c, t, g, unknown or other
  misc_feature (323)..(323): n is a, c, g, or t
  modified_base (388)..(388): a, c, t, g, unknown or other
  misc_feature (388)..(388): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagttggtttcttcgtggggctgggtccggcagctcccgagggaaggggctggaatacattggaagtgtctctcatagtggaggttcctattacngtccgtntctcaagatcgagtcactatactctcgtggaccacgtccagcaatctacgttttcccagaacgtntgagtttcgtgtcgaccgccgctgacgtcgggtcgtttattactgtgcgagacgcgtactagttagttgttagttttggagtttggtttacttcgactacccgtagacgtcggacggggtcctaccgggacccggttcggggccgtaacgggttaacgtacggttacggtaccgtacccgttacccgttaccgttaccggcccctaacccgg

SEQ ID NO: 141362 - DNA, 521 bp, Homo sapiens
  misc_feature: GYAE6OF02HGC9U.46.67.G01.1.454.CMB.1.raw
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccaggacggcccctaagctcctaatctatgctgcatccagtttgcaaagtcgggtcccagtcgaggttcagtgccagtcggatctgggacagatttcactctacacatcagtaactctgacaacgtgaagtattttagctaacttattactgtacaacagtaatactaattgtttacgacaagggacacgactaacaaattaaacgaactgtagctgacaacctatcttgtacttcgtactccttccgactactctagtac

SEQ ID NO: 141363 - DNA, 595 bp, Homo sapiens
  misc_feature: GYAE6OF02H8H6H.46.67.G01.1.454.CMB.1.raw
  modified_base (310)..(310): a, c, t, g, unknown or other
  misc_feature (310)..(310): n is a, c, g, or t
  modified_base (314)..(314): a, c, t, g, unknown or other
  misc_feature (314)..(314): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctcatcagtagtggtttcttcgtggggctgggtccgcagctcccgaggggaagggctggaatacgattggaagtgtctctcagtagtggaggttcctattacagtccgtctctacaagcgtcgagtcaccatatctcngacncgtcagcaatctacgttttccagaagtatgtagtttctggtacgacccgcgtctagccgtaacgggtcgttttattacgtggtcgacgtagaggtacggtcttaagttagtgttagttttggagtttggttattcgactacctagactcgggacgggctcgacccggtgggccaagggtactacgttcgaccaccgtctccgttacgccctacgaccgaacggccctagtcccggttcccttccccgtcgaccctaccctacccgtaccacggtctacccg

SEQ ID NO: 141364 - DNA, 599 bp, Homo sapiens
  misc_feature: GYAE6OF02FT78W.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccagtcgaggttcagtggcagtgatctgggacagattcactctcaccatcataatctgcaacgtgaagtattttgactaacttattacttgtactaaactagtaattaactaattagtttttaccggaaccgtaaaggggtacctaacggtaacttaaacgtaaaacgtttaaaaccgaaacgttacggtacggtacgttacgaccgtaacccgtaacttaccgttacgttactttaccgtacttacccgtttaccccggtaccctacgttcctacggtaac

SEQ ID NO: 141365 - DNA, 604 bp, Homo sapiens
  misc_feature: GYAE6OF02H71MP.46.67.G01.1.454.CMB.1.raw
  modified_base (357)..(357): a, c, t, g, unknown or other
  misc_feature (357)..(357): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagcctcccgaggggaagggctggaactacagttggaagtgtctctcattagtggaggttcctattacagtccgtctctcaagacgtcgagtccaccatactctcgtacggacaccgtccagacaatctacgttttcccagaacgtntgtacgttcgtgtcgaccgcgcgtacgacgtacgggttcttttactacgtgtcgcgagacggacggcttattatgttagttttggagtttggttactttcgactaccctagacgttcgggcggggtctccggaccgtcgggaccgaggtacgtacgtgtccgtacccgtctaccgttacgccctacgaccgacggccctagtccggttcccttcccgcgtaccctcccgtcctacgaacgctacccg

SEQ ID NO: 141366 - DNA, 630 bp, Homo sapiens
  misc_feature: GYAE6OF02HHMYR.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaattggtatcaacatagaccagggaccggcccctaagcctcctaatctatgctgcatccagtttgacgtaaaggtcggggtacccagtcggtaggttcaggtggactaggtggtatcgtagggacagtatttcactctcacctatctagtaactctagactaacggtgtaagttagtttacgaacttaacttttacttaccgttagtactaaacgtaagttaaactttactaagtttcggttttaccggaccgtaagggtaacctaaccggtaacttaaacgtaaaacgttaaaaccgtaacgttacggtacgtcgttacgacctaacctacgttaccttacgttccttacctacttacccgtttacccgaccttacttcgtactaacg

SEQ ID NO: 141367 - DNA, 552 bp, Homo sapiens
  misc_feature: GYAE6OF02HAGSL.46.67.G01.1.454.CMB.1.raw
  modified_base (331)..(331): a, c, t, g, unknown or other
  misc_feature (331)..(331): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctccagggagggctggaatacattggaagtgtctctcatagtggaggttcctattacagtccgtctctcaagagtcgagtcaccatatctctggacacgtccagcaatcagttttcccngaacgatgagttctgtcgaccgccgctgacacgggtctttattactgtgcgagagacggctattatgtattttggagttggttattcgacacctagatcgacggggctcgacccgtgggccgagggactacgtgtcctaccgtctccttacgcctccaccgaacggcccacggttccgtccgttcccccgtggtccctacccctcctacccagtcgacccg

SEQ ID NO: 141368 - DNA, 608 bp, Homo sapiens
  misc_feature: GYAE6OF02IES2O.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgacaaccggtgggagacagtgtcaccatcacgttggccgggacaaggtcggaacattcgaacctaccttaattttaaagttggtatacaacataagaccgagggacggacccctaagctacctaatctatgctgacatcctagtttcgacgtaaaggtcgggtacccagtcggtagttcgagtcggacaggtgtatcgtagggacagtactttcacttcacgtaccatacaagtaatctgacgtaacgtagaacgtattttcgactaacgttattactcgtaacaactaagtaaacttaataacgttcgttttaccggaaccgtaacgggacaaacgtaacttaaactaaaacgttaaacgaaacgtgtacgactacgactactaattctacgttctacgtacttcctacccgactactcctagtaacg

SEQ ID NO: 141369 - DNA, 683 bp, Homo sapiens
  misc_feature: GYAE6OF02ISVNC.46.67.G01.1.454.CMB.1.raw
  modified_base (250)..(250): a, c, t, g, unknown or other
  misc_feature (250)..(250): n is a, c, g, or t
  modified_base (436)..(436): a, c, t, g, unknown or other
  misc_feature (436)..(436): n is a, c, g, or t
tcagactagcagtacacgaccggtgctcgatttagagtatacatattggggttttgggggacgtactcggtccaggtacgacagccatggacatgagggtccccgctcagctcctggggctcctgctactcttggctccggaggtgccagatgtgacactcgagctgacccagtcctccatcctcctgtctgcaacgtgggagacagtcgtcgacctatctacgttggcccgggctaaggtcggaaactnttagacctaaccttaattttaaactggtaattacaactatagaccgtaggggaccgacccctaagcctaccctaagtctaagtcgctgactagtccgtagtttgacgaaaggttcgggtccagtcgtaaggttacaggtgacagtgatcgtggacagtattcacgtcacgacacgtcaagtaactnacgactaacgtagtaagtactttacgactaaactttagttacgtagtactaacgtaagttaaacttaagaacgtttcgtttaccggaacgtaaacgggtaacctaaccggtaaacgttaaaccgtaaaaacgttaaacggtaaacgttggttacggtacgtacgtaccgtaacgtaacgttacttaacgtttactttacgtaccgttacccgttcccgtaaccgtagtttacccggtacgttaaccg

SEQ ID NO: 141370 - DNA, 698 bp, Homo sapiens
  misc_feature: GYAE6OF02H1D39.46.67.G01.1.454.CMB.1.raw
  modified_base (250)..(251): a, c, t, g, unknown or other
  misc_feature (250)..(251): n is a, c, g, or t
  modified_base (368)..(368): a, c, t, g, unknown or other
  misc_feature (368)..(368): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtcgcctccatcagtagtggtttctcgtggggctgggtccgnngctccgagggagggctggaatcagttggagtgtctctcataggtggtacgttcctattacgagttccgtctctacgaagagtcgagtccaactatatctcgtcgactacgtaccganctaactctaacgttttcccagtaacgtagtgtaagtttctggtcgacccgtccgtcgtggaaccgtaccgggttagtttacgtttacgtggtagtacggaggtaaggacggtacttaagttttacgtggtttaacgttttttgggacgtttaggtttaacttttaccggaacccttaacccggttaaggtacgtaccggggtaccgggggtccccgttaccgggaacccccggttagggggtaacccgaacgggggttaaaccttaccgggttcgggtaaccccgttaccccggtttactttaccccgttaccggtacccctaaccccgg

SEQ ID NO: 141371 - DNA, 665 bp, Homo sapiens
  misc_feature: GYAE6OF02F3P1A.46.67.G01.1.454.CMB.1.raw
  modified_base (212)..(212): a, c, t, g, unknown or other
  misc_feature (212)..(212): n is a, c, g, or t
  modified_base (250)..(250): a, c, t, g, unknown or other
  misc_feature (250)..(250): n is a, c, g, or t
  modified_base (331)..(331): a, c, t, g, unknown or other
  misc_feature (331)..(331): n is a, c, g, or t
  modified_base (378)..(378): a, c, t, g, unknown or other
  misc_feature (378)..(378): n is a, c, g, or t
  modified_base (383)..(383): a, c, t, g, unknown or other
  misc_feature (383)..(383): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtcccctcacctgcgctgtctctggtncctccatcagtagtggtttctcgtggggctgggtccgnagcctcccgagggaaggggctggaatacagttggaagtgtctctcatagtggaggttcctattacagtccgtctctcaagngtcgagtcaccatatctctggacacgtccagcaatctagttttcccngaagntgagtttctgtcgaccgccgtctagaccgtacgggtcgttttaacgttacgttggttcgacggagtaacgggacggtcttaatttacgttaggttagtttttagggttaggtttgggttttaacgttttccgtaaccgtacccgttaaggtacgtaccgggtaccgggggtccgttacccggtaaccccgggtcggggtacccggaacggggtaacgttaaccggttcgggttacccggtacccgttcccggtttacccgtttacggtcccctaacccccgg

SEQ ID NO: 141372 - DNA, 582 bp, Homo sapiens
  misc_feature: GYAE6OF02IU4HK.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggagacagtgtcaccatcacttgccgggcaagtcgaacatgacacctattaaatggtatcaacatagaccagggacgcccctaagctcctaatctatgctgcactcctagtttcgactaaaggtcggggtacccagtcgtaggttcaggtcggcaggtggatcgtagggactaggtactttcactcgtcacctatacagtaactctagaccaagtagtaagttatttacgactaacttattacgtagtacaactagtaaacttactaagttcgttacggaccgtaaggaccaacgtaacttaaactaaaacgttaacgaacttcggtagtctacgacctaacctattccgttatcttacgtacgttccttcccgactacgttccgtagtaaccg

SEQ ID NO: 141373 - DNA, 574 bp, Homo sapiens
  misc_feature: GYAE6OF02FHXCP.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagacagggaccgcccctaagctctaatctatgctgcatccagtttgcaaagtgggtccatcgaggttcagtgcagtggatcgtgggacagtattcactctacacctatcagtaactctagacaacgtgtaagtattttacgactaacttattactgtacaacagtaaacttactaattcgtttacggacctaagggtacctaacgtaacttaaacgaaaattaaacgaacttcggtacggtactacgaccgtaacctaacgttctaccgttactttaccgactttacccgttccccgacttacttccgtagttaaccg

SEQ ID NO: 141374 - DNA, 690 bp, Homo sapiens
  misc_feature: GYAE6OF02H8FF3.46.67.G01.1.454.CMB.1.raw
  modified_base (312)..(312): a, c, t, g, unknown or other
  misc_feature (312)..(312): n is a, c, g, or t
tcagactagcagtacacgaccggtgctcgatttagagtatacatattgggttttgggggagtctcggtcaggacacagaatggacatgagggtcccccgctcagctccctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccgagggaccggcccctaagctcctaatctatgctgcactccagtttnacgaaaggtcggggtacccatcgaggttcagtggcagtggatcgtagggacagtattcactcctacacctatactaagtactctacgtaccgtaaacgtgaacgttattttgacttaaactttattactacgttaactaacaagtaactttaacgtaacgtttacggttttacggaaccgtaaacggggtactaaccggttaaccttaaaaccgttaaaaaatttaaaaccggtaaacgttaacgggttacggtaccgttacggtaaccctaaccgtaacgttacccgttacggtttaacccttttacctaaccgttttccccgtttcccccggaacccctttaccgtttcccgtttaaccggtaactttaaccccgg

SEQ ID NO: 141375 - DNA, 574 bp, Homo sapiens
  misc_feature: GYAE6OF02FQL19.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgcccctaagctcctaatctatgctgcatccagtttgcaaagtgggtcccagtcgaggttcagtggcagtgatcgtgggacagatttcactctcaccatacagtaatctagacaacgtagaagtattttagacttaacttactttaactagttactaacgtagtaaactttaactaagttcggttttaccggacgtaacgggtacaccgtaacttaactaaaaattaaaaccgaacttagtaggtctagaccaaccgtattcctacgtttccttcctaccttcccgtccctattcctagacttaccg

SEQ ID NO: 141376 - DNA, 585 bp, Homo sapiens
  misc_feature: GYAE6OF02IVE54.46.67.G01.1.454.CMB.1.raw
  modified_base (171)..(171): a, c, t, g, unknown or other
  misc_feature (171)..(171): n is a, c, g, or t
  modified_base (285)..(285): a, c, t, g, unknown or other
  misc_feature (285)..(285): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttcttctggggctgggtccggcagctccgagggagggctggaatacattggaatgtctctcatagtggaggttcctattacagtccgtctctcaagngtcgagtcaccatatctctggacacgtccagctaatctacgttttcccagaacgatgagttctgtcgaccgccgtctagacgacggggtctttaattacgtgtgacgagacgacggtcttattatgttagttttggagttgtttatttcgactacctagacgtcggacgggtctccgacccggtgggaccgagggactacgtggtcctaccgtcgtccttacgccctaccgaccgaacgggccctagtcccggttcccttcccccgtacgccctacccctcccgtaccacgtcctacccg

SEQ ID NO: 141377 - DNA, 553 bp, Homo sapiens
  misc_feature: GYAE6OF02HOK63.46.67.G01.1.454.CMB.1.raw
  modified_base (211)..(211): a, c, t, g, unknown or other
  misc_feature (211)..(211): n is a, c, g, or t
  modified_base (477)..(477): a, c, t, g, unknown or other
  misc_feature (477)..(477): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctcatcagtgtgttcttctggggctgggtccggcagcctcccgagggaagggctggaatacattggaagtgtctctcatagtggaggttcctattacagtccgtctctcaagagtcgagtcaccatatctctggacacgtccagcaatctacgttttccctagaagatgtagttctgtcgaccgccgctgacgtacgggtcgtttaatcgtgtgcgagagacgctattatgttagttttggagttggttatttcgactacctagngtcggcggggtctccggacccggtgggaccgagggtaactacgtcggtctacccgttctccttacggccctacccg

SEQ ID NO: 141378 - DNA, 571 bp, Homo sapiens
  misc_feature: GYAE6OF02HZ392.46.67.G01.1.454.CMB.1.raw
  modified_base (294)..(294): a, c, t, g, unknown or other
  misc_feature (294)..(294): n is a, c, g, or t
  modified_base (341)..(341): a, c, t, g, unknown or other
  misc_feature (341)..(341): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagcctcccgaggggagggctggaatacagttggaagtgtctctcagtagtggtaggttcctattacagttccgtctctcaagngtcgagtcaccatatctctggacacgtccagcaatctagttttcccngaagatgattctgtgaccgccgctgaccgacgggtctttattacgtgtgcgagacgcggctattatgttattttggagttggtttattcgactacctagacgtcggacgggctccgacccgtgggaccgagggactacgtcgtcaccgtcttccgtacgccctaccgaccgaacggtccctacgtccgttcccttcccgtcggcccacccctcctaccgacgtctacccg

SEQ ID NO: 141379 - DNA, 595 bp, Homo sapiens
  misc_feature: GYAE6OF02FOLBU.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccggcaagtcggaacattgacacctatttaaattggtatcaacatagaccagggacggcccctaagctcctaatctatgctgcatccagtttgctaaaggtcggggtcccatcgaggttcagtggcaggtggatcgtagggacagatttcactctcaccatcaagtaatctgacaacgtgaagtattttagactaacttattactgtacaacagtaacttacaatttcgttttacggaccgtaagggtaccaaccgtaacttaactaaaacgtttaaaccgaaacgttaggtaggtacctacggacctaacccgtaattccttacggttacctttaaccgtactttccccttaccccggaccctaaccttccgtagttaacccg

SEQ ID NO: 141380 - DNA, 543 bp, Homo sapiens
  misc_feature: GYAE6OF02FYT2E.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctcctaatctatgctgcatccagtttgcaaagtgggtccatcgaggttcagtggcagtggatcgtgggacagatttcactctcaccatcagtaatctgcaacgtgaagtattttgctaacttattacttagtacaaacaagtaaattacaaattcgttttacggacctaaacgggtaacaacgtaacctaaacaaaattaaacgtaaactagtaggtactgaccaacattctagtccttcacttccttacccgcctactctgtaac

SEQ ID NO: 141381 - DNA, 568 bp, Homo sapiens
  misc_feature: GYAE6OF02JN02Y.46.67.G01.1.454.CMB.1.raw
  modified_base (210)..(210): a, c, t, g, unknown or other
  misc_feature (210)..(210): n is a, c, g, or t
  modified_base (346)..(346): a, c, t, g, unknown or other
  misc_feature (346)..(346): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccgnagctccgagggaagggctggaatacgagttggaagtgtctcgtcagttacggtggaggttcctagttacagtccgtctctcaagagtcgagtcaccatactctctggacacgtcagcaatctagtttccagaacgntgtagttctgtcgaccgcgctgacgtacggtcgtttatactgtgcgagagacgtctatatgtatttggagttggttattcgactacctagacgtcggacggggtctccggacccgtgggccgagggtaactacgtcgtcctaccggtctccgtagcctcacgtaacggcctacgtcgtacccttcccgtcgtccctacccgtcctaccgtacgtacgtaccg

SEQ ID NO: 141382 - DNA, 564 bp, Homo sapiens
  misc_feature: GYAE6OF02G3IF0.46.67.G01.1.454.CMB.1.raw
  modified_base (234)..(234): a, c, t, g, unknown or other
  misc_feature (234)..(234): n is a, c, g, or t
  modified_base (382)..(382): a, c, t, g, unknown or other
  misc_feature (382)..(382): n is a, c, g, or t
  modified_base (416)..(416): a, c, t, g, unknown or other
  misc_feature (416)..(416): n is a, c, g, or t
  modified_base (536)..(536): a, c, t, g, unknown or other
  misc_feature (536)..(536): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccggtgggagacagtgtcaccatcacttcggccgggacaagtcggaactnttgactaccttatttaaattggtatcaacatagaccagggaccggcccctaagctcctaatctatgctgcatccagtttgacaaaggtcggggtcccagtcgaggttcaggtggacaggtggatcgtaggggacagtatttcacttcncacctatacagtaactctgactaacgtgaagttntttacgacttaactttattacttgtacaactagaattacattcgtttacgacgtaaggacaacgtaactaactaaagttaaacaacgtgtagtctagaccgaactatcgtcgttaccttntacttcccttaccgacctattctatacg

SEQ ID NO: 141383 - DNA, 615 bp, Homo sapiens
  misc_feature: GYAE6OF02HTAMQ.46.67.G01.1.454.CMB.1.raw
  modified_base (229)..(229): a, c, t, g, unknown or other
  misc_feature (229)..(229): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttggccgggcaagtcggaacnttgacaccttatttaaattggtatcaacatagaccaggacggcccctaagctcctaatctatgctgcatccagtttgactaaagtcgggtccagtcgaggttcagtggcagtgatcgtgggacagtattcgactcgtcaccgtatccgataactctcgactaacggtgaagtattttacgactaactttaattacgttagtacaactaagtaattaacaatttcggttttaccggaaccgtaaacgggtacctaaccgtaacttaaaccgtaaaagtttaaaccgaacgttaggtacgtactccggtaccaaccgtacttacgttacgtttacctttacgtaccttcccgtttaccccggacccttaacgttccttaggttaaacc

SEQ ID NO: 141384 - DNA, 638 bp, Homo sapiens
  misc_feature: GYAE6OF02GM9PW.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgccaccatcacttgccgggcaagtcggaacattgacacctatttaaattggtatcaacatagaccagggacgcccctaagctcctaatctatgctgcatccagtttgcaagtgggtcccatcgaggttcagtggcagtggatcgtggacagtattcactctcacatcagtaatctgcaacgtgaagtattttgactaacttattacgtagtacaacgtaagtaattgacgtaagtttcggttttaccgggacgtaaacggggtacctaacggtaaccttaaaccgtaaaagtttaaaaccgtaaagtttacgggttacggtaccgttacggtaacccgtaaacccgttaagtttcccgttaacggttttacccctttaccgttaaccggtttacccccgttttacccccggtaacccctttaacgttacccgtttaaccgg

SEQ ID NO: 141385 - DNA, 585 bp, Homo sapiens
  misc_feature: GYAE6OF02G25G6.46.67.G01.1.454.CMB.1.raw
  modified_base (228)..(228): a, c, t, g, unknown or other
  misc_feature (228)..(228): n is a, c, g, or t
  modified_base (250)..(250): a, c, t, g, unknown or other
  misc_feature (250)..(250): n is a, c, g, or t
  modified_base (409)..(409): a, c, t, g, unknown or other
  misc_feature (409)..(409): n is a, c, g, or t
  modified_base (438)..(438): a, c, t, g, unknown or other
  misc_feature (438)..(438): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttgccggcaagtcggaacntgacactatttaatgtatcaanatagaccgagggaccggcccctaagcctcctaatctatgctgcactccgagtttgacgtaaaggtcgggtaccctagtcggtaggttcgaggtggctaggtggatcgagggacagtacttcactctacaccatctagtatctgacgtaacgtgtaattntttacgactaattagttacttagtacaanagtaacttactaagttcgttacggacgtaaggacacgtaactaactaaacttaacgaacgtgtacgtcgtacgacctaaccgtattcccgttacgttaccttaccgtacctttcccgttaccccgtacttaacgttccgtagtaacc

SEQ ID NO: 141386 - DNA, 637 bp, Homo sapiens
  misc_feature: GYAE6OF02I0G7B.46.67.G01.1.454.CMB.1.raw
  modified_base (385)..(385): a, c, t, g, unknown or other
  misc_feature (385)..(385): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgagggaggggctggaatacattggaagtgtctctcatagtggaggttcctattacagtccgtctctcaagagttcgagtcaccatatctctggaccacgtaccagcaatctacgttttcccagaaagntagtagttctgtgacccgcgctgacgtacgggtcgtttaactacgtgttgacggagaggacggtcttaattagtacgttagtttttgggagtttgggtttaactttccggtaacctaccccgttaagtacgtccggggtacgggggtccttacccggccccggttaggggacccggaacggggtaacgttaccggttacgggtccgtaacccggttccgtttaccccgtttacggtaccccgttaacccccg

SEQ ID NO: 141387 - DNA, 572 bp, Homo sapiens
  misc_feature: GYAE6OF02GA94D.46.67.G01.1.454.CMB.1.raw
  modified_base (229)..(229): a, c, t, g, unknown or other
  misc_feature (229)..(229): n is a, c, g, or t
tcagactagcagtacacgaccggtgctcgatttagagtatacatattgggtttggggagtcgtcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacncttgacacctatttaaattggtatcaacatagaccagggacgcccctaagctcctaatctatgctgcatccagtttgcaaaggtgggtcccagtcgaggttcagtggcagtggatcgtgggacagtactttcactctacaccatcagtatctgacaacgtgaagtatttcgactaacttattactgtacaactaagtaattaactaattcgttttacggaccgtaagggacctacgtaacttaacaaaacgttaaacgtaacgttagtacggtacttacgacctaaccgtacttcgttacgttctttactaccttccttcccgtacctacttacgtataaccg

SEQ ID NO: 141388 - DNA, 611 bp, Homo sapiens
  misc_feature: GYAE6OF02GCF8V.46.67.G01.1.454.CMB.1.raw
  modified_base (255)..(255): a, c, t, g, unknown or other
  misc_feature (255)..(255): n is a, c, g, or t
  modified_base (307)..(307): a, c, t, g, unknown or other
  misc_feature (307)..(307): n is a, c, g, or t
  modified_base (348)..(348): a, c, t, g, unknown or other
  misc_feature (348)..(348): n is a, c, g, or t
  modified_base (391)..(391): a, c, t, g, unknown or other
  misc_feature (391)..(391): n is a, c, g, or t
  modified_base (406)..(406): a, c, t, g, unknown or other
  misc_feature (406)..(406): n is a, c, g, or t
tcagactagcagtacacgaccggtgctcgatttagagtatacatattgggtttgggtagtctcggtcgtaggacacagcatggacatgaggtcccgctcagctcctgggctcctgctactctggctcgagtgccagatgtgacatcgagctgacccagtctccatcctccctgtctgcaaccgtggagacagtgtcaccatcacttgccgggcaagtccgaacagttgaccaccgtatttaaatggtatcaactntagaccaggacgcccctaagctcctaatctatagctgctatacctagtttcnctaaagtgggttcccaatccgaggttcagtggcagtggtanctagggacaggtatttcgacgtctacaccgatccgatatctanactacgtgaaacgtntttagactaacttattacttcgtagtaaacctagtaacttaactaagtacgttttacgaccgttaagggtaccctacgtaaccttaacgtaaaacttaaaccggtaaacttacgtaacggtactacggtaccaacgtaaccgttcctaaggtttacccttacgtacttaccgtttaacccgccctaacgtttaccgtagtaaccc

SEQ ID NO: 141389 - DNA, 517 bp, Homo sapiens
  misc_feature: GYAE6OF02FVAIO.46.67.G01.1.454.CMB.1.raw
  modified_base (388)..(388): a, c, t, g, unknown or other
  misc_feature (388)..(388): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaattggtatcaacatagaccagggacggcccctaagctcctaatctatgctgcatccagtttgcaaagtggggtcccatcgaggttcagtggcagtggatctgggacagtatttcactctccacatcagtatctgcaacgtgaagtntttgactaacttattacttgtcaacagaattacaattgttttacggacctaaggacacgactaacaaattaaacgaactagtgactgacaccaattctgtcttactactcttacccgcctactctgtac

SEQ ID NO: 141390 - DNA, 538 bp, Homo sapiens
  misc_feature: GYAE6OF02I97F9.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacatgacacctattaaattggatcaacatagaccagggacgcccctaagctctaatctatgctgcatccagtttgacaaagtgggtcccagtcgaggttcagtgcagtggatcgagggacagtattacactctacaccatacagtaactctgacaacgtagaagtatttgactaacttattactgtacaactagtaacttacaattcgtttacgaccgaaggacacgtaactaacaaattaaacgaacgttgtagtactagacctactatcgtacgttcttactacttccgttacccgacctactctagtacg

SEQ ID NO: 141391 - DNA, 553 bp, Homo sapiens
  misc_feature: GYAE6OF02I45JR.46.67.G01.1.454.CMB.1.raw
  modified_base (332)..(332): a, c, t, g, unknown or other
  misc_feature (332)..(332): n is a, c, g, or t
  modified_base (356)..(356): a, c, t, g, unknown or other
  misc_feature (356)..(356): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccgcagctccagggaaggggctggaatacattggaagtgtctctcatagtggaggttcctattacagtccgtctctcaagagtcgagtcaccatatctctggacacgtccagcaatcagttttcccngaacgatgagttctgtcgaccgcnctgacgacggtcgtttatacgtgtgcgtagaggacggctattatgtattttgggagtggtttattcgactaccctagactcgacggggcctcgacccgtgggccgagggaatacgtacgtcacgtcctcctacgccctaccaccgaacggcctacgtccgttcctcccgtcgcctaccctccgtacctagcctaccg

SEQ ID NO: 141392 - DNA, 621 bp, Homo sapiens
  misc_feature: GYAE6OF02I71NS.46.67.G01.1.454.CMB.1.raw
  modified_base (226)..(226): a, c, t, g, unknown or other
  misc_feature (226)..(226): n is a, c, g, or t
  modified_base (375)..(375): a, c, t, g, unknown or other
  misc_feature (375)..(375): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaacggtggagacagtgtcaccatcacttgccgggacaagtcgaacnttgacactatttaaattggtatcaacatagaccagggacgccctaagctacctaatctaatgctgctatcagtttgactaaaggtcgggtaccatcggacggttacaggtggactaggtgatcgtgggactagtctttcgactacttanaccgtatacagttaatctagactaacgtagaagtatttgacttaacttagttactagtaacaacgtaagtaactttacaacgtttggtttacgaacccgtaaagggacctaaacggttaactaaactaaaagtttaaaccgaacgttacggttacgtacgttacgtaccgtaaccgtaattccgtttaagccgtttaacctacgttaccctttaaccccggaccttaacgttacccgttagaaccg

SEQ ID NO: 141393 - DNA, 549 bp, Homo sapiens
  misc_feature: GYAE6OF02GVJ29.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacactatttaatgtatcaacatagaccagggacgcccctaagctcctaatctatgctgcatccagtttgcaagtgggtcccatcgagttcagtggcagtgatctgggacagatttcactctcaccatcagtatctgacaacgtgaagtattttgactaactttattacttgtacaactagaattactaagttgtttacggaccgtaagggtacaacggtaactaacgtaaaattaaacgaacttagtaggacttgaccaacctattcgtacgttacctttacgacttcccttacccgtacctactccgttagtaaccg

SEQ ID NO: 141394 - DNA, 599 bp, Homo sapiens
  misc_feature: GYAE6OF02JK4RH.46.67.G01.1.454.CMB.1.raw
  modified_base (343)..(343): a, c, t, g, unknown or other
  misc_feature (343)..(343): n is a, c, g, or t
  modified_base (434)..(434): a, c, t, g, unknown or other
  misc_feature (434)..(434): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctcgtggtgcctcatcagtagttggtttcttcgtggggcgtcgggtccggcagcctacccgaggggaacggggctggaatactagttggaagtgtctctcagtaggtggaggttcctaattacgagtccgtctctcaagngtcgagtcaccatatctctggacacgtcagcaactctacgttttccagaagtatagtacgttcgtgtcgaccgcgctgaaccgtacgggtntttactcgtggtgcgagtgacgtactattgtgttagttttggagttgtttacgtttcgaacctaccgtaagtcgtacgggccgggtactcccggtaccccggtgggaccctaagggtactacggtacggtacctacccggttacttccgttaccgcccgtacccg

SEQ ID NO: 141395 - DNA, 709 bp, Homo sapiens
  misc_feature: GYAE6OF02IW453.46.67.G01.1.454.CMB.1.raw
tcagactagcagtacacgaccggtgctcgatttagagtatacatattggggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtgggctgggtccggcagctcccagggaagggctggaatacgagttggaagtgtctctacagtaggtggtaggttccttagttacagtcccgtctcctacaaggacgttcgacgtcaaccatatcttcgtcggactacgttaccgagtctaacttcctacggtttttcccaggtaacgtactggtaagttcgttggtcggtacccgccgtcgtcgaaccgtacggggtactttttaacgttacttcggtacgcgtaacggtaacggaccggtaccgttaatttagttacgggtttagtttttttagggtaaggttttacggttttacgttttaccggtaacctaccccggttaagtaacgttaccgggtaccggggtactacccgtaacccggttcgggtacccggaagggtaacttaccgtacggtacgtccgtaccttcgttacgcctaccaccgacggccctacgtccgttcctccccgtcggcccacccgtcctacgtacgtcgtacccg

SEQ ID NO: 141396 - DNA, 577 bp, Homo sapiens
  misc_feature: GYAE6OF02H81V1.46.67.G01.1.454.CMB.1.raw
  modified_base (252)..(252): a, c, t, g, unknown or other
  misc_feature (252)..(252): n is a, c, g, or t
  modified_base (396)..(396): a, c, t, g, unknown or other
  misc_feature (396)..(396): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaatgtatcaanatagacaggacgcccctaagctactaatctatgctgcatcctagtttgacaaaaggtcgggtcccaagtcgaggttcagtggacagtgatcgtgggacagatttcactctccacatcaagtaatctcgacaacgtagtaaagtntttcgactaatttatacctgttacaaactaagtaattactaattgttttaccgggaactaacgggaccaacgtaaccttaaactaaaagttaaaacgaacgttagtacggacgttacgacctactaacgttctacgtttaccttacacttacccgttcccgtacctagttctaggtaaacc

SEQ ID NO: 141397 - DNA, 606 bp, Homo sapiens
  misc_feature: GYAE6OF02G44TO.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctacctaatctatgctgcactccagtttcgacaaaggtcggggtacccagtcgtaggttcaggtggacaggtggatcgtgggacagtatttcactctcacctatcagtatctcgacaacgtgaagtattttacgactaacttattaactgtactaactagtaattacgtaatttcgtttaccggaccgtaagggactaacggtaacttaaactaaaagttaaaccgaaacgttagtacggtacttacggacctaaccgtaacttaccgttacgttaccctttacgtacctttacccgtttaccccgaccttactttaccgtagtaacc

SEQ ID NO: 141398 - DNA, 764 bp, Homo sapiens
  misc_feature: GYAE6OF02J3OFC.46.67.G01.1.454.CMB.1.raw
  modified_base (174)..(174): a, c, t, g, unknown or other
  misc_feature (174)..(174): n is a, c, g, or t
  modified_base (241)..(241): a, c, t, g, unknown or other
  misc_feature (241)..(241): n is a, c, g, or t
  modified_base (433)..(433): a, c, t, g, unknown or other
  misc_feature (433)..(433): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactgggtcgaggccttcgggagccctgtccctcacctgcgctgtctctggtcncctcatcagtgttggttcttcgtgggtctgggtcgctagctccggaggggacggctaggaactacgngttggagtgtctctactgtaggtggtacgttcctagttacgacgtccgtctacgtacgaagtcgtacggatacctacctagtactcctacgtacgaccgtaccgttaccagacctaataccgttacgtttcccgagaagtctaggtacgtttcgacgttcggacccgtcctacgtcgtacgtaccggggttnttttaactcgtaggtcgaccggtaggtacgacgttacttaacgtttagtaggtttacgttttacgggtagggtttacgtttacgttaccgtaaccttaccggttaagtaccgggtacgggtacccgggttacccgggtaacccgtcccggggtaaccgggtacggtaaacggggacctttaccggtaccggtacccgtacccgtcgtttaaccccggtccgtacccgtacccggtacccgtaaccggcccttaaccgggtccccgtttacccgtaccccggtacggtaccccctacccggttaccctaacggtacccgtcccgtaacccgg

SEQ ID NO: 141399 - DNA, 505 bp, Homo sapiens
  misc_feature: GYAE6OF02F98PU.46.67.G01.1.454.CMB.1.raw
  modified_base (409)..(409): a, c, t, g, unknown or other
  misc_feature (409)..(409): n is a, c, g, or t
  modified_base (501)..(501): a, c, t, g, unknown or other
  misc_feature (501)..(501): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggagacagtgtcaccatcacttgccgggcaagtcgaacattgacacctatttaaatgtatcaacatagaccaggacggcccctaagctcctaatctatgctgcatccagtttgcaaagtggggtcccatcgaggttcagtggcagtggatcgtgggacagatttcactctcacatcagtatctgcaagtgaagattttgctaacttattacttgtacaacanaattacaattgtttcggacaagggacaacgactaacaaattaaacgaacgttgtagctgacacattctgtcttcattccttcccgccatctntaac

SEQ ID NO: 141400 - DNA, 678 bp, Homo sapiens
  misc_feature: GYAE6OF02GLUQK.46.67.G01.1.454.CMB.1.raw
  modified_base (209)..(209): a, c, t, g, unknown or other
  misc_feature (209)..(209): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccgnagctccagggagggctggaatacattggaagtgtctctcatagtggaggttcctattacagtccgtctctcaagtagtcgagtcaccatactctctggacacgtccagacaagtctacgttttcccagaagtatgtaagtttctgttacggaccgccgtactcggacgtaccggggttcttttaattacgtggtacgcggaggaacgacggtacttaagtttacgttagttacgtttttggaggtttggttactttcgacctacccgttagacgtccgggtacggggtcctaccggtacccggtacggggtaccgaggggtaacgttacgtacgggttacctaccggttccgtttacccgttacgtaccccttacccgaaccggtaaaccgggtccccgtaacgttccccggttcccttacccccggtcgggtaccccttaccccgtcccgtaccaacggaccgtcccg

SEQ ID NO: 141401 - DNA, 590 bp, Homo sapiens
  misc_feature: GYAE6OF02JCFOX.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtgggctgggtccgcagctccgagggaagggctggaatacagttggaagtgtctctcagtagtggaggttcctattacagtccgtctctcaagtagtcgagtcaccatatctctggacacgtccagcaaatctagttttcccagaacgtatgagttctgtcgaccgcgctgacacgggtctttattactgtgcgagagacggctattatgtattttggagttgttatttcgactaccttagattcggacggggtcctaccgacccgttagggccgtagggtaactacgttcggtcaaccgttcgttaccttacgccttaccaaccgtaacgggccctacgttccggtaccctttccccgcggtccctacccctcccgtaccgtacgaccgtacccg

SEQ ID NO: 141402 - DNA, 593 bp, Homo sapiens
  misc_feature: GYAE6OF02HC0QF.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttggccgggcaaggtcggaacattgacaccttattaaatgtatcaatatagacgagggaccgccctaagctacctaatctatcgctgcactcctagtttcgacgtaaacggtcgggtaccctagtcggtaggttacgaggtcggcgtaggtcggtagtcgtagggactaggtactttacaccttcctacacctatcgtaacgtaactcgtagaacgtaacgtagtaagttagtttacgacttaacttattactagtacaactagtaacttactattgtttacgacgtaacggactacgtaactaactaaattaaacgtaacgtgtacgtactactaccactacttacttcttacttactacttccgtccctactacttctatac

SEQ ID NO: 141403 - DNA, 664 bp, Homo sapiens
  misc_feature: GYAE6OF02H28XD.46.67.G01.1.454.CMB.1.raw
  modified_base (253)..(253): a, c, t, g, unknown or other
  misc_feature (253)..(253): n is a, c, g, or t
  modified_base (338)..(338): a, c, t, g, unknown or other
  misc_feature (338)..(338): n is a, c, g, or t
  modified_base (342)..(342): a, c, t, g, unknown or other
  misc_feature (342)..(342): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggcctttcggagacccctgtcccctcacctgcgctgtctctggtgcctccatcagtagtggtttcttctggggctggggtccggcagctcccagggagggctggaatacattggaagtgtctcncatagtggaggttcctattacagtccgtctctacagagtcgagtcacccatatctctggacacgtccagcaatctagttttcccngaanatgagttctggtcgaccgtccgctacgacctacggggtctttttaattacgtggttcgacggaggacggacggtacttagtttagtagttagtttttagggaggtttggtttagtttacgtacctacccgttagtacgtcgggacgggggtcctaccggtaccccggtcggggaccgtaacggggtaacttacggttccgtccgtacccgttccttacccgttaccgtcccttacccgaacccgaacgggtccccacgttcccggttacccgttccccccgttaggccccgtaccccttccccgtaccgtacggctaacccg

SEQ ID NO: 141404 - DNA, 569 bp, Homo sapiens
  misc_feature: GYAE6OF02HCZGJ.46.67.G01.1.454.CMB.1.raw
  modified_base (172)..(172): a, c, t, g, unknown or other
  misc_feature (172)..(172): n is a, c, g, or t
  modified_base (211)..(211): a, c, t, g, unknown or other
  misc_feature (211)..(211): n is a, c, g, or t
  modified_base (293)..(293): a, c, t, g, unknown or other
  misc_feature (293)..(293): n is a, c, g, or t
  modified_base (404)..(404): a, c, t, g, unknown or other
  misc_feature (404)..(404): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgagggccttcggagaccctgtccctcacctgcgctgtctctggtncctccatcagttagtggtttctcgtggggctgggtccgnagcctcccgaggggagggctgggaatacagttggaagttgtctctcataggtggaggttcctattacagtcctctctcaagngtcgagtacaccatatctctggacacgtccagcaatctacgttttcccagaacgtatgtagttctgtcgaccgtcgcgtcgacgtacgggttctttattacgtgtgcgagngacgtctatagtgttagtttggtagttgttattcgactaccgtagcgtcggcgggctccggcccggtgggccgaggacgtacgtcgtcctaccgtcctctacgcctaccgaccgacgcctacgtccggttccctcccgtcgtccctaccctccctcgacgcaccg

SEQ ID NO: 141405 - DNA, 573 bp, Homo sapiens
  misc_feature: GYAE6OF02GNUXZ.46.67.G01.1.454.CMB.1.raw
  modified_base (213)..(213): a, c, t, g, unknown or other
  misc_feature (213)..(213): n is a, c, g, or t
  modified_base (235)..(235): a, c, t, g, unknown or other
  misc_feature (235)..(235): n is a, c, g, or t
  modified_base (249)..(249): a, c, t, g, unknown or other
  misc_feature (249)..(249): n is a, c, g, or t
  modified_base (462)..(462): a, c, t, g, unknown or other
  misc_feature (462)..(462): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgacggccttcggagaccctgtccctcacctgcgctgtctctggtcncctcatcagtagtgtttctcgnggggctgggtccgnagcctccgagggaagggctggaatacattggaagtgtctctcatagtggtaggttctattacacgtccgtctctcaagacgtcgagtcaccatactctctgacacgtccagcaactctagttttccctgtaacgatgagttctgtgaccgccgcgtcgacgacgggtcgtttatactgttcgcgagacgtacgctattagttgtagttttggngttaggttagtttcgaactacccgtagacgtcgggtacggggctaccggacccgtcgggaccgtaagggtaactacgtcggtacacccggtctccgttacgtccctacccg

SEQ ID NO: 141406 - DNA, 637 bp, Homo sapiens
  misc_feature: GYAE6OF02GP422.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggaccgcccctaagctcctaatctatgctgcatcctagtttgactaaaggtcggggtcccagtcgaggttcaggtgcagtggatcgtgggacagtattcactcacaccatcgagttaactctagactaacggtgaaacgttattttacggacttaaactttattacttagtacaaacgtagtaaatttaactaagtttacgtttaccggaaccgtaaagggtaccaaccggtaaaccttaaacgtaaaaactttaaaaccggtaacttacggtacggtaccgtacggaaccctaaccctacggttttaccttaccggttacctttacctaaccgtttcccgtttacccccgacctaactttccgtagttaacc

SEQ ID NO: 141407 - DNA, 895 bp, Homo sapiens
  misc_feature: GYAE6OF02H7C8W.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacaggtgtcaccatcacttggccgggcaaggtcggaacattcgacaccttatttaaattggtatacaacatagacgagggaccggccctaagctcctaatctatgctgctatcctagtttcgacgtaaaacggttcggggtacccctagtaccggtagggtttaccgaagggttcgggaccgtaagggttacgggtaagttccgggttaacgggggtaaacctaagggttaaaccttttttccgaacccgtttaccccttacccgtaaaccccgtaaacgtttaacccgtaaacggtttaaaacttaccgttaaccggtaacccggtaaaacccgggtttaacggtaaaacggtttaaagtttttacgggtaaaccctttaaaacgttttaaacgttttaaaccgttaacggtttaaccgtaaaaccgttaaacgtttaaaactttaaaccgtttaaaaccgttttacgggttttttaacccgggaaacccggttaaaccgggtaaaacccgtaaaccggtaaaaccgttaaaaccgttaaaaaacgtttaaaaaccggtaaaaccgtttaacggtacgggttaaccgttaaccggtaacccgtaaccgtaaccgttaccgttaaccggtttacctttaccgttaacctttacccccggtttaccccgttaaccccttacgtttaccccgttagttaacccgg

SEQ ID NO: 141408 - DNA, 593 bp, Homo sapiens
  misc_feature: GYAE6OF02GCEH3.46.67.G01.1.454.CMB.1.raw
  modified_base (337)..(337): a, c, t, g, unknown or other
  misc_feature (337)..(337): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgaggggaaggggctggaatacagttggaagtgtctctcatagtggaggttcctattacagtccgtctctcaagagtcgagtcaccatatctctggacacgtccagcaatcagttttcccngaagatgagttctgtcgaccgcgctgacacgggtctttattactgtgcgagagacggctattatgtagttttggagttggttattcgactaccctagacgtcggacggggtctccgtcccgtggggaccgagggaacttacgtggttccaccgttcgtcccgttacgccctaccgaccgaaccgggtcccacgttccggttaccctttcccccggtacggtccctaccccgttccctacccgtaacgccgtacccg

SEQ ID NO: 141409 - DNA, 570 bp, Homo sapiens
  misc_feature: GYAE6OF02JYULD.46.67.G01.1.454.CMB.1.raw
  modified_base (159)..(159): a, c, t, g, unknown or other
  misc_feature (159)..(159): n is a, c, g, or t
  modified_base (226)..(226): a, c, t, g, unknown or other
  misc_feature (226)..(226): n is a, c, g, or t
  modified_base (351)..(351): a, c, t, g, unknown or other
  misc_feature (351)..(351): n is a, c, g, or t
  modified_base (360)..(360): a, c, t, g, unknown or other
  misc_feature (360)..(360): n is a, c, g, or t
  modified_base (375)..(375): a, c, t, g, unknown or other
  misc_feature (375)..(375): n is a, c, g, or t
  modified_base (508)..(508): a, c, t, g, unknown or other
  misc_feature (508)..(508): n is a, c, g, or t
tcagactagcagtacacgaccggtgctcgatttagagtatacatattgggtttggggagtctcggtcaggacacagcatggacatgaggtccccgctcagctcctgggctcctgctactctggctccgaggtgcccagatgtgacatcgagctgacccngtctccatcctccctgtctgacaaccggtggagacagtgtcaccatcacttgccggcaagtcggacnttgacctactatttaatgtatcaacatagaccaggacgcccctaagctactaatctatgctgcatccagtttcgacaaggtcggtcccagtcgaggttcagtgcgtagtcgatctagggacagtnttcacgtcncgtacatcagtactntcacaacgtagtaactagtttcgaacgtaacttacttagacttacaacgtagaaacttactaagttacgtttacgaccgtaacgggtaactacgtaactaaacgtaaacttaaacgaacgtagttgaccttanaccaacgtaatcgttaccgtactttacaaccttcccgttacccgcttaacttcgattaaccg

SEQ ID NO: 141410 - DNA, 543 bp, Homo sapiens
  misc_feature: GYAE6OF02GIWAP.46.67.G01.1.454.CMB.1.raw
  modified_base (217)..(217): a, c, t, g, unknown or other
  misc_feature (217)..(217): n is a, c, g, or t
  modified_base (365)..(365): a, c, t, g, unknown or other
  misc_feature (365)..(365): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacacctatttaaattggtatcaacatagaccaggacgcccctaagctcctaatctatgctgcatccagtttgacaaagtgggtcccagtcgaggttcagtggcagtgatcgtgggacagatttcactctcaccntacagtaatctgcaacgtgtaagtatttcgactaacttattactgtacaactagtaattactaattgtttacggacgtaagggactaacggactaactaaattaacgaactagtagcttagaccgtacctattctacgttccttactacttccttacccgacctacgttacctgtaac

SEQ ID NO: 141411 - DNA, 602 bp, Homo sapiens
  misc_feature: GYAE6OF02F1R8Z.46.67.G01.1.454.CMB.1.raw
  modified_base (334)..(334): a, c, t, g, unknown or other
  misc_feature (334)..(334): n is a, c, g, or t
  modified_base (340)..(340): a, c, t, g, unknown or other
  misc_feature (340)..(340): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgagggagggctggaatacattggaatgtctctcatagtggaggttcctattacagtccgtctctcagagtcgagtcaccatatctctggacacgtccagcaatctagttttccccngaacgntcgattcgtgtcgaccgccgtctgacgcggggtctttatactgtgcgagagcgactattatgtattttggagttggttattcgactacctagtacgtcgggacggggtctccggacccggtggggaccgtagggtaacttacgttcggtacctacccggttctacccgttacgcccttaccgaaccgtaaccgggcccttaagtcccggttcccttccccgtcggtcccctaccccgttcctacccgtacgaccgtaccccg

SEQ ID NO: 141412 - DNA, 590 bp, Homo sapiens
  misc_feature: GYAE6OF02F2XS2.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaaggtgggtcccagtcgaggttcagtggcagtggatcgtgggacagattcactctcaccatcagtaatctgactaacgtagaagtattttagactaacttattacttagtacaactagtaattactaattcgttttacgaccgtaacggaacgtaacgtaaccttaaacgtaaaacttaaaacgtaacgttacggtacggtacgttacggacctaacctaacttacgttacgttactttactactttcccgtttacccgtaccctacttacgttacgttaacc

SEQ ID NO: 141413 - DNA, 685 bp, Homo sapiens
  misc_feature: GYAE6OF02GC1X4.46.67.G01.1.454.CMB.1.raw
  modified_base (194)..(194): a, c, t, g, unknown or other
  misc_feature (194)..(194): n is a, c, g, or t
  modified_base (228)..(228): a, c, t, g, unknown or other
  misc_feature (228)..(228): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccggtggganacagtgtaccaccatcctacgttcggcccggganaacggtaccggaaactagttacgaacctaaccttaatttaaacgttggtaactacaaacctagtacggaccggacggggaccctaccctaagtccttactaattctatcgctgactacgtccgtagttacgacgtaacggtcggtaccagtcgtaggttcgaggtcgacgtaaggtgtagtcggtaggtactagttacttccacttcaaccactctaagtattactcgagtacgtaagtagttaaattactttacgaaactttaacgtacttaactacgtaacaaacttaagttaacgttaccgttaagggtttaccgtaacggaaacgtaaccgggtaactaaacgtaaccttaaaacgttaaacgtaacgttacgtcgaagtcccagtacctacttaccgttacgttccgttaacctcgttaacccgtccctaaccgtatacgttccacgttacg

SEQ ID NO: 141414 - DNA, 582 bp, Homo sapiens
  misc_feature: GYAE6OF02GH4NJ.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggaccgcccctaagctcctaatctatgctgcatccagtttgacaaagtgggtcccatcgaggttcagtggcagtgatcgtgggacagtatttcactctcaccatcagtaatctgcaagtagaagtatttgactaactttattactgtactaaacgagtaacttaacaagtttgttttaccggaccgtaaagggtacctaacggtaacttaaacgtaaaaatttaaaaccggaactaggttaccggacttacggaccgtaaacctattaccgtagttcctttactacttacccttcccgtacctacgttcctagtaacg

SEQ ID NO: 141415 - DNA, 846 bp, Homo sapiens
  misc_feature: GYAE6OF02FY4R4.46.67.G01.1.454.CMB.1.raw
  modified_base (288)..(288): a, c, t, g, unknown or other
  misc_feature (288)..(288): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccgcagctcccgagggaagggctggaatacattggaagtgtctctcagtagtggaggttcctattacagtccgtctctcaagngtcgagtcaccatatctctggacacgtccagcaatctacgttttcccagaacgataggtagttctggtcgacccgcccgtcgtacggaccgtaccggggttaccgtttttaacgttaaccgttcggtacggtccggtaaagggtaacgggaccgggttacctttaaggttttaagtttacgggtttaaggttttttaggggtaagggtttttacggggttttaacgttttttcccgggaaacccttaacccccggtttaaagggtaaccggttcccgggggtaaccgggggggttacccttccccgggttaaaccccggggttccggggggtacccgtaaacggggggtaaccttaccggttaccggggttacctaaccccgggtttaccgtttaccccgtttaaccgggttcccctaacccccggtaaacccggtaaacccgggggtacccccctaacgggtttcccccgggtttacccccgttttacccccccggtcggtacccccttaaccccccgttcccgtaaccccggtaaccgggtaccgtaaccccccgg

SEQ ID NO: 141416 - DNA, 572 bp, Homo sapiens
  misc_feature: GYAE6OF02GC9OD.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacaccttatttaaattggtatcaacatagaccagggacggcccctaagctcctaatctatgctgcatccagtttcgacgtaaaggtcggggtacccagtcggtaggttcaggtggcaggtggatcgtggacagtattcactctcaccatcagtatctgacagtagaagtatttagactaacttattactgtacaactagtaattactaagttcgtttacggactaacgggacctaacgtaacttaaactaaaacttaaacgaacgttacgtaggtactacgaccgtaacctacttccttacgttcttacctacttcccgttccccgactacttctagtaac

SEQ ID NO: 141417 - DNA, 563 bp, Homo sapiens
  misc_feature: GYAE6OF02H6BKZ.46.67.G01.1.454.CMB.1.raw
  modified_base (336)..(336): a, c, t, g, unknown or other
  misc_feature (336)..(336): n is a, c, g, or t
  modified_base (503)..(503): a, c, t, g, unknown or other
  misc_feature (503)..(503): n is a, c, g, or t
  modified_base (544)..(544): a, c, t, g, unknown or other
  misc_feature (544)..(544): n is a, c, g, or t
  modified_base (552)..(552): a, c, t, g, unknown or other
  misc_feature (552)..(552): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggcctttcggagacccctgtcccctcaccctgcgctgtctctggtgcctccatcagtagtggtttcttctggggctgggtccgcagctcccgagggagggctggatacagttggaagtgtctctcatagtggaggttcctattacagtccgtctctcaagagtcgagtcaccatatctctgacacgtccagcaatcacgttttcccngaagatgagttctgtgaccgccgctgaccgacgggtcgttttattacgtgtgcgagagaccggtctattagtgttattttggagttggtttatttcgactaccctagatcggacggggcctcggaccccgtgggccgagggactacgtgtccacgtcctccgttacncctacccaccgacggcccagtccgttccttccccgtgcccnccctcccnccacgatcccg

SEQ ID NO: 141418 - DNA, 566 bp, Homo sapiens
  misc_feature: GYAE6OF02G3ATO.46.67.G01.1.454.CMB.1.raw
  modified_base (289)..(289): a, c, t, g, unknown or other
  misc_feature (289)..(289): n is a, c, g, or t
  modified_base (340)..(340): a, c, t, g, unknown or other
  misc_feature (340)..(340): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgagggaaggggctggaatacattggaagtgtctctcatagtggaggttcctattacagtccgtctctcaagngtcgagtcaccatatctctggacacgtccagcaatcagttttcccagaagntgagttctgtcgaccgccgctgacacgggtctttatactgtgcgagagacggctattagtgttattttggagttggttatttcgactacccgtagacgtcggacggggctccgacccgtggggaccgagggtaactacgtgtccaccgtctccttacgcctccgaccgaacgggcccagtccggtaccttccccgtcggccctaccctccctaccacgcgtacccg

SEQ ID NO: 141419 - DNA, 546 bp, Homo sapiens
  misc_feature: GYAE6OF02IL5IE.46.67.G01.1.454.CMB.1.raw
  modified_base (213)..(213): a, c, t, g, unknown or other
  misc_feature (213)..(213): n is a, c, g, or t
  modified_base (539)..(539): a, c, t, g, unknown or other
  misc_feature (539)..(539): n is a, c, g, or t
tcagactagcagtacacgaccggtgctcgatttagagtatacatattggggtttgggggacctcctgtgcaagaacatgaagcacctgtggtttgtcctcctgctggtggcagctcccagatgggtcctgtccctggtgcaactgcaggagtcgggcccacgactggtgaggcctttcggagaccctgtccctcacctgcgctgtctctggtncctccatcagtagtggtttcttctgggggctgggtccggcagcctcccgagggaaggggctggaatacattggaagtgtctctcatagtggaggttcctattacagtccgtctctcaagagtcgagtcaccatatctctggacacgtccagcaatcagttttcccagaagatgagtttctgtcgaccgccgctgacgacgggtcgttttatacgtgtgcgagagacggctattatgtagtttttggagttggtttattcgactaccctagatcgacggggctccggacccgtgggccagggatacgtcggtcaccgtctccgttcncctaccg

SEQ ID NO: 141420 - DNA, 604 bp, Homo sapiens
  misc_feature: GYAE6OF02GVH8J.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacgttgccgggcaagtcggaacattgacacctatttaaatgtatcaacatagacaggacggaccctaagctcctaatctatgctgcatcctagtttgacgaaagtcgggtccaagttcggaggttacaggttcggacgtagtggaattcgagggtacctaagtactttcacttctacaaccagttacagtaactcgtgacgtaacgtagtaagtatttagactaacttattactgtacaaactagtaaattactaagttgtttacggacgaagggaaccaacgtaacctaactaaaacgttaaacgtaaactacggtgacttacggactaaacctacttaccgttacgttacctttaccgtacttcccgttaccccgacctacgttcgtacgttaacg

SEQ ID NO: 141421 - DNA, 560 bp, Homo sapiens
  misc_feature: GYAE6OF02H8IHB.46.67.G01.1.454.CMB.1.raw
  modified_base (256)..(256): a, c, t, g, unknown or other
  misc_feature (256)..(256): n is a, c, g, or t
  modified_base (402)..(402): a, c, t, g, unknown or other
  misc_feature (402)..(402): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatccctccctgtctgcaaccgtgggagacagtgtcaccatcacttgccgggcaagtcggaacattgacactatttaaattggtatcaanatagaccagggacgcccctaagctcctaatctatcgctgcatcctagtttgacgtaaaggttcggggtacccagtcgaggttcaggtggacaggtggatcgtgggacagtatttcactctcacatcatatctgacaagtgtaagtntttagactaattattactagtacaactagtaattactaattggtttaccgacgtaggtacacgtaactaaacgtaaacttaaacgaacgttagtaggtactagtaccactattcgtcgttacttactacttccctcccgtacctacttacctgttaac

SEQ ID NO: 141422 - DNA, 666 bp, Homo sapiens
  misc_feature: GYAE6OF02IQHTX.46.67.G01.1.454.CMB.1.raw
  modified_base (214)..(214): a, c, t, g, unknown or other
  misc_feature (214)..(214): n is a, c, g, or t
  modified_base (239)..(239): a, c, t, g, unknown or other
  misc_feature (239)..(239): n is a, c, g, or t
  modified_base (252)..(252): a, c, t, g, unknown or other
  misc_feature (252)..(252): n is a, c, g, or t
  modified_base (337)..(337): a, c, t, g, unknown or other
  misc_feature (337)..(337): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcgggagacccctgtccctcacctgcgctgtctctggtcncctccatcagtagtcggtttctcgngggctgggtccgnagcctccgagggacgggctaggatacgattggaagtgtctctctagtagtggtagttccttattacgacgtccgtctctacaagngtcgagtcactatactctctaggactacgtacagctaactctacgttttcccagaatactgtagttactgtacgaccgtcgtacgtcgacgtacgggttccttttaagtacgttcggtacgtacggtagaacgggtacgtacttaagttagttcgttaagtttttcgggtagtttaggtttacgtttacgaacccgttaaccgttaaggtacgttaccggggtaccgggggtccttcccgggtaaccccggttcgggggacccgttaaacgggtaccttacgggtccggttaccgtacccgttcgttacccgttacgccccttacccgg

SEQ ID NO: 141423 - DNA, 619 bp, Homo sapiens
  misc_feature: GYAE6OF02JZ21X.46.67.G01.1.454.CMB.1.raw
  modified_base (192)..(192): a, c, t, g, unknown or other
  misc_feature (192)..(192): n is a, c, g, or t
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggnaagtcggaacattgactacctatttaaatggtatcaacatagacaggacgcccctaagctctaatctatgctgcatcctagtttacgactaaaggtcgggtacccagtcgtaggttcagttcggactagtcggatcgtagggactaggtactttacacgttctacgtaccattacagtaatctagcaaacggtgaagtatttcgactaacgtttacttacgttacgttacaaacgtataaacttaactaagtttacggttttaccggaaccgttaacggggaacctaaccggttaacctaaaccgtaaacgtttaaaaccgaccgttaggttacggtactacggtaccaaccgtacttcgtacgtacttactacttccgtaacccgtcacttcgtataaccg

SEQ ID NO: 141424 - DNA, 608 bp, Homo sapiens
  misc_feature: GYAE6OF02FIMH2.46.67.G01.1.454.CMB.1.raw
  modified_base (330)..(330): a, c, t, g, unknown or other
  misc_feature (330)..(330): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccggcagcctcccgagggaaggggctggaatacattggaagtgtctctcatagtggaggttcctattacagtccgtctctcaagngtcgagtcaccatatctctggacacgtccagcaatctagttttccctgaagtatgtagttctgtgaccgccgctgacgacgggtacgtttattacgttgtcgacgagaggacgtctattattgtagtttttgggagttggtttagtttcgtactacccgttagacgtcgggtaccgggggtcctacccggtaccccggttcggggacccggtaaggggtaacgtacgttacgggttaccctacccggttccttacccgtttaccggcccttaaccccg

SEQ ID NO: 141425 - DNA, 512 bp, Homo sapiens
  misc_feature: GYAE6OF02G5HSW.46.67.G01.1.454.CMB.1.raw
  modified_base (386)..(386): a, c, t, g, unknown or other
  misc_feature (386)..(386): n is a, c, g, or t
  modified_base (486)..(486): a, c, t, g, unknown or other
  misc_feature (486)..(486): n is a, c, g, or t
tcagactagcagtacacgaccggtgctcgatttagagtatacatattgggtttggggagtctcggtcaggacacagaatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctcctaatctatgctgcatccagtttgcaaagtggggtcccatcgaggttcagtggcagtgatctgggacagatttcactctcaccatcagtaatctgcaagtgaagtnttttgactaacttattactgtacaaacagtaattacaattgtttacgaccaagggtacacgtaactaacaaattaaacgactagtggactgacacatctntctctatcctccgcctatctgtatac

SEQ ID NO: 141426 - DNA, 619 bp, Homo sapiens
  misc_feature: GYAE6OF02I3GLL.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatctgggacagtattcactctaccacatacagtaatctgctaacgtgtaagtattttgactaacttattaacctgttacaacgtaacgtaatttaacctaatttcgttttaccgggacccgtaaaggggtaacctaaccggtaacgttaaacctaaaaacgtttaaaaccggaaacctttacggtacggttcctaacggtaccaaccctaacgttaccttcggttcctttaccgtacgtttcccgtttaccccggacccttaaccttccgtacggttaac

SEQ ID NO: 141427 - DNA, 606 bp, Homo sapiens
  misc_feature: GYAE6OF02GWZ1K.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgagggaaggggctggaatacattggaagtgtctctcatagtggaggttcctattacagtccgtctctcaagagtcgagtcacatatctctggacacgtccagcaatctagttttcccagaagatgtagttctgtgaccgccgcgtgacgacgggtcgttttattacgtgtgcgagagacggctattatgtagttttggtagttggttattcgtactaccgtagacgtcggacgggtccgtaccggtacccgtacgggccgaagggtaactacgttcggtaccgtaccgttccgtaccgttaccgccctccgaaccgtaacgggaccctacgtcccggttacccttcccccgtcggccctacccctcccgtacccgacggtctaccccg

SEQ ID NO: 141428 - DNA, 560 bp, Homo sapiens
  misc_feature: GYAE6OF02G0ZF2.46.67.G01.1.454.CMB.1.raw
  modified_base (449)..(449): a, c, t, g, unknown or other
  misc_feature (449)..(449): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttccctgaagatgagttctgtgaccgcgctgacacgggtcgtttattacgtgtgcgagagacggctatttatgttagttttggagttggttatttcgactaccctagatcggacggggtcncgacccgtgggcagggaatcgtgtcgaccgtctccttagcctccaccgaacggcccacgtccggttacccttccccgtcggccctaccccgtccctaccgacgcgtacccg

SEQ ID NO: 141429 - DNA, 702 bp, Homo sapiens
  misc_feature: GYAE6OF02IQ88O.46.67.G01.1.454.CMB.1.raw
  modified_base (213)..(213): a, c, t, g, unknown or other
  misc_feature (213)..(213): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactgggtgaggccttcgggagaccctgtccctcacctgcgctgtctctggtgcctccatcagtagtggtttcttcgtgggctgggtccggnagctccgagggagggctggaatacagttggaagtgtctctcataggtggtaggttcctattacagtccgtctctcaagagtcgagtcaccatatctctggacacgtccagacaactctacgttttcccaggaacgatgtagttctgtcgaccgcccgcgtacgaaccgtacggggtacgttttattacgtggttgacggaaggacggtacggtacttaatttagttagtttagtttttagggtaggttaggtttaattttccggaacctacccgtaggtaccgttaccggggacgggggtcctacccggtaccccggttgggggacccgtaaggggtaacttaccggttcgggtaccctacccggttccgttacccgtttaacgtccccgtacccgaacccggaaccgggtcccctagggttccccgttacccgtttccccccggtcggccctacccccgttacccgtacccgaacgtccgtaccccgg

SEQ ID NO: 141430 - DNA, 615 bp, Homo sapiens
  misc_feature: GYAE6OF02GJED9.46.67.G01.1.454.CMB.1.raw
  modified_base (412)..(412): a, c, t, g, unknown or other
  misc_feature (412)..(412): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgagggaaggggctggaatacagttggaagtgtctctcatagtggaggttcctattacagtccgtctctcaagagtcgagtcaccatatctcgtggacacgtccagacaactctacgttttcccagaagtatgtagttcgtgtcgaccgccgtctacgacgtacgggttctttattacgtgtgcgagagacggtntattagttgttagttttggtagttgtttagttcgactacccgttagacgtcgggacgggtcctaccggacccggtggggaccgaagggtactaccgtggtcctacgtccttaccgtacgccctaccgaccgtaacgggccctacggttcccgttcccgttccccgtcggacccctacccgttccctacccgacgacgtacccg

SEQ ID NO: 141431 - DNA, 521 bp, Homo sapiens
  misc_feature: GYAE6OF02GMKIV.46.67.G01.1.454.CMB.1.raw
  modified_base (420)..(420): a, c, t, g, unknown or other
  misc_feature (420)..(420): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaatgtatcaacatagaccagggacggcccctaagctcctaatctatgctgcatccagtttgctaaagtggggtcccatcgaggttcagtggcagtggatctggggacagtatttcacttctacaccatcagtaactctgcaacgtgaagtattttgactaacttattactgtacaactanaattacaattgtttcgaccgaagggacacgtactacaaattaaacaactgtagctgacacctatcctgtcttacacttccttcccgtacctacttctgtac

SEQ ID NO: 141432 - DNA, 619 bp, Homo sapiens
  misc_feature: GYAE6OF02JC8EQ.46.67.G01.1.454.CMB.1.raw
  modified_base (193)..(193): a, c, t, g, unknown or other
  misc_feature (193)..(193): n is a, c, g, or t
  modified_base (213)..(213): a, c, t, g, unknown or other
  misc_feature (213)..(213): n is a, c, g, or t
  modified_base (250)..(250): a, c, t, g, unknown or other
  misc_feature (250)..(250): n is a, c, g, or t
  modified_base (326)..(326): a, c, t, g, unknown or other
  misc_feature (326)..(326): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggcctttcggagaccctgtccctnacctgcgctgtctcgtggtncctcatcagttagtggtttctgtggggctgggtccgnagctccgagggaggctggatacgattggaatgtctctcagtagtggacggttctattacgagtccgtctctcaagngtcgagttcactatagtctcgtgactacgtccacgcaagttctacgttttcccagtaacgtagtacgtagttctggtcgaaccgtccgctgaacgtcgggtactttaagttactggttgacgtaaggcgtacggtacttagttagtagttacgtttttagggacgtttggttaacttttccgaacgttacccgtaagtacgttacgggacgggtcgtaccggtacccgtggggtacccgaaggtaacgttcgtacggttactacccgttgtacccgttacgtccctaacccgg

SEQ ID NO: 141433 - DNA, 660 bp, Homo sapiens
  misc_feature: GYAE6OF02JC8Z4.46.67.G01.1.454.CMB.1.raw
  modified_base (211)..(211): a, c, t, g, unknown or other
  misc_feature (211)..(211): n is a, c, g, or t
  modified_base (328)..(328): a, c, t, g, unknown or other
  misc_feature (328)..(328): n is a, c, g, or t
  modified_base (347)..(347): a, c, t, g, unknown or other
  misc_feature (347)..(347): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttcttctggggctgggtccgcagctcccgagggaaggggctggaatacattggaagtgtctctcatagtggaggttcctattacagtccgtctctcaagngtcgagtcaccatatctcnggacacgtaccagctaatctacgtttttcccagaagtattgtagtttcttaggttcgaccccggtcccgtcctaggtaccgtacggggttcgttttaactttacgtggttggccgtaggacggaacgggtccttaagtttaagttgttaagttttttgggacgtttagggtttaattttccggaactacccttaaggtacgtcgggtacgggggtcctaccgggtaccccgtcgggggaccgtaacggggtaacgtttaccggtcgggttacctaacccggtcctttacccgttaccggtcccctaaccccgg

SEQ ID NO: 141434 - DNA, 595 bp, Homo sapiens
  misc_feature: GYAE6OF02JOYON.46.67.G01.1.454.CMB.1.raw
  modified_base (276)..(276): a, c, t, g, unknown or other
  misc_feature (276)..(276): n is a, c, g, or t
  modified_base (320)..(320): a, c, t, g, unknown or other
  misc_feature (320)..(320): n is a, c, g, or t
  modified_base (333)..(333): a, c, t, g, unknown or other
  misc_feature (333)..(333): n is a, c, g, or t
  modified_base (355)..(355): a, c, t, g, unknown or other
  misc_feature (355)..(355): n is a, c, g, or t
  modified_base (386)..(386): a, c, t, g, unknown or other
  misc_feature (386)..(386): n is a, c, g, or t
  modified_base (391)..(391): a, c, t, g, unknown or other
  misc_feature (391)..(391): n is a, c, g, or t
  modified_base (396)..(396): a, c, t, g, unknown or other
  misc_feature (396)..(396): n is a, c, g, or t
tcagactagcagtacacgaccggtgctcgatttagagtatacatattgggtttgtctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcaggctcccgagggaaggggctggaatacagttggaagtgtctctcatagtggaggttcctattacngtccgtctctcaagagtcgagtcacatatctctgacacgtcagnaatcagtttcccngtaagatgattctgtcgccgcnctgactacgggtctttatacgtgtgcgtagngacgnttatntgtagttttggagtttggttacttcgtactaccttagacgtcggtacggggtctaccggacccggtagggccgaggtaacgtacgttcgtaccgaccgttcgtaccgttcgcccgttaccgaccgtaaccgggtccctacggttcccggttccttacccccggtcggccctacccctccgtacccgtacgccgtacccg

SEQ ID NO: 141435 - DNA, 576 bp, Homo sapiens
  misc_feature: GYAE6OF02IOIOG.46.67.G01.1.454.CMB.1.raw
  modified_base (283)..(283): a, c, t, g, unknown or other
  misc_feature (283)..(283): n is a, c, g, or t
  modified_base (396)..(396): a, c, t, g, unknown or other
  misc_feature (396)..(396): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccgcagctccagggagggctggaatacattggaagtgtctctcatagtggagttcctattacagtccgtctctcaagngtcgagtcaccatatctctggacacgtcagacaatctacgttttcccagaacgatgtagttctgtcgaccgcgctgacgacgggtctttaattactgtgacgtagagacggtntattagtgttagttttggagttggtttattcgactacctagatcggacggggctccgcccgtgggccaagggactacgtcggtccaccgtcctccgttacgccctaccgaccgaacggcccagttaccggtcccttacccccggtgaccctacccctaccctacccgaagaccgtacccg

SEQ ID NO: 141436 - DNA, 574 bp, Homo sapiens
  misc_feature: GYAE6OF02GIV6P.46.67.G01.1.454.CMB.1.raw
  modified_base (285)..(285): a, c, t, g, unknown or other
  misc_feature (285)..(285): n is a, c, g, or t
  modified_base (331)..(331): a, c, t, g, unknown or other
  misc_feature (331)..(331): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccgcagctcccagggagggctggaatacattggaagtgtctctcatagtggaggttcctattacagtccgtctctcaagngtcgagtcaccatatctctggacacgtccagcaatcagttttcccngaagatgtagttctgtgaccgcgctgacacgggtcttttattactgtgcgagagacggctattatgtattttggagttggtttatttcgactaccctagtacgtcggacggggctcgacccgtggggccagggatacgtggtctaccgtcttccgttacgcctcccaccgaacgggtcccctacgtccggttccctttccccccgtggtcccctaccccgtccctacccgaacgacgtacccg

SEQ ID NO: 141437 - DNA, 609 bp, Homo sapiens
  misc_feature: GYAE6OF02F1OJB.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagaatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacactatttaaatggtatcaacatagaccaggacggcccctaagctcctaatctatgctgcatccagtttgactaaagtcggggtcccagtcgtaggttcagtggcagtggatcgtgggacagtatttcactctcacctatacagtatcgtgactaaacgtgtaagtatttacgacttaaacttattactgtacaacgtagtaattaactaaatttcggttttaccggacgtaaacgggtacctaacgtaacctaacgtaaaacgttaaaccgtaacgttaggtacgtaccttacggacctaacccgtaacttcctttacggttaccttacgttacttcccgtttaccccgaccttaactccgttagtactttaaccg

SEQ ID NO: 141438 - DNA, 559 bp, Homo sapiens
  misc_feature: GYAE6OF02FM6FZ.46.67.G01.1.454.CMB.1.raw
  modified_base (212)..(212): a, c, t, g, unknown or other
  misc_feature (212)..(212): n is a, c, g, or t
  modified_base (250)..(250): a, c, t, g, unknown or other
  misc_feature (250)..(250): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtcccctcacctgcgctgtctctggtncctccatcagtagtggtttctcgtggggctgggtccgnagctcccgagggagggctggaatacattggaagtgtctctcatagtggaggttcctattacagtccgtctctcaagagtcgagtcaccatatctctggacacgtccagcaatctagttttccctagaacgtatgtacgttctgtgacccgccgcgtgacgcgggtcgtttattacttgtgcgagagacgtctattatgttagtttttggagttggtttatttcgtactaccctagacgttcggacggggtctccggacccgtgggccgaaggtactacgtggttccaccgtctccgttacgcctacccg

SEQ ID NO: 141439 - DNA, 567 bp, Homo sapiens
  misc_feature: GYAE6OF02GA4IE.46.67.G01.1.454.CMB.1.raw
  modified_base (332)..(332): a, c, t, g, unknown or other
  misc_feature (332)..(332): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgagggagggctggaatacattggaatgtctctcatagtggaggttcctattacagtccgtctctcaagagtcgagtcaccatatctctggacacgtccagcaatcagttttcccngaagatgagttctgtgaccgcgctgacacgggtcgttttatactgtgcgagagacggctattatgtattttggagttggttatttcgacaccctagatcgacggggtctcgaccccgtggggccaggggaatacgtggtccaccgtctccttagccctccaccgaacgggcccacgttccggtaccctttccccctcgggtccctaccccgttccctacccaacggtacgacccg

SEQ ID NO: 141440 - DNA, 610 bp, Homo sapiens
  misc_feature: GYAE6OF02GARZ3.46.67.G01.1.454.CMB.1.raw
  modified_base (302)..(302): a, c, t, g, unknown or other
  misc_feature (302)..(302): n is a, c, g, or t
  modified_base (434)..(434): a, c, t, g, unknown or other
  misc_feature (434)..(434): n is a, c, g, or t
tcagactagcagtacacgaccggtgctcgatttagagtatacatattgggtttgtcctcctgctggtggcagctcccagatgggtcctgtccctggtgcaactgcaggagtcggcccacgactggtgagcctcggagaccctgtccctcacctgcgctgtctctggtgcctccatcagtagtggtttcttcgtgggctgggtccgcagctcccgagggagggctggaactcatggagtgtctctcataggtgaggttcctagttaccagtccgtctctcaagcgtcgatcacccatactctntggacacgtccagcaatcacgttttcccctgaacgtatcgacgttctgtcggacccgccgtctcgaccacgggtcttaacttcgtagtcgcgagcgacggctaatactgtatttggagttgttattcgtacncccgtagactcggacggggtcctaccgaccccgtggggacctagggtaaacttaacgttcgggttaccaaccgttctacccgttacggccccttaccgaacccgtaacgggccctaacgttccggttcccgttacccccgtcggccctaccccgtccctacccgacgtccgacccg

SEQ ID NO: 141441 - DNA, 554 bp, Homo sapiens
  misc_feature: GYAE6OF02I5NA1.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagtattttgactaacttattacttgtacaactagaattactaattagtttcggacctaagggacacgacttaacaaattaaaccgaattagtaggactacggaccaacctattacctagttacctttccgtaacttccctttacccggaccctacttccgtagttaacg

SEQ ID NO: 141442 - DNA, 613 bp, Homo sapiens
  misc_feature: GYAE6OF02JF2ZU.46.67.G01.1.454.CMB.1.raw
  modified_base (195)..(195): a, c, t, g, unknown or other
  misc_feature (195)..(195): n is a, c, g, or t
tcagactagcagtacacgaccggtgctcgatttagagtatacatattgggtttggggagtctcggtcaggacacagcatggacatgagggtccccgctcagctcctgggggctcctgctactctggctccgaggtgccagatgtgacatcgagctgacccagtctccatccctccctgtctgcaaccggtggganacagtgtcaccatcacttcggccgggactaacggtcggaaactattgaacctaccttaattttaaaattggtaatacaacatacgaaccgacgggaccggcccctaagcttacctaatctatgctgcatcctagtttgacgtaaaggtcgggtcccatcgtaggttcaggtcggctaggtgtatcgtgggacagtattcactctccactactacagttactcgtacgactaagtgaagttatttgactaacttattcgtatactaactagtaacttactaagttcgtttaacgacgtaaacggactaacggtaactaactaaaacgttaaacgtaacgtagttacggtctacggtacctaaccgtattacgttacgttccttacgtacttcccgtacccgtactactacttagtaacg

SEQ ID NO: 141443 - DNA, 507 bp, Homo sapiens
  misc_feature: GYAE6OF02G5957.46.67.G01.1.454.CMB.1.raw
  modified_base (504)..(504): a, c, t, g, unknown or other
  misc_feature (504)..(504): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccagtcgaggttcagtggcagtgatctgggacagatttcactctcaccatcagtaatctgcaacgtgaagtattttgctaacttattacttgtcaacagtaattacaattgtttacggacaagggacacgactaacaaattaaacgaactgtgctgacacatctgtcttcatcttcccgcctactctntac

SEQ ID NO: 141444 - DNA, 556 bp, Homo sapiens
  misc_feature: GYAE6OF02H9GHS.46.67.G01.1.454.CMB.1.raw
  modified_base (180)..(180): a, c, t, g, unknown or other
  misc_feature (180)..(180): n is a, c, g, or t
  modified_base (218)..(218): a, c, t, g, unknown or other
  misc_feature (218)..(218): n is a, c, g, or t
  modified_base (393)..(393): a, c, t, g, unknown or other
  misc_feature (393)..(393): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtccngacaacgtgggagacagtgtccacatcacttgccgggnaagtcggaacattgaccactatttaaatggtatcaactatagaccaggacggccctaagctacctaatcctatgctgcatcctagtttagcaaagtcgggtacccagtcgaggttcagtggcagtgatcgtaggacagtattcacttctcacgatcaagtaactctgacaacgtnaagtctttagactattatactgtacaacagtaattacaattcgtttacggactaacgggacaacgtacctaaataaacgttaaagaaccttgtaggcttacggctaaacccagttacttgtaccttattacgttacccttccgaccctatttaccagttaacc

SEQ ID NO: 141445 - DNA, 518 bp, Homo sapiens
  misc_feature: GYAE6OF02FRPSQ.46.67.G01.1.454.CMB.1.raw
  modified_base (459)..(459): a, c, t, g, unknown or other
  misc_feature (459)..(459): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgcccctaagctcctaatctatgctgcatccagtttgcaaagtgggtcccatcgaggttcagtggcagtggatcgtgggacagtatttcactctcaccatcagtaatctgcaacgtgtaagtattttagactaaactttattacttgtacaacagtaattactaatgtttacgactaaggacaacgactaanaaattaaacgaactgtgctagcaacatctgtcttctacttcctcccgcacttctgtaac

SEQ ID NO: 141446 - DNA, 546 bp, Homo sapiens
  misc_feature: GYAE6OF02IZNK5.46.67.G01.1.454.CMB.1.raw
  modified_base (371)..(371): a, c, t, g, unknown or other
  misc_feature (371)..(371): n is a, c, g, or t
  modified_base (432)..(432): a, c, t, g, unknown or other
  misc_feature (432)..(432): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccgcagctcccgagggaagggctggaatacattggaagtgtctctcatagtggaggttcctattacagtccgtctctcaagagtcgagtcaccatatctctgacacgtccagcaatcagttttcccngaagatgagttctgtgaccgccgctgacgtacgggtcgtttattacgtgtgcgagagcggntattatgtattttggagttggttatttcgtacacccgtagagtcgtacggggctccggtaccccgtgggccgagggtactacgtcggtcgaccgtcctacgttacgcctacccg

SEQ ID NO: 141447 - DNA, 579 bp, Homo sapiens
  misc_feature: GYAE6OF02I3JOG.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccgcagctccagggagggctggaatacagttggaagtgtctctcatagtggaggttcctattacagtccgtctctcaagagtcgagtcaccatatctctggacacgtccagcaatctagttttccctgaagatgtagttctgtcgaccgccgctgacgtacgggtcgtttattacgtgtgcgagagacggctatatgtattttggagttggttatttcgactaccgtagtacgtcggacggggtctccggacccgtcggggccgaagggtactacgtcgtaccgtaccgttctccgttacgtccctccgaccgtaacggccctacgtccgtccgttccccgtcgccctaccctcccgtaccgtacgcgtacccg

SEQ ID NO: 141448 - DNA, 545 bp, Homo sapiens
  misc_feature: GYAE6OF02FOA90.46.67.G01.1.454.CMB.1.raw
  modified_base (490)..(490): a, c, t, g, unknown or other
  misc_feature (490)..(490): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgaggggaaggggctggaatacagttggaagtgtctctcatagtggaggttcctattacagtccgtctctcaagagtcgagtcaccatatctctggacacgtccagcaatcagttttccctgaagatgagttctgtcgaccgccgctggacgacgggtcgtttattactgtgcgagacgacggctattatgtagttttggagttgttatttcgacaccttagatcggacgggctcgacccgtgggccagggactacgtgtcaccgtctcctancctcgaccgacggcccagtccgtccttcccctgccctaccctcctccagctaccg

SEQ ID NO: 141449 - DNA, 639 bp, Homo sapiens
  misc_feature: GYAE6OF02G83FO.46.67.G01.1.454.CMB.1.raw
tcagactagcagtacacgaccggtgctcgatttagagtatacatagttggggtttggggagtctcggtcaggacacagcatggacatgagggtccccgcgtccagctcctggggctcctgctactctggctccgaggtgccagatgtgacatcgagctgacccagtcctccatcctccctgtcctgcaaccgtggagacagtgtcaccatccacttgccgggtcaacggtcggaacattgactacctatttaagtgtatcaactataagaccagggacgacccctaagcctacctaatcctatcgctgcatccagtttgcaaagtcgggtacccagtcgaggttcagtggactagtggatgtagggactagtatttcactcgtacaccgtatcaagtaatctgacacgtgaagtatttacgacttaacttattacgttagtaccaaactacgtaaacttaactaagtttcgtttaccggaaccgtaaagggtacctaaccggttaaactaaccgtaaaacgttaaaccgaaccgttaggtacggtacctacggtaccgtaacctaagttccgttaagttaccctttacgtaaccgtttcccgttaccccggaccttaccgtttaccgtacgttaacccg

SEQ ID NO: 141450 - DNA, 518 bp, Homo sapiens
  misc_feature: GYAE6OF02GB5L7.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggcatcaacatagaccagggacgcccctaagctcctaatctatgctgcatccagtttgcaaagtgggtccatcgaggttcagtggcagtggatcgtgggacagtatttcactctcaccatcagtaatctgcaacgtgaagtatttgactaacttattactgttacaacagtaattacaattgtttacggacctaagggacacgtaactaactaaacttaaacgaactagtacgactagacaccatctgtcttcattccttcccgctatctacg

SEQ ID NO: 141451 - DNA, 616 bp, Homo sapiens
  misc_feature: GYAE6OF02JLD9Y.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggagacagtgtcaccatcacttgccgggcaagtcggaacattgacactatttaaattggtatcaacatagaccaggacgccctaagctctaatctatgactgcatccagtttgacaaagttcgggtacccatcggtagttcagtggacagtggatcgtagggacaggtatttcgacttctacacctatcagtaactcgtagactaacgtgtaagtagtttacgacttaactttattaacttacgtacaaactaagtaactttaacgtaatttcgtttaccggaccgtaaacgggtacctaacgtaacgttaaacctaaagttaaaccgtaaacttcggtaaggtcgtacgtaccgtaaccgtaacgttacgttacgtttaccgttacgtactttcccgttacccgtacctaccgttactaccgttaacg

SEQ ID NO: 141452 - DNA, 572 bp, Homo sapiens
  misc_feature: GYAE6OF02IWRN5.46.67.G01.1.454.CMB.1.raw
  modified_base (256)..(256): a, c, t, g, unknown or other
  misc_feature (256)..(256): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttcgccgggcaagtcggaacattgacactatttaaattggtatcaanatagaccgagggaccgcccctaagctacctaatctatgctgcatcctagtttagacgtaaaggtcgggtacccagtcggtaggttcaggtggcgtaggtggtagtcgtagggacagtatttcactctacacctatacgagttaactctacgactaacgtagtaattgtttgacttaacttattactgtacaatataattacagttcgttaccggacgtaacggacaacgtactaactaaaacgtaaacgtattgtacggtactacgaccacctagtctacgttaccttcacttcccgttacccgactactctatac

SEQ ID NO: 141453 - DNA, 587 bp, Homo sapiens
  misc_feature: GYAE6OF02HX11O.46.67.G01.1.454.CMB.1.raw
  modified_base (257)..(257): a, c, t, g, unknown or other
  misc_feature (257)..(257): n is a, c, g, or t
  modified_base (340)..(340): a, c, t, g, unknown or other
  misc_feature (340)..(340): n is a, c, g, or t
  modified_base (354)..(354): a, c, t, g, unknown or other
  misc_feature (354)..(354): n is a, c, g, or t
  modified_base (462)..(462): a, c, t, g, unknown or other
  misc_feature (462)..(462): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggcctttcggagacccctgtccctcacctgcgctgtctctggtcgcctccatcagttagttggtttcttcgtggggctggggtccggnacgctcccgagggaaggggctaggaatacattggaagtgtctctcagtagtggaggttcctattacagttccgtctctcaagngtcgagtccacatntctctggacaccgtcagcaactctacgttttcccagaagagtgtacgtttctgtcgaccgcccgtctgacgacgggtactttattactgtgcgagagacgtctagttntgttagtttttggagttggtttattcgactacgtagtctccgggacggggtctcccggtacccggtcgggacctaagggtacttacgtcggtaccgcccgttactcccgttacgtccctaacccg

SEQ ID NO: 141454 - DNA, 635 bp, Homo sapiens
  misc_feature: GYAE6OF02GSB17.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatcgtgggacagatttcactctcacatcagtaatctgcaacgtgaaagtattttacgactaacgttaactttacgttagtactaaactaagtaaactttactaaagtttacgtttttaccgggaccgtaaacggggtaaccaaaccggtaacttaaacctaaaaagtttaaaaccggaaaccttaggttacggacgttacggtaacctaacccgtaactttccgttacgtttccgtttaacctacgtttacccgtttacccccggtaccctaacgtttcccgttacggttaacc

SEQ ID NO: 141455 - DNA, 588 bp, Homo sapiens
  misc_feature: GYAE6OF02IQT7K.46.67.G01.1.454.CMB.1.raw
  modified_base (192)..(192): a, c, t, g, unknown or other
  misc_feature (192)..(192): n is a, c, g, or t
  modified_base (475)..(475): a, c, t, g, unknown or other
  misc_feature (475)..(475): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacactatttaaatggtatcaacatagaccgagggacggcccctaagctactaatctatgctgcatccagtttgactaaacgtgggtacccagtcgagttcagtgacagtgatcgtgggacagattcactctacaccatcagtaatctagactaacgtgaacgtagttttacgactaacgtttatacttacgtacaacaagtaattacaattcgtttcgactaaagggactacgtaaccttaaanaaaacgttaaacgaacttacgtagtactaggtacctaaccgtaacttaccgttacgttaccgtttacctaaccgtttccctacccggttaccctaacgttacctaggttaacc

SEQ ID NO: 141456 - DNA, 608 bp, Homo sapiens
  misc_feature: GYAE6OF02GHWZ8.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctggggtccggcagctcccgaggggaagggctggaatacagttggaagtgtctctcagtagtggaggttcctattacagtccgtctctcaagagtcgagtcacccatatctctggacacgtccagcaatctacgttttcccagaagtatgtagttctgtcgaccgccgctcgacgacgggtcttttaactacgtgtgcgaggacgacggcttagtttagtgttagtttttggagtttggttatttcgacctacccgttagacgtcgggacggggtctaccggtaccccggtggggccgaagggtactacgttggtaccaccgttctccttacgtccctccgaaccgacgggaccctaggtcccgtcctttccccgcggtccctaccccgtcctacccgagcctacccg

SEQ ID NO: 141457 - DNA, 701 bp, Homo sapiens
  misc_feature: GYAE6OF02I9KJA.46.67.G01.1.454.CMB.1.raw
tcagactagcagtacacgaccggtgctcgatttagagtatacatagttcgggtttagtcctccctgctggtggccagctcccagatgggtcctgtccctggtgcaactgcaggagtcgggccctacgactggtgaggccttcggagaccctgtccctcacctcgcgctgtctctggtcgcctccatcagtagtggtttctcgtgggctgggtccgcagctcccgagggagggctggaatacgagttggaagtgtctctcgagtagtggaggttcctagttacacgtccgtctcctcgaagtagtcgagtcactatagtctcgtgacacgtcagacaatcgtacgttttcccagaacgtatgtacgttcgtgtcgtaccgcgtcgtacgacgtacgggttacttttacgttacgttcgtagcgtaggacgacggtacttaagttagtagtttagttttagggagtttaggtttacgtttccgtaactacccgtaggtaacgttaccgggaccgggggtccttccgggtacccgttacggggacccgtaacggggtaacgttaccgttcggttaccgtacccggttaccgttaccgttacgtacccgtacccgtaaccggtaacgggtcccctaaggttcccggttaccgtttccccgtacggtccctaccccgtacccgttaccgtaacggtccgtacccgg

SEQ ID NO: 141458 - DNA, 731 bp, Homo sapiens
  misc_feature: GYAE6OF02IIRGF.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctcgacccagtcctccatccctccctgtctgacaaccggtgggacgacagtgtaccaccatctacgttcggccgggacaacggtacggaaactagttacgaacctaacttaattttaaagttggtatacgaactataacgaccggacgggaccgtacccctaagcctacctaagtctatcgctcgactactccttaggtttacgacgtaaacgggtccggtaccaagttcggtaggttcgaggtcggagtaggtacgtaacgtcggtagggtaactaacggtactttaccaacttcctaccgaactacgtacgtaacgtaacttcgtacgaacgtaacggtagtaaacgttagtttacgtaaccttaatttacttacgtacggttaacaaacgtaacgttaaacgtttactaacgtttacggtttaccggaaccgtaaacggtaaccgaaacgtaacctaaacttaaaacgttaaaacgtaacgttaggttacgacgtacgtacctaacttacttaccgttaagttaccttacttaccgttacccgttacccgtaccgttaactaccgtacgttaacg

SEQ ID NO: 141459 - DNA, 715 bp, Homo sapiens
  misc_feature: GYAE6OF02I71OA.46.67.G01.1.454.CMB.1.raw
  modified_base (191)..(191): a, c, t, g, unknown or other
  misc_feature (191)..(191): n is a, c, g, or t
  modified_base (214)..(214): a, c, t, g, unknown or other
  misc_feature (214)..(214): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgganacagtgtcacatcacttgccggnaagtcgaacatgacaactatttaaatggatcaacatagaccaggaccggcccctaagctaccgtaatctaatgctgcatcctagtttacgacgtaaaggttcgggtaccctagtaccggagtttacgaggttacggcaggttaggaactcggtacggggaactaggttactttacaaccttcgaactaacctagtactaacggttaactccgtaggtaacctaaacggtagtaaacgttaactttttacggaaccttaaaaccttttaagttaaccgtttagtaacctaaacgtaaccggtaaatttaaacgtacgtttacgtttaacccggaaccggtaaacgggacctaaacggtaaccttaaaacgttaaaacgttaaaccgaaacgttacggtaacggtaccgttacggtaacctaaccgttaattcggtaactttacccgttaacgtttaaaccgtcccttttaacccggaccttaaacgttcgtaaccggttaac

SEQ ID NO: 141460 - DNA, 562 bp, Homo sapiens
  misc_feature: GYAE6OF02GVL6A.46.67.G01.1.454.CMB.1.raw
  modified_base (227)..(227): a, c, t, g, unknown or other
  misc_feature (227)..(227): n is a, c, g, or t
  modified_base (294)..(294): a, c, t, g, unknown or other
  misc_feature (294)..(294): n is a, c, g, or t
  modified_base (530)..(530): a, c, t, g, unknown or other
  misc_feature (530)..(530): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaanattgacactatttaatgtatcaacatagaccaggacgcccctaagctactaatctatgctgcatccngtttgacaaaggtcggggtcccatcggtaggttctagtggcagtggatcgtgggacaggtatttcactctcacctatacagtaatcgtgactaacggtgaagttattttagactaactttattaacttcgtacaacagtaattactaattcgtttacggaccgtaagggactaacgacttaaactaaaattaaacgaacttagtagtactacgacctaacctattctgttaccttntaccttccttcccgactacttcgtattaaccg

SEQ ID NO: 141461 - DNA, 609 bp, Homo sapiens
  misc_feature: GYAE6OF02JEQ72.46.67.G01.1.454.CMB.1.raw
  modified_base (290)..(290): a, c, t, g, unknown or other
  misc_feature (290)..(290): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttgccgggacaaggtcggaacattgactacctatttaatgtatcaacatagaccaggacgcccctaagctcctaatctatnctgcatccagtttgacgtaaaggtcggggtacccagtcgtaggttcagtggcagtggatcgtgggacagtatttcactctcacctatcagttaactctcgactaacggtagaacgtattttacgactaaactttaattaccttagtacctaaacgtaagttaaactttaactaagtttacggttttacggaccctaaagggacctaacgtaacctaaacgtaaaacttaaaccgaacttgtacgtctacgaccgtaactacttcgttagttcctttacgtacctttcccgttccccgacctaacgttccgttagtaacg

SEQ ID NO: 141462 - DNA, 795 bp, Homo sapiens
  misc_feature: GYAE6OF02HRI1J.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggcctccgaggtcgccagtatgtgacagtcgagtcgtcgacccagtcctccactccctcccgtgtctcgaccgaaccggtgggacgacgtaggtcgtaccaccatcctacgttccgggcccgggactaacggtaccggaaactagttacgaacctaacctttaaattttaaagttcggtacttaccaaactaagtaacggaccggaacggggacccgtaaccccgtaaagtcccttaaccttaacgtaccttaacgtcggtacgtacgacctaacgtacccgttaggtttacggaacgtaaaggggtcccggggtacccctaggtcggtacggttacgtagggtcgacgtaggtaggtacgttcggtaggggaactaaggttactttaccaccttactaccacctataccgtaagtaacttcgtcgtaaaccgtaacgtaggtaatttacgtttacgaacttaaacttttacgttacgttacgtaacaaagttaacttaaattaacttaaggttttcgtttaccggaacggtaacggacctaacgtaaccttaaacgttaaaacgttaaacgaccgttagggtacgtaccgtacgtaaccctacttaacttccgttacgttaccttacttaccttaccccgttacccgtaccgtacttaccggtattaaccg

SEQ ID NO: 141463 - DNA, 523 bp, Homo sapiens
  misc_feature: GYAE6OF02FHUWJ.46.67.G01.1.454.CMB.1.raw
  modified_base (228)..(228): a, c, t, g, unknown or other
  misc_feature (228)..(228): n is a, c, g, or t
  modified_base (500)..(500): a, c, t, g, unknown or other
  misc_feature (500)..(500): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacnttgacacctatttaatggtatcaacatagaccagggacgcccctaagctcctaatctatgctgcatccagtttgcaaagtggggtcccagtcgaggttcagtggcagtggatctgggacagtattcactctcaccatcagtaactctgcaacgtgaagtattttgactaacttattacttgtacaacacgtaattactaagttgttttacggaccaagggactaacgaacttaacaaattaaacgaacttgtggctgacacactctgtcttntactccttcccgcactctatacg

SEQ ID NO: 141464 - DNA, 738 bp, Homo sapiens
  misc_feature: GYAE6OF02IHY7K.46.67.G01.1.454.CMB.1.raw
  modified_base (218)..(218): a, c, t, g, unknown or other
  misc_feature (218)..(218): n is a, c, g, or t
tcagactagcagtacacgaccggtgctcgatttagagtatacatattgggtttggggtagtctcggtcaggacacagcatggacatgagggtccccgctcagctcctggggctcctgctactctggctccgaggtgccagatgtgacatcgagctgacccagtctccatcctccctgtctgcaacgtgggagacagtgtcaccatcacttgccgggtnaagtcggaacattgactactatttaaatgtatcaacatagacaggacgcctaagctacctatctatcgactgctatcctagttttcgacgtaaaggttcgggtaccacgttacggaggtttacgacgttaggacgtaggtaggtaagttcgtagggactaagtacgtttactactccgtactaccctaagttcgaaacgttaaacgttctacggtaaccgtaaaacggttacggtaaagttacgtttttacgaacgtttaaactttaacgttttaacctttaggtaacctaaaacgtaacgttaaactttaaaccttaaaggttttacggtttttacccgggaaccgttaaaacgggggtaccttaaaccggtaaaccgtttaaaccgttaaaacgtttaaaacggtaaacccgtagttaccgggactttacggacctaaacgtacgttaccgtttaccgttaccgttacttaacctttaccgttacccccggttactaccgttaccgtagtttaacccg

SEQ ID NO: 141465 - DNA, 582 bp, Homo sapiens
  misc_feature: GYAE6OF02IELTR.46.67.G01.1.454.CMB.1.raw
  modified_base (210)..(210): a, c, t, g, unknown or other
  misc_feature (210)..(210): n is a, c, g, or t
  modified_base (277)..(277): a, c, t, g, unknown or other
  misc_feature (277)..(277): n is a, c, g, or t
  modified_base (331)..(331): a, c, t, g, unknown or other
  misc_feature (331)..(331): n is a, c, g, or t
  modified_base (337)..(337): a, c, t, g, unknown or other
  misc_feature (337)..(337): n is a, c, g, or t
tcagactagcagtacacgaccggtgctcgatttagagtatacatattgggtttgtcctcctgctggtggcagctcccagatgggtcctgtccctggttcaactgcaggagtcgggcccacgactggtgaggcctttcggagaccctgtccctcacctgcgctgtctctggtgcctccatcagtagtggtttcttcgtgggctgggtccgnagctccgagggagggctggaatacattggaagtgtctctcatagtgaggttcctattacagtccgtntctcaagagtcgagtcaccatatctctggacacgtccagcaatcagttttcccngaaagntgactttctgtcgaccgccgctggactccggggtctttaattactgtgacgagagacggtctaattatgtagttttggagttggttatttcgactacctagatcggacggggtctcgacccgtggggaccagggaactacgtaggtaccaccggtcttaccttacgcccttccgaccgaacgggcccaacgtccggttcccttccccgtcggccctacccttccgaccgaacgtacgcctacccg

SEQ ID NO: 141466 - DNA, 602 bp, Homo sapiens
  misc_feature: GYAE6OF02IKL8U.46.67.G01.1.454.CMB.1.raw
  modified_base (339)..(339): a, c, t, g, unknown or other
  misc_feature (339)..(339): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccgcagctccgagggagggctggaatacattggaagtgtctctcatagtggaggttcctattacagtccgtctctcaagagtcgagtcaccatatctctggacacgtccagctaatctagttttcccagaagntgacgttctggtacgaccgtccgctaggaccgacgggtcttttaagttacgtgtcgacgagaggtacggcttaattatgttattttaggagttggttatttcgaccgtacctagacgtcggacggggtctcgacccgtgggccagggtaatacgtcgtccgacgtcttaccgttacgcctaccgaacccgtaacggtcccgtagtcccggttcccttccccgtcggtaccctaccccgttccctacccgtacgtacgtacccg

SEQ ID NO: 141467 - DNA, 634 bp, Homo sapiens
  misc_feature: GYAE6OF02HIRS0.46.67.G01.1.454.CMB.1.raw
  modified_base (246)..(246): a, c, t, g, unknown or other
  misc_feature (246)..(246): n is a, c, g, or t
  modified_base (385)..(385): a, c, t, g, unknown or other
  misc_feature (385)..(385): n is a, c, g, or t
  modified_base (408)..(408): a, c, t, g, unknown or other
  misc_feature (408)..(408): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctcatcagtgtggtttctctggggctgggtccgnagctcccgagggaaggggctggaatacagttggaagtgtctctcataggtggtagttctattacagtccgtctctcaagagtcgagtcaccatatctctacggacacgtccagactaatctacgttttcccaggtaagntagtacgttctgtcgaccgtccnctgaccgacgggttctttagtacgttgtgcgaggacggtacgtactaagttattggttacgtttttgggtaggttacggttttaacgtttaccgtaccgtaacctaaggtacgttccgggtaccggggtccgttacccggtaaccccggttgggacccgaagggtaaccgtttcggtaccggttccgtacccggttaccgtttaccgttacgccccttaaccccgg

SEQ ID NO: 141468 - DNA, 553 bp, Homo sapiens
  misc_feature: GYAE6OF02FGXWN.46.67.G01.1.454.CMB.1.raw
  modified_base (370)..(370): a, c, t, g, unknown or other
  misc_feature (370)..(370): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccgcagctcccagggagggctggaatacattggaagtgtctctcatagtggaggttcctattacagtccgtctctcaagagtcgagtcaccatatctctggacacgtccagcaatcagttttcccngaagatgattctgtgaccgccgctgacacgggtcgtttatactgtgcgagacgacgctattagttgtagtttttggagtttggtttatttacgacctacctagtacttccggtacggggctccggacccgtggggacccagggtaactacgtcggtctaccgtcctccgttacgccctacccg

SEQ ID NO: 141469 - DNA, 619 bp, Homo sapiens
  misc_feature: GYAE6OF02IYZIR.46.67.G01.1.454.CMB.1.raw
  modified_base (331)..(331): a, c, t, g, unknown or other
  misc_feature (331)..(331): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctccagggagggctggaatacattggaagtgctctcatagtggaggttcctattacagtccgtctctcaagagtcgagtcaccatatctctggacacgtccagcaactcagttttcccngaagatgagttctgtcgaccgcgctgaccgacgggtcttttattacgtgtagcgagacgacggctagtttatgtatttttggagtttggttattcgtacacccttagtacgtcgggtacggggcctccggacccggttggggacccgtaaggggtaacttaccgtgggttacctaccggttcctccgttacgtccctccgtaaccggtaacgggacccctacgttacccggttcctttcccccgtcgggtaccctacccccgttcctaccccgtaacggccgtacccg

SEQ ID NO: 141470 - DNA, 605 bp, Homo sapiens
  misc_feature: GYAE6OF02FQZC2.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgagggaaggggctggaatacattggaagtgtctctcatagtggaggttcctattacagtccgtctctcaagagtcgagtcaccatatctctggacacgtccagcaatcagttttcccctgaagatgagttctgtcgaccgccgctgacgacgggtcttttattactgtgcgagagacggctattatgtattttggagttggttatttcgacaccctagacgtcggaccgggggctaccggaccccgtgggggacccaggggtaactacgttcgggtcctaccggtccttccgttacgccctcccgaaccgtaacgggcccctacgttcccggttaccctttcccccgtacgggccctaccccgttccctacccgacgaccgtaccccg

SEQ ID NO: 141471 - DNA, 777 bp, Homo sapiens
  misc_feature: GYAE6OF02JDUE9.46.67.G01.1.454.CMB.1.raw
  modified_base (171)..(171): a, c, t, g, unknown or other
  misc_feature (171)..(171): n is a, c, g, or t
  modified_base (209)..(209): a, c, t, g, unknown or other
  misc_feature (209)..(209): n is a, c, g, or t
  modified_base (283)..(283): a, c, t, g, unknown or other
  misc_feature (283)..(283): n is a, c, g, or t
  modified_base (357)..(357): a, c, t, g, unknown or other
  misc_feature (357)..(357): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttcttcgtgggctgggtccgnagctccgagggaagggctggaatacgagttggaagtgtctctcataggtggtaggttcctattacagtcccgtntctcaagtagtcgagtcaccattactctcgtaggacctaacgtccagacaactctacggttttcccagaaagtnttgtaacgttctggtacgacccgcgtcgtaggaaccgtacggggttacttttacgttaccgtggttacggacgtaggtaacggtacggtaccttagtttacgttaggttaggttttttagggaacgggttttcggttttaacgtttaccggtaacccgttaaccgtttaacggtaacgttaccgggggtaaccggggtccgttacccgggtaccccgggtttacgggggaacccggtaaagggtaacgtttaaccggttcggtaacccggttacccggttaccttacccggtttaccggcccctttacccgaacccgggtaacccgggtacccgttaccgttacccggttacccccgtttccccggtacccggtccccgttaccccgttacccgtaacccgtaacgggcctaaccccggg

SEQ ID NO: 141472 - DNA, 572 bp, Homo sapiens
  misc_feature: GYAE6OF02H7DRE.46.67.G01.1.454.CMB.1.raw
  modified_base (248)..(248): a, c, t, g, unknown or other
  misc_feature (248)..(248): n is a, c, g, or t
  modified_base (331)..(331): a, c, t, g, unknown or other
  misc_feature (331)..(331): n is a, c, g, or t
  modified_base (377)..(377): a, c, t, g, unknown or other
  misc_feature (377)..(377): n is a, c, g, or t
  modified_base (381)..(381): a, c, t, g, unknown or other
  misc_feature (381)..(381): n is a, c, g, or t
  modified_base (445)..(445): a, c, t, g, unknown or other
  misc_feature (445)..(445): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcggcccagactggtgaggcctttcggagaccctgtccctcacctgcgctgtctctggtgcctccatcagtagtggtttctcgtggggctgggtccgnagctccgagggaaggggctgggaatacattggaagttgtctctcatagtggaggtttcctattacagttccgtctctacaagngtcgagtcacatatctctggacacgtccagcaatctagttttcccngaantgagtttctgtcgaccgccgctgacgtacgggtcgttttaattacgtgtcgacgagaggacgtntaagttatagttagtttttggagttggtttatttcgaacctaccgtagtacgtcggacgggtcctaccggcccgtggggaccaagggtactacgtggtcctaccgtcctcgttaccgcctaccccgg

SEQ ID NO: 141473 - DNA, 666 bp, Homo sapiens
  misc_feature: GYAE6OF02HB66W.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtgggctgggtccggcagctcccgagggagggctaggaatacagttggaagtgtctctcatagtggaggttcctattacagttccgtctctcaagagtcgagtcaccatatctctggacacgtccagcaatctacgttttccagaagatgagttctgtcgaccgccgcgtcgacgtcgggtcgttttattacgtgtgcggagacgacggtacttattagttgttagtttttgggaggtttaggtttactttacgaaccgtacccgttagtacgttccgggaccgggggtctacccggaccccggtggggacccgtaagggtaacttaccgttcgggtcccgtaacccggttccttacccggttacgtaccccgttacccgaacccggtaaccgggtcccctaaggttcccggtcccctttacccccggtcggcccctaccccgttcccgtaacccgacggacccgtaccccg

SEQ ID NO: 141474 - DNA, 568 bp, Homo sapiens
  misc_feature: GYAE6OF02JYTLX.46.67.G01.1.454.CMB.1.raw
  modified_base (361)..(361): a, c, t, g, unknown or other
  misc_feature (361)..(361): n is a, c, g, or t
  modified_base (538)..(538): a, c, t, g, unknown or other
  misc_feature (538)..(538): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccgcagctcccgagggaagggctggaatacagttggaagtgtctctcatagtggaggttcctattacagtccgtctctcaagagtcgagtcaccatatctctggacacgtcagctaatcacgttttcccagaagactgtagttctgtcgaccgcnctgacacgggtctttatacgtgtgcgagacgacggctattatgttagttttggagttggttattcgacctaccgtagactcgggacgggcctacgcccgtggggacctagggtaactacgtcggtccaccggtctaccgttacgccctacgaccgacggcccagtccgtcctcccgngtcccgtaccctcctaccgtacgactcccg

SEQ ID NO: 141475 - DNA, 656 bp, Homo sapiens
  misc_feature: GYAE6OF02GTGB7.46.67.G01.1.454.CMB.1.raw
  modified_base (218)..(218): a, c, t, g, unknown or other
  misc_feature (218)..(218): n is a, c, g, or t
  modified_base (230)..(230): a, c, t, g, unknown or other
  misc_feature (230)..(230): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttggccggnaaggtcggaacnttgactaccttatttaattgtatcaacatacgaccagggaccgcccctaagcctacctaatctaatgctgcatcctagtttgacgtaaaggtcggggtaccccagtcggaggttcaggtggcaggtggactcgtgggaactagtatttcactctaccacctatctagtaatctgactaacgtagtaagttagttttacgactaacgttattacgtagtactaaacgtaagttaaacttaactaagtttcggtttaccggaaccgtaaagggtaacctaaccggtaacctttaaaacgtaaaaccgtttaaaacgtaacgttaggttacggtacttaccgacctaacccgtaactttccgttaaccgtttcctttaccgtaccgtttaccccgttaccccggtacctaacgtttacctaggttaacc

SEQ ID NO: 141476 - DNA, 558 bp, Homo sapiens
  misc_feature: GYAE6OF02J1BPV.46.67.G01.1.454.CMB.1.raw
  modified_base (199)..(199): a, c, t, g, unknown or other
  misc_feature (199)..(199): n is a, c, g, or t
  modified_base (208)..(208): a, c, t, g, unknown or other
  misc_feature (208)..(208): n is a, c, g, or t
  modified_base (223)..(223): a, c, t, g, unknown or other
  misc_feature (223)..(223): n is a, c, g, or t
  modified_base (257)..(257): a, c, t, g, unknown or other
  misc_feature (257)..(257): n is a, c, g, or t
  modified_base (260)..(260): a, c, t, g, unknown or other
  misc_feature (260)..(260): n is a, c, g, or t
  modified_base (269)..(269): a, c, t, g, unknown or other
  misc_feature (269)..(269): n is a, c, g, or t
  modified_base (347)..(347): a, c, t, g, unknown or other
  misc_feature (347)..(347): n is a, c, g, or t
  modified_base (398)..(398): a, c, t, g, unknown or other
  misc_feature (398)..(398): n is a, c, g, or t
  modified_base (432)..(432): a, c, t, g, unknown or other
  misc_feature (432)..(432): n is a, c, g, or t
  modified_base (500)..(500): a, c, t, g, unknown or other
  misc_feature (500)..(500): n is a, c, g, or t
  modified_base (553)..(553): a, c, t, g, unknown or other
  misc_feature (553)..(553): n is a, c, g, or t
tcagactagcagtacacgaccggtgctcgatttagagtatacatattgggtttggggtaggtcgtcggttcgtaggacgacagcatggacatgagggtcccgctcagctcctggggctcctgctactctgctcgaggtgccagatgtgacgatcgagctgacccagtctccatcctccctagtcctgacaccgtggganacagtgtcnccatcacttgccggnagtcgacattgcacctattaattgtatcaacatnacnggacgccanctactatctatcgctgcatccagtttgactaacgtgggccacgttcgaggttcaggttcggctaggtgatctcggganaggtactttcaacgttcttcgaccattaccgagtaactcttagcaaacgtnacgttattttagactaccttaatcctagtcaaancgtaaatcaagtttgttaccgtcaaacggtacgaactaccgttaataaacttaaaccgatacgggttnacttcgaccaactattcgtacgttactcctaagtccctccgtaccaatttccngtaac

SEQ ID NO: 141477 - DNA, 618 bp, Homo sapiens
  misc_feature: GYAE6OF02IR08M.46.67.G01.1.454.CMB.1.raw
  modified_base (291)..(291): a, c, t, g, unknown or other
  misc_feature (291)..(291): n is a, c, g, or t
  modified_base (339)..(339): a, c, t, g, unknown or other
  misc_feature (339)..(339): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgagggaaggggctggaatacagttggaagtgtctctcatagtggaggttcctattacagtccgtctctcaagngtcgagtcaccatatctctagacacgtccagcaatctacgttttcccngaagatgagttctgtcgaccgccgctcgacgacgggtcttttatactgtgcgagacggacggtctattatgttagttttggagttggtttatttcgaactacctagactcgggacggggtctccggacccgtggggaccgaaggggaacttacgtcgggtaccacccgttcctaccgttacgcccttaccgaacccggtaacgggtcccctaaggttcccggttacccctttcccccggtaggccccttaccccgtcccgtaaccctacggcctacccg

SEQ ID NO: 141478 - DNA, 607 bp, Homo sapiens
  misc_feature: GYAE6OF02HV8RJ.46.67.G01.1.454.CMB.1.raw
  modified_base (286)..(286): a, c, t, g, unknown or other
  misc_feature (286)..(286): n is a, c, g, or t
  modified_base (331)..(331): a, c, t, g, unknown or other
  misc_feature (331)..(331): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtccctcacctgcgctgtctctggtgcctccatcagtagtggtttcttctgggctgggtccgcagctcccagggagggctggaatacattggaagtgtctctcatagtggtaggttcctattacagtccgtctctcaagngtcgagtcaccatatctctggacacgtccagcaatctagtttccngagatgtagttctgtgaccgcgctgacacggtctttatacgtgtgcgagagacgctatatgtagttttggagttggtttattcgtacacccgtagacgttcggacgggtcctaccggtaccccgtggggacccaaggggtaactaccgtcggttaccgacccgttccgtccgttacgtaccctaccgaacccggaacgggtcccctacgttcccggttaccctttcccccgtcggtacccctaccccgttaccctacccgtaacgtacgtaccccg

SEQ ID NO: 141479 - DNA, 581 bp, Homo sapiens
  misc_feature: GYAE6OF02GWHDO.46.67.G01.1.454.CMB.1.raw
  modified_base (333)..(333): a, c, t, g, unknown or other
  misc_feature (333)..(333): n is a, c, g, or t
  modified_base (544)..(544): a, c, t, g, unknown or other
  misc_feature (544)..(544): n is a, c, g, or t
  modified_base (573)..(573): a, c, t, g, unknown or other
  misc_feature (573)..(573): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcagagtcgagtcaccatatctctggacacgtccagcaatcagttttcccngaagatgagttctgtgaccgccgctgacacgggtcgtttatactgtgcgagagacggctattatgtagttttggagttgttattcgactacccgtagtactcggacggggtctccgacccgtggggcctagggactacgtggtccgaccgtctccgttagcccttaccgacccgaacgggtcccctaagttcccggtcccgtttcccccgnggtccccaccccgtttcccacctaacggngtaccccg

SEQ ID NO: 141480 - DNA, 635 bp, Homo sapiens
  misc_feature: GYAE6OF02HN7R9.46.67.G01.1.454.CMB.1.raw
  modified_base (253)..(253): a, c, t, g, unknown or other
  misc_feature (253)..(253): n is a, c, g, or t
  modified_base (338)..(338): a, c, t, g, unknown or other
  misc_feature (338)..(338): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactgggtgaggccttcggagaccctgtccctcacctgcgctgtctctggtcgcctccatcagtagttggtttctcgtggggctgggtccggnagcctccgagggaacgggctaggaatacagttggaggtgtctctcataggtggtaggttcctattacgagtccgtctctcgaagngtcgtagtccactatactctcgtcggacacgtccagactaactctacgttttccagtagatagtattctgtcgaccgcgcttaggaccgtacgggttcgttttatacgtggtacggacgaaggacgtacggtacttagttaagttcggtttagtttttcgggtagttaggtttactttcggaacccttaccggtagtacgtacggggaccgggttcgtcccgggtacccggtacgggtacgaacgggtaacctcggtacgtcccgtaccgttccgtccttaccggaccctaacccgg

SEQ ID NO: 141481 - DNA, 604 bp, Homo sapiens
  misc_feature: GYAE6OF02HQE70.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacacctatttaaattggtatcaacatagaccaggacggcccctaagctcctaatctatgctgcatccagtttgacaaagtcggggtccatcgaggttcagtggctagtggatcgtgggacagtatttcactctacaccatcagtaactctagacctaacgtagaagtatttcgacttaaactttattaactcgtacaaacgtaagtaaattaactaagtttggtttaccggaaccgtaaacggggtaacctaacggtaacttaaacgtaaaacgttaaaaccgaacgttaggtcggtaccgtagacccgtaacgtacgttactcgttacctttacacgttacccgttacccgtacctaacttccgtagtaacc

SEQ ID NO: 141482 - DNA, 553 bp, Homo sapiens
  misc_feature: GYAE6OF02HDVPG.46.67.G01.1.454.CMB.1.raw
  modified_base (389)..(389): a, c, t, g, unknown or other
  misc_feature (389)..(389): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttggccgggcaagtcggaacattgacacctattaaatgtatcaacatagaccaggacgcccctaagctctaatctatgctgcatccagtttgactaaaggtcgggtcccatcgaggttcagtggcagtggatcgtagggacagtattcactctcactatcagtatctgacaagtgaagtntttagactaacttattacttgtacaaactataacttaacaagtttagtttccggaacgtaagggacctaacgtaacttaaactaaaagttaaaccgaacttagtacgtactagacctaacctatctagttccttacacttcccttccgacctattcgtagtaac

SEQ ID NO: 141483 - DNA, 620 bp, Homo sapiens
  misc_feature: GYAE6OF02H8WH2.46.67.G01.1.454.CMB.1.raw
  modified_base (195)..(195): a, c, t, g, unknown or other
  misc_feature (195)..(195): n is a, c, g, or t
  modified_base (230)..(230): a, c, t, g, unknown or other
  misc_feature (230)..(230): n is a, c, g, or t
tcagactagcagtacacgaccggtgctcgatttagagtatacatattggggtttggggagtctcggtcaggacacagcatggacatgagggtccccgctcagctccgtggggctcctgctactctggctccgaggtgccagatgtgacatcgagctgacccagtctccatcctccctgtctgcaaccggtggganacagtgtcaccatcacttggccgggcagtcggaanatgacacttatttaaattgtatcaacatagaccgagggaccgacccctaagcctactaatctatgctgcatcctagtttacgacgtaaacggtcggggtaccccagttcggtaggttcaggtggcgtaggtggagtcgtgggacagtacttcactctcaccatacgaataatctgacgtaacggtagtaagttatttgaacttaactttattacgttgtactaaacaattaattaactaagtttcggttttaccggaaccgtaacgggtaaccacgtaaaccttaaacgtaaaacgttaaaaccgtaagttggtacgtctacgaaccgtaaccttagttccttacgttaccttcacgtttccctacccgtaccttaattccttagttaac

SEQ ID NO: 141484 - DNA, 644 bp, Homo sapiens
  misc_feature: GYAE6OF02F8VR0.46.67.G01.1.454.CMB.1.raw
  modified_base (288)..(288): a, c, t, g, unknown or other
  misc_feature (288)..(288): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccgcagctcccgagggaagggctggaatacattggaagtgtctctcatagtggaggttcctattacagtccgtctctcaagngtcgagtcaccatatctctggacacgtccagcaatctacgttttcccagaagatgtacgttctgtcgacccgccgctaggaccgtacgggtcttttagtacgtgtgcgagaggacggtctaattgtgtagttttggagttggttatttcggaactacccgtagtacgtcgggacggggtccgtccggtaccccggtggggacccgaaggggtaacgtacgttcggtaccgtacccgtcgttcccgttaccgtcccgtacccgaacccggtaaccgggtcccctacggttcccggttcccgtttcccccgtcggtccccgtacccccgttcccgtacccgtaaccggacgtaccccg

SEQ ID NO: 141485 - DNA, 676 bp, Homo sapiens
  misc_feature: GYAE6OF02HKFS9.46.67.G01.1.454.CMB.1.raw
  modified_base (223)..(223): a, c, t, g, unknown or other
  misc_feature (223)..(223): n is a, c, g, or t
tcagactagcagtacacgaccggtgctcgatttagagtatacatattgggtttggggagtctcggtcaggacacagcatggacatgagggtccccgctcagctccgtggggctcctgctactctggctcgaggtgccagatgtgacatcgagctgacccagtctccatcctccctgtctgaccaaccggtgggagacagtcgtcaccatcacttggccggganaaggtcggaaactattcgacctacttattttaaattggtaatcaacataagaccgagggaccggccctaagcctacctaatctatgactgactatcctagtttcgactaaaggttcgggtacccagttccggaggtttcgaggtggacaggtggatcgtagggacagtatttcactctacactatcagttaatcgtgacaagtagaagtattttcggacttaacgtttattacgttacgtactaaacgtagtaacttaacgtaagtttacggttttaccggaaccgtaaagggtaccctaaacgtaaacttaaacctaaaacgttaaaacgtaaacgttggttaacggaccttaacggaccctaaccttaaaccggttccttaccggttttaacccttaccgttaacctttacccgttaaccccggttacctacgtttccgtaacgttaaccg

SEQ ID NO: 141486 - DNA, 792 bp, Homo sapiens
  misc_feature: GYAE6OF02HXREK.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccgcagctcccagggagggctggaatacattggaagtgtctctcatagtggtaggttcctattacagtccgtctctcaagagtcgagtcacatatctctggacacgtccagctaatctacgttttccctagaacgtattacggagtttctaggtacgacccggccgtcgttaggaccgtacgggggttaccgtttttaagttacgttcggtcggtacggtaacggtaacggtacggtaccgttaagtttaacgttaggtttaacgttttttagggtaggtttacgggttttaacgttttaccggaaacccgttaaccccgttaaggtaaccgttaccggggaccggggggtcccgttacccgggtaaccccggttacggggggacccgtaaacggggtaacgttaccggttacggtacccgtacccggttaccgtttacccgttaccggtacccttacccgtaacccggaaaccgggtacccccgttaaccggttccccgggtttacccctttaccccccggttacgggtacccccgttaaccccccgttaccccgttaacccgtaaccggtaccggttaacccccgg

SEQ ID NO: 141487 - DNA, 617 bp, Homo sapiens
  misc_feature: GYAE6OF02GQVJP.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagaccctgtccctcacctgcgctgtctctggtgcctccatcagtagtggtttcttctggggctgggtccggcagctcccgagggagggctggaatacattggaagtgtctctcatagtggaggttcctattacagtccgtctctcaagatcgagtcaccatatctctggacacgtccagcaatctacgttttcccagaagatgagttctggtcgaccgccgcgtgacgtacgggtcttttaataccgtgtcggcgagagacggtctattagtgtagtttttggagttggttacttcgactaccgtagacgttcgggacggggtctccggacccgtcggggaccgtaggggtaacttacgtggtcctacccggttctacccgttacgccctaccgaaccggaacgggccccttaggtcccggttcccttccccccggtgtaccccgtaccccttcccgtacccaacggaccgtaccccg

SEQ ID NO: 141488 - DNA, 637 bp, Homo sapiens
  misc_feature: GYAE6OF02HOMYM.46.67.G01.1.454.CMB.1.raw
  modified_base (334)..(334): a, c, t, g, unknown or other
  misc_feature (334)..(334): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgagggaaggggctggaatacattggaagtgtctctcatagtggaggttcctattacagtccgtctctcaagagtcgagtcaccatatctctggacacgtcagcaatcagttttcccngaagatgagttctggtcgacccgccgtcgtcgacgacggggtcgttttaattaccgtggttcgacggtagaggacgggtcttaagtttattaggtagttttttagggacggtttggtttatttcgactacccctaagtacgtcggaccgggggcttaccggaccccggttggggcccaaggggtaactaccgttcgggttccaccggttccttcccgttacgccctcccgaaccgaacgggtccctacgtccggttcccttcccccgtcggccctaccccttccctacccgtagacgtacccg

SEQ ID NO: 141489 - DNA, 644 bp, Homo sapiens
  misc_feature: GYAE6OF02IO76G.46.67.G01.1.454.CMB.1.raw
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacatgacactattaaatggtatcaacatagaccaggacggcccctaagctactaatctatgctgcatccagttgacaaagtgggtcccatcgagttcagtggtcagtggatcgtagggactagtatttcacttctcacctatacaagtaatcgtaacgactaaacggtgtaaacgttattttacgacctaaacttttaattacttacggttacaaaaccgtaagtaaaactttaacgaaacttttacggtttaccggaaccgtaaaacgggtaccgaaacggtaaaccttaaaacgtaaaaacgtttaaacggtaaaaccgttagtacggtacgttacggaccgtaaacctaacttaccgttagttacccgtttaccgtaactttccctttacccggaccctacttccgttaagtaac

SEQ ID NO: 141490 - DNA, 611 bp, Homo sapiens
  misc_feature: GYAE6OF02GIL71.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggagacagtgtcaccatcacttgccgggcaagtcggaacattgacaccttatttaaattggtatcaacatagacagggacgcccctaagctacctaatctatgctgcatcctagtttgactaaaggtggggtcccagtcgaggttacagtggcagtggatcgtgggacagtacttacactctctaccatcaagtaatctacgacaacgtgaagtattttgactaaactttatactagtacaactagtaaattacaagtttcgtttacggaccgtaaagggtacctaacggtaaccttaaacgtaaaactttaaaaccgaacgttagtacggtacttacggacctaaccgtattaccggtacgttaccgtttacgtaacgttttccccgttaccccggtaccttacgttacccgttaggtaaccc

SEQ ID NO: 141491 - DNA, 614 bp, Homo sapiens
  misc_feature: GYAE6OF02GYIKI.46.67.G01.1.454.CMB.1.raw
  modified_base (192)..(192): a, c, t, g, unknown or other
  misc_feature (192)..(192): n is a, c, g, or t
  modified_base (218)..(218): a, c, t, g, unknown or other
  misc_feature (218)..(218): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatccacttgccgggnaagtcggaacattgacacctatttaaatggtatcaacatagaccagggacggcccctaagctcctaatctatgctgcatccagtttgactaaaggtgggtcccagtcggaggttccagtggcaggtggatcgtgggacagtatttcacttctcacctatacaagtaatcgtagactaacgtgaagtattttagactaaactttattaactgtacaactaagtaaatttactaagtttcgttttaccggaccgtaaaggggtaacctaacggtaaccttaaacgtaaaacgttaaaccgtaaacgttagtacggtactacgaccgtaacctaattaccgttagttacctttactaccgtttcccgttaccccgtaccgtacttaccgtagttaaccg

SEQ ID NO: 141492 - DNA, 651 bp, Homo sapiens
  misc_feature: GYAE6OF02JSBWT.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttgggggagtctcggtcaggacacagcatggacatgagggtccccgctcagctcctggggctcctgctactctggctccggaggtgccagatgtgacatcgagctgacccagtctccatcctcctgtctgcaaccgtgganacagtgtcaccatcacttggccgggacaagtacggaactattcgactaaccttaatttaagttgtatacaactagtagaaccgagggaccgaccctaagcctacgtaatctatcgactcgactacgtacctagtttcgacgtaaacggtcgggtaccctagttcggtaggttaccaggtcggacgtaggtaggtactcgtagggacgtagtacttccgacttccgtaccacgtatacgaacgtattcgtagacgtaagtcgtaagttatttcgaaccttaacttagtacttagtaacaagtaaacgtaattactagtttacgttacgaaccgtaaggtacctaacgtaactaaacgttaaagttaaacgaacgtggtacgtccgtaaggtactaacggttaatcggttaacttacctacgtaacctttccgtaaccgtaccctggttaccctagttacg

SEQ ID NO: 141493 - DNA, 511 bp, Homo sapiens
  misc_feature: GYAE6OF02GZEM5.46.67.G01.1.454.CMB.1.raw
  modified_base (392)..(392): a, c, t, g, unknown or other
  misc_feature (392)..(392): n is a, c, g, or t
  modified_base (421)..(421): a, c, t, g, unknown or other
  misc_feature (421)..(421): n is a, c, g, or t
  modified_base (501)..(501): a, c, t, g, unknown or other
  misc_feature (501)..(501): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacgcccctaagctcctaatctatgctgcatcagtttgcaaagtggggtcccatcgaggttcagtggcagtggatctgggacagtatttcgacttctacacctatcagtaatctgacaacgtgaagtnttttagactaacttattactgtacaacanaatacaatgtttcgacaaggacacgactaacaaattaaacgaactgtagctagacaaccatctagtcttcactcttcccnctatctatac

SEQ ID NO: 141494 - DNA, 546 bp, Homo sapiens
  misc_feature: GYAE6OF02F2UXL.46.67.G01.1.454.CMB.1.raw
  modified_base (228)..(228): a, c, t, g, unknown or other
  misc_feature (228)..(228): n is a, c, g, or t
  modified_base (387)..(387): a, c, t, g, unknown or other
  misc_feature (387)..(387): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacnttgacacctatttaaattggtatcaacatagaccagggacgcccctaagctcctaatctatgctgcatccagtttgcaaagtgggtcccatcgaggttcagtgcagtggatcgtgggacagtatttcactctcaccatcagtatctgcaacgtgaagtntttgactaacttattactagtacaacagtaattactaattgttttacggaccaagggtaccaacgtaacttaaactaaacttaaacgtaaacgttagtacggactacgacctaacctacttctagttcttacacttccttcccgactactctagtaacg

SEQ ID NO: 141495 - DNA, 574 bp, Homo sapiens
  misc_feature: GYAE6OF02GTWAF.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctctaatctatgctgcatccagtttgcaaaggtcggggtacccagtcgaggttcagtggcaggtggatcgtgggacaggatttcactctcacatcagtaatctgctaacgtgaagtatttagactaacttattaactgtacaacaagtaattacaattcgtttacggacctaacgggactaacgactaaactaaacttaaaccgtaactagtagtacgtacgtaccgaacctaagttccttacgttacctttacgtaccgttcccttacccggaccctaacgttcctagttaaccg

SEQ ID NO: 141496 - DNA, 645 bp, Homo sapiens
  misc_feature: GYAE6OF02GS8UW.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttggccgggcaagtcggaacattgacaccttatttaaattggtatcaacatagaccagggaccgcccctaagcctcctaatctatgctgcactcctagtttgacgtaaaggtcggggtccctagtcggtaggttcgaggtggctaggtggtatcgtagggactaggtactttcacttcctacacctatacgtaagttactcgtcgactaacggtagtaaagttattttacgtaccttaacttttaattacgttacgtacctaaacgtaagttaaactttaactaagtttcggttttaccgggaaccgttaacgggtaaccgtaaccgtaacttaaactaaaacgttaaaccgaacgttggacgtacgtacgaccgtaacctattacgttacttccttacgtaccttcccgtacttaccttcgttacgtacttaccg

SEQ ID NO: 141497 - DNA, 567 bp, Homo sapiens
  misc_feature: GYAE6OF02JDJJM.46.67.G01.1.454.CMB.1.raw
  modified_base (385)..(385): a, c, t, g, unknown or other
  misc_feature (385)..(385): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatcgtgggacagatttcactctcaccatcagtaatctgcaacgtnaagtattttgactaacttattacctagtacaaactagtaattaacaagtttcgttttaccggacctaaacgggacctaacgtaacttaaactaaaacttaaacgaaacgttagtacggtactacgccgtaaccattactacgttacttctacttcccttcccgtacctacttctacgttaac

SEQ ID NO: 141498 - DNA, 607 bp, Homo sapiens
  misc_feature: GYAE6OF02G17HN.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctggggtccgcagcctcccgagggaaggggctggaatacattggaagtgtctctcatagtggtaggttcctattacgagtccgtctctcaagtacgtcgagtcaccgtatatctctgacacggtccagcaatctacgttttcccagtaacgtctgtagttctgtacgaccgtaccgctcgacgacgggtctttacgttacgtgtcgcgagaggacgtactattagttgttagttttcggagttggtttattacgtaccgtacctaaggacgtacgggacggggtccgtccggaccccggtgggtaccgtaacgggtaactacggtcgtaccgtacccggttacttaccgttacgtcccgtaaccccgg

SEQ ID NO: 141499 - DNA, 592 bp, Homo sapiens
  misc_feature: GYAE6OF02IRX2C.46.67.G01.1.454.CMB.1.raw
  modified_base (357)..(357): a, c, t, g, unknown or other
  misc_feature (357)..(357): n is a, c, g, or t
  modified_base (508)..(508): a, c, t, g, unknown or other
  misc_feature (508)..(508): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagttagtggtttctcgtggggctgggtccggcagcctcccgagggaaggggctggaatacattggaatgtctctcatagtggaggttcctattacgagtccgtctctcaagagtcgagtcaccctatatctctggacncgtccagctaactctacgttttcccagtaagatagtacgttctgttcgaacccgccgtctcgacgcgggtacgttttactacgttggtcgacggagacgtacggcttattatgttagttttggagttggtttattcgtactacccgtaagntacggacgggccttccggacccggttcgggccgtaacgggacttacgtcggtacctaccgtcttaccgttacgccctaacccgg

SEQ ID NO: 141500 - DNA, 575 bp, Homo sapiens
  misc_feature: GYAE6OF02F9YBQ.46.67.G01.1.454.CMB.1.raw
  modified_base (377)..(377): a, c, t, g, unknown or other
  misc_feature (377)..(377): n is a, c, g, or t
  modified_base (552)..(552): a, c, t, g, unknown or other
  misc_feature (552)..(552): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagacccctgtccctcacctgcgctgtctctggtgcctccatcagtagtggttttctcgtggggctggggtccgcagcctccgagggaaggggctggaatacattggaagtgtctctcatagtggaggttcctattacagtccgtctctcaagagtcgagtcaccatatctctggactacgtcagcaatcagttttcccngaagtactgtagtttctgttcgaccgccgctgacgacgggtcgttttattactggtcgcggagagacggtctagttatgtagtttttagggagttggtttactttcgaactacccttagactccgggacggggcctccggaccccggtcgggccgtagggaactacgtcggtacncccgttctccttacgctaccccg

SEQ ID NO: 141501 - DNA, 801 bp, Homo sapiens
  misc_feature: GYAE6OF02JP7ZA.46.67.G01.1.454.CMB.1.raw
  modified_base (195)..(195): a, c, t, g, unknown or other
  misc_feature (195)..(195): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctcgcaaccggtggganacagtgtccaccatcacttcggcccgggacaaggtcggaactagttacgaacctaaccttaagttttaaaagttcggtaataccaaactagtaacgaccgtaagggaccggtacccctaagccttactaatcgtatcggctcgtacacttaccgtagttttacgacgtaaacgggttcggggtacccctaagttcggtacggtttccgaagggttcggcgtaagggttggaacgttcggtacggggtaactaggttacttttaccgacctttacctaccgtaccgtaaacgttcgtaaacggttaaactttccggacgttaaccgtaaacgggttagtaaacggtttacgtttttacggaaacctttaaacgttttaactttaccggttacgtaaacgttaaacctaaggtttaaactttaaccgtaaacgttttcgggtttacccggaaccggtaaacgggtaacctaaacggtaaaacttaaacgtaaaacgtttaaaccggaaacgttacggtacgacgttacggaacctacgtaacgttcttaacgttacgtttaccctaacggtttccccttaacccgtactaaccttacgtgtttaaccg

SEQ ID NO: 141502 - DNA, 624 bp, Homo sapiens
  misc_feature: GYAE6OF02HIJAW.46.67.G01.1.454.CMB.1.raw
  modified_base (192)..(192): a, c, t, g, unknown or other
  misc_feature (192)..(192): n is a, c, g, or t
  modified_base (219)..(219): a, c, t, g, unknown or other
  misc_feature (219)..(219): n is a, c, g, or t
  modified_base (260)..(260): a, c, t, g, unknown or other
  misc_feature (260)..(260): n is a, c, g, or t
  modified_base (618)..(618): a, c, t, g, unknown or other
  misc_feature (618)..(618): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttggccggganaagtcggaactagttgactacttatttaaagttgtatcaanatagacgaggacgacccctaagctcctaatctatgctgcatccgtagtttcgactaaaggtcgggtaccctagtcggaggttcaggtggcgtaggtggtatcgtgggaacaggttatttcgactccgtaccacctatacgtaagtaactcgtagacctaaggtagtaagttatttacgacttaacgttattacttagtacgtaaactagtaaacttactaagtttcgtttacggaacgtaacgggtactaacgtaacttaaactaaacgttaaaccgaagttcgtacgacgttacgtacctaacgtacttacgtacgttcctttacgtaccttcccgttacccgtcttacgtacgttntaaccg

SEQ ID NO: 141503 - DNA, 565 bp, Homo sapiens
  misc_feature: GYAE6OF02GQG9H.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagcctcccgaggggaagggctggaatacattggaagtgtctctcatagtggaggttcctattacagtccgtctctcaagagtcgagtcaccatatctctggacacgtccagcaatcagttttcccagaagatgagttctgtgaccgccgctgacacgggtcgtttattactgtgcgagacgacggtctattatgtattttggagttggttatttcgactaccctagattcggacgggtctcgacccgtggggccgagggaactacgtgtcaccgtctccgttagcctccgaccgaacggccctagtccgtcccttccccgtcggccctacccctccctaccaacgacgtacccg

SEQ ID NO: 141504 - DNA, 590 bp, Homo sapiens
  misc_feature: GYAE6OF02F3E0Y.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagacagggacgcccctaagctcctaatctatgctgcatccagtttgacaaagtggggtcccatcgaggttcagtggcagtggatctgggacagattcactctcacatcagtaatctagcaacgtgaagtattttagactaacttattactgtactaacaagtaattaactaagtttgttttaccggaccgtaaagggtacctaacgtaacctaaactaaaacgttaaaacgtaaacgttaggtacggtactacggtaccgtaacctaattaccgttacgttacctttacgtaacgttcccgtttaccccggtacctacgttacgtacgttaacg

SEQ ID NO: 141505 - DNA, 623 bp, Homo sapiens
  misc_feature: GYAE6OF02IRBAP.46.67.G01.1.454.CMB.1.raw
  modified_base (329)..(329): a, c, t, g, unknown or other
  misc_feature (329)..(329): n is a, c, g, or t
  modified_base (333)..(333): a, c, t, g, unknown or other
  misc_feature (333)..(333): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctcatcagtagtggtttctctggggctgggtccggcagctccgagggagggctggatacagttggaagtgtctctcatagtggagttcctattacagtccgtctctcaagagtcgagtcaccatatctctggacacgtccagcaatctacgtttccngaantgagttctgtgaccgccgctgacacggggtctttattactgtgcgtaggacgtacggtcttaagttacgtgttagtttttacgggagtttgggtttacttttccgaaccgtacctaggtaatcgggaccgggggccttacggacccccgttggggcccgaagggtaacgtacgttgggtcctacccgttcttacccgttagtccctaccgtaacccggaacgggtaccccacgttcccggtcccgtttcccccgtcggacccacccccgttcctacccgacgcgtacccg

SEQ ID NO: 141506 - DNA, 564 bp, Homo sapiens
  misc_feature: GYAE6OF02JBQCP.46.67.G01.1.454.CMB.1.raw
  modified_base (228)..(228): a, c, t, g, unknown or other
  misc_feature (228)..(228): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacnttgacacctatttaatgtatcaacatagacaggacgcccctaagctcctaatctatgctgcatccagtttgacgaaagtcgggtcccatcgaggttcagtgcagtgatcgtggacagtattcactctcacatcagtaatctgacaacgtgtaagtatttgactaacgttattactgtacaaactagtaaattaactaattacggtttacgaccgtaaggtacaacgtaactaaactaaacgttaaacgtaacttagtacgtactcggtaaccaccgtaattcgtagttacctttacgtacttcccgttaccccgtactacttaccgtacgttaacg

SEQ ID NO: 141507 - DNA, 598 bp, Homo sapiens
  misc_feature: GYAE6OF02GNUHU.46.67.G01.1.454.CMB.1.raw
  modified_base (210)..(210): a, c, t, g, unknown or other
  misc_feature (210)..(210): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggnagctcccagggaagggctggaatacattggaagtgtctctcatagtggaggttcctattacagtccgtctctcaagagtcgagtcaccatatctctggacacgtccagcaatctagttttcccagaagatgagttctgtcgaccgcgctgacgacggtctttattactgtgcgagagacggctattatgtagttttggtagttggtttattcgactaccgtagtacgtcggacggggtcctaccggacccgtacggggaccaggggtaactacgttcggtcctacccgttccgttaccttacgccctaccgacccggaacgggccctacgtcccggttcccgttcccccgtggtcccctaccccgttccctaccgacgacgtaccccg

SEQ ID NO: 141508 - DNA, 616 bp, Homo sapiens
  misc_feature: GYAE6OF02H693K.46.67.G01.1.454.CMB.1.raw
  modified_base (291)..(291): a, c, t, g, unknown or other
  misc_feature (291)..(291): n is a, c, g, or t
tcagactagcagtacacgaccggtgctcgatttagagtatacatattgggtttgtcctcctgctggtgacagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgagggaaggggctggaatacagttggaagtgtctctcagtagtggaggttcctattacagtccgtctctcaagngtcgagtcacctatatctctggacacgtccagcaatctacgttttcccagaagtatgagtttctgtgacccgcgctagaccgtacggtctttattacgtgtcgcgagaggacggtcttattagtgttattttggagttggtttattccgactaccgttagacgtcgggacggggtctccggaccccgtggggccaagggtaactaccgttcggtcctaaccggttccttaccgttacgcccttacccgaacccgacgggcccctagtccccggttcccttacccccgtcggacccctaccccttcccgaccgtacgcgtaccccg

SEQ ID NO: 141509 - DNA, 604 bp, Homo sapiens
  misc_feature: GYAE6OF02HEYRA.46.67.G01.1.454.CMB.1.raw
  modified_base (207)..(207): a, c, t, g, unknown or other
  misc_feature (207)..(207): n is a, c, g, or t
  modified_base (284)..(284): a, c, t, g, unknown or other
  misc_feature (284)..(284): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctgggctgggtccgnagctccgagggagggctggaatacagttggaagtgtctctcatagtggaggttcctattacagtccgtctctcaagngtcgagtcacatatctctggacacgtccagcaatctacgttttcccagaacgtatgtagttctgtcgaccgtccgctgacgtacgggtcttttatactgtgacgagagacggtctattagtgttagttttggagttggttattcgactaccgtagacgtcgggacggggtctaccggacccggtggggacccgtaagggaacttacgtacggtcctaccggttccttccgttacgccctaccgaaccgtaacgggcccctaacgttccggttccccttccccgtcggaccctaccccgtccctacccgaacgcgtacccg

SEQ ID NO: 141510 - DNA, 553 bp, Homo sapiens
  misc_feature: GYAE6OF02F48K1.46.67.G01.1.454.CMB.1.raw
  modified_base (349)..(349): a, c, t, g, unknown or other
  misc_feature (349)..(349): n is a, c, g, or t
  modified_base (377)..(377): a, c, t, g, unknown or other
  misc_feature (377)..(377): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccggcagcctcccgagggaaggggctggaatacattggaagtgtctctcatagtggaggttcctattacagtccgtctctcaagagttcgagtcaccatatctntggacacgtccagcaatcagttttcccngaagatgagttctgtgaccgccgctgacacgggtcgttttatacgtgttgcgagagacggctattatgtagtttttggagttggttattttcgactaccctagagtcggacggggtctccggaccccgtggggccaagggaactacgtcggtcaccgttctccttacgcctacccg

SEQ ID NO: 141511 - DNA, 520 bp, Homo sapiens
  misc_feature: GYAE6OF02HPQ50.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactattaaatgtatcaacatagaccaggacggcccctaagctcctaatctatgctgcatccagtttgacaaagtggggtcccagtcgaggttcagtggcagtggatcgtgggacagtatttcactctcacatcaagtatctgacaacgtgaagtatttgactaacttattactgtacaactagaattataattgtttcgaccaaggacacgaactaactaaattaaacgaactgtagctagaccactatctagtcttacacttccttcccgacctattcctgtaacg

SEQ ID NO: 141512 - DNA, 548 bp, Homo sapiens
  misc_feature: GYAE6OF02GDFLK.46.67.G01.1.454.CMB.1.raw
  modified_base (192)..(192): a, c, t, g, unknown or other
  misc_feature (192)..(192): n is a, c, g, or t
  modified_base (211)..(211): a, c, t, g, unknown or other
  misc_feature (211)..(211): n is a, c, g, or t
  modified_base (325)..(325): a, c, t, g, unknown or other
  misc_feature (325)..(325): n is a, c, g, or t
  modified_base (373)..(373): a, c, t, g, unknown or other
  misc_feature (373)..(373): n is a, c, g, or t
  modified_base (378)..(378): a, c, t, g, unknown or other
  misc_feature (378)..(378): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctnacctgcgctgtctctggtncctcatcagtagtgtttctcgtggggctgggtccgcagcctccgagggagggctggaatacattggaagtgtctctcatagtggaggttcctagttacagtccgtctctcaagngtcgagtcaccatactctctggacacgtcagcaaatctagttttcccngaagntgtagttctgtcgaccgccgcgtgacgtacgggtctttattacgtgtgcgagagacgtctagttattgtagttttggagtttgttatttcgactacctagactcggtacgggctccggtaccgtgggaccagggtaactcgtcggtctaccgttctcttacgcctacccg

SEQ ID NO: 141513 - DNA, 605 bp, Homo sapiens
  misc_feature: GYAE6OF02FF2V7.46.67.G01.1.454.CMB.1.raw
  modified_base (352)..(352): a, c, t, g, unknown or other
  misc_feature (352)..(352): n is a, c, g, or t
  modified_base (366)..(366): a, c, t, g, unknown or other
  misc_feature (366)..(366): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccactcctccctgtctgcaaccgtgggagacagtgtcaccatcacttgccggcaagtcgacattgacacctatttaaattgtatcaacatagacaggacggcccctaagctcctaatctatgctgcatccagttgcaaagtgggtccatcgaggttcagtggcagtggatctgggacagattcactcncacatcagtaatcngcaacgtgaagtatttagactaactaatttactagtacaactaagaatttaacaagtttacgttttaccggaccgtaaacgggaccgtaaccggaactttaaacgaaactttaaaaaccgtaacgttacgggtaggtaccgtacgtaccgtaacccgtaacttaccgttaccggtttacccttacgttaaccgttacccgtttaccccccgtaccgttaactttaccttacgttaaccg

SEQ ID NO: 141514 - DNA, 641 bp, Homo sapiens
  misc_feature: GYAE6OF02FHTCS.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagacagggacggcccctaagctcctaatctatgctgcatccagtttgacaagtgggtcccatcgaggttcagtggcagtggatcgttggggactagtatttccaacttctaccaccgtatcaagtaacttctgactaacgtagtaagtattttgacctaacttattacgttatacctaaacgtaagtaaatttactaacgtttaggttttaccggaccgtaaacgggtaacctaaccggtaaccttaaacgtaaaactttaaaaccggtaaccgttagggttacggtaccgtacggtaccgtaacccgtacttaccgttaccgtttacctttaccgttaacctttcccgtttacccccgacctttaccgttccttagttaaccg

SEQ ID NO: 141515 - DNA, 581 bp, Homo sapiens
  misc_feature: GYAE6OF02GIPQQ.46.67.G01.1.454.CMB.1.raw
  modified_base (392)..(392): a, c, t, g, unknown or other
  misc_feature (392)..(392): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgacaaagtggggtcccatcgaggttcagtggcagtggatcgtgggacagtacttcactctcaccatcagtaatctgacaagtgaagtntttgactaacttattactgtacaactagtaacttactaagttcgtttacggaccgtaacgggactaacgtaacttaaactaaaacgttaaaaccgaacgttagtacggtacttacgaccgtaacctaacttcgttacgttacctttactactttacccgtttaccccgacctacttaccgtacgtaacc

SEQ ID NO: 141516 - DNA, 567 bp, Homo sapiens
  misc_feature: GYAE6OF02FI9QR.46.67.G01.1.454.CMB.1.raw
  modified_base (213)..(213): a, c, t, g, unknown or other
  misc_feature (213)..(213): n is a, c, g, or t
  modified_base (253)..(253): a, c, t, g, unknown or other
  misc_feature (253)..(253): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcgggagacccctgtccctcacctgcgctgtctctggtncctccatcagtagttggtttctcgtggggctgggtccggnagcctcccgagggaaggggctggaatacattggagtgtctctcatagtggaggttcctattacagtccgtctctcaagagtcgagtcaccatatctctgacacgtccagcaatcagttttcccagagatgagttctgtgaccgccgctgacacgggtctttatactgtgcgagagacgctattatgtattttgggagttggttattcgacctacctagtactcggaccgggggctaccggacccccggttggggacccaaggggtaacttacggtcggttaccaacccggttcctccgtttacgcccttacccg

SEQ ID NO: 141517 - DNA, 566 bp, Homo sapiens
  misc_feature: GYAE6OF02GM66J.46.67.G01.1.454.CMB.1.raw
  modified_base (335)..(335): a, c, t, g, unknown or other
  misc_feature (335)..(335): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtcagcaatctagttttcccngaagatgagttctgtgaccgccgctcgacacgggtcttttatacgtgtgcgagagacggctattatgtattttggagttggttatttcgactaccctagactcggacggggctccgacccgtggggaccgagggaactacgtcggtcaccgttcctccgttagccctacgaccgaacggccccagtccggttccttccccgtgccctacccctccctaccacgacgtaccc

SEQ ID NO: 141518 - DNA, 598 bp, Homo sapiens
  misc_feature: GYAE6OF02GAPR8.46.67.G01.1.454.CMB.1.raw
  modified_base (171)..(171): a, c, t, g, unknown or other
  misc_feature (171)..(171): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttcttctggggctgggtccggcagctcccgagggaagggctggaatacagttggaagtgtctctcatagtggaggttcctattacagtccgtctctcaagagtcgagtccaccatactctctggacacgtccagcaatctacgttttcccagaagatgtagttctgtcgacccgccgctcgacgacgggtcttttattacgtgtgcgagagacggtctattatgttagttttggagttggtttattcgacctacctagagtcggacgggtcctaccgacccggtgggccgtaagggtaactacgtcggtcctaccgttcctccgttacgccgtaccaacccggtaacggtccctacgtcccggttcccttccccgtcggtaccctcccgtccctaccgacgtacgtcccg

SEQ ID NO: 141519 - DNA, 715 bp, Homo sapiens
  misc_feature: GYAE6OF02HXOPL.46.67.G01.1.454.CMB.1.raw
  modified_base (218)..(218): a, c, t, g, unknown or other
  misc_feature (218)..(218): n is a, c, g, or t
  modified_base (286)..(286): a, c, t, g, unknown or other
  misc_feature (286)..(286): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggacgacagtgtcaccatcacttgccgggnaagtcggaacattgacacctatttaaatggtatcaacatagaccaggacgccctaagctctaatctangctgctatccagtttcgacaaaggtgggtacccagtcgtaggttaccagtggcagtggactcgtggaacaggtatttacgaacttccgtactaaccgtacttacgtaacgttaacgttacgtagaaccttaacggtacggaaagttacgtttttcggaaaccgttaacctttaattaaccgttacggtaacctaaactaaacgggtaaattttaaccgtaaaacgtttcggtttttaacccgggaaccctaaacggggtaacccgaacggttaaaccgttaaaccgtaaaaacgtttaaaaccggtaaacgtttagggtacggaccttacggtaaccgaaccgttaacttaccgttacgtttacccgtttaactacgtttaaccccttaccccgggtacctttaaccggttacccttagggttaaaccc

SEQ ID NO: 141520 - DNA, 539 bp, Homo sapiens
  misc_feature: GYAE6OF02I73Z0.46.67.G01.1.454.CMB.1.raw
  modified_base (303)..(303): a, c, t, g, unknown or other
  misc_feature (303)..(303): n is a, c, g, or t
  modified_base (395)..(395): a, c, t, g, unknown or other
  misc_feature (395)..(395): n is a, c, g, or t
  modified_base (528)..(528): a, c, t, g, unknown or other
  misc_feature (528)..(528): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccaggggaaggggctggaatacagttggaagtgtctctcatagtggaggttcctattacagtccgtctctcaagagtcgagtcaccntatctctggacacgtccagcaatctagttttcccagaagatgtagttctgtcgaccgcgctgacagggtctttatactgtgcgagagacgtntattatgtattttggagttgttattcgactcctagagtcggacgggctcgacccgtgggccagggactacgtgtcaccgtctccttacgcctccacgaacggcccagtccgtccttccccgtcgcctccctcnccacgacgccg

SEQ ID NO: 141521 - DNA, 555 bp, Homo sapiens
  misc_feature: GYAE6OF02H2Z38.46.67.G01.1.454.CMB.1.raw
  modified_base (251)..(251): a, c, t, g, unknown or other
  misc_feature (251)..(251): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtcccctcacctgcgctgtctctggtgcctccatcagtagtggtttctcgtggggctgggtccggnagctcccgagggaaggggctggaatacattggaagtgtctctcatagtggaggttcctattacagtccgtctctcaagagtcgagtcaccatatctctggacacgtccagcaatctagttttccctgaagatgagtttctgtgaccgccgctgacgacgggtgtttacttactgtgcgagagtacggctattatgtatttttggagttggttatttcgtacacccttagatcggacggggtcctccggacccgtcgggccgagggaactacgtcggtccgaccgttctccgttagccctacccg

SEQ ID NO: 141522 - DNA, 534 bp, Homo sapiens
  misc_feature: GYAE6OF02FLPNU.46.67.G01.1.454.CMB.1.raw
  modified_base (357)..(357): a, c, t, g, unknown or other
  misc_feature (357)..(357): n is a, c, g, or t
  modified_base (388)..(388): a, c, t, g, unknown or other
  misc_feature (388)..(388): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgactacctaatttaaattggtatcaacatagaccaggacggcccctaagctcctaatctatgctgcatccagtttgacaagtcgggtcccatcgaggttcaggtggcagtggatcgtgggacaggtnttcactctcacatcagtatctagcaacgtanaagtatttgactaattattactgtaccaacaagtaattactaagttgtttaccggactaaggacacgtacttaacgaaacttaaacgaactagagtctacgcaacatctcgttacttcacttccttacccgctacttccgtagtac

SEQ ID NO: 141523 - DNA, 547 bp, Homo sapiens
  misc_feature: GYAE6OF02FH0RQ.46.67.G01.1.454.CMB.1.raw
  modified_base (303)..(303): a, c, t, g, unknown or other
  misc_feature (303)..(303): n is a, c, g, or t
  modified_base (333)..(333): a, c, t, g, unknown or other
  misc_feature (333)..(333): n is a, c, g, or t
  modified_base (337)..(337): a, c, t, g, unknown or other
  misc_feature (337)..(337): n is a, c, g, or t
  modified_base (544)..(544): a, c, t, g, unknown or other
  misc_feature (544)..(544): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatanctctgacacgtccagcaatcagttttcccngaanatgagttctgtgaccgccgctgacacggggtcgtttattactgtgcgagagacggctattatgtatttttggagttggttatttcgactaccctagtactcggacgggggtctcgacccgtggggccagggaactacgtggtccacgtctcctacgcctccacgaacggcccacgtccgtccttccccgtgccaccctcctaccagngcc

SEQ ID NO: 141524 - DNA, 528 bp, Homo sapiens
  misc_feature: GYAE6OF02G83CU.46.67.G01.1.454.CMB.1.raw
  modified_base (418)..(418): a, c, t, g, unknown or other
  misc_feature (418)..(418): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaattggtatcaacatagaccagggacggcccctaagctcctaatctatgctgcactccagttttgcaaagtcggggtcccatcggaggttcagtggcagtggatctgggacagatttcactctcacatcagtaatctgacaacgtgaagtattttgactaacttattactgtacaanagtaattacaattgtttcggacgtaaggacacgaactaacaaattaaacgatagtaggtctagacctaccattctgttctttaccacttccttcccgctattcctgtaac

SEQ ID NO: 141525 - DNA, 745 bp, Homo sapiens
  misc_feature: GYAE6OF02HM82Y.46.67.G01.1.454.CMB.1.raw
  modified_base (278)..(278): a, c, t, g, unknown or other
  misc_feature (278)..(278): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtgtggtttcttcgtgggctgggtccggcagcctccgaggggaagggctaggaatacngttggaagtgtactctacataggtggtacggttcctatttacgagttccgtctctacaagtagtacgtagtccaccgtatactctcgtagggaccacggtccagacaacttcgttacgttttcccagaagtattgtacgtttactgtacgacccgtccgtacgtcgaaccgtacggggttacgttttaacgttacgttcggttacggacggtaacggaacggtacggtacgtttaagtttacgttacggtttaagttttttacgggagttttagggttttaacgttttaccgaaccccgttaacccgttaagggtaccgttaccggggacccgggggttaccttaccccgggtaacccccgggtttacgggggaccccggtaaagggtaaaccgtttaccgggttaccggtacccggtacccggttttaccccgttaccgttaacccggtcccgttaaaccccccgg

SEQ ID NO: 141526 - DNA, 596 bp, Homo sapiens
  misc_feature: GYAE6OF02JHEHW.46.67.G01.1.454.CMB.1.raw
  modified_base (353)..(353): a, c, t, g, unknown or other
  misc_feature (353)..(353): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacgttgccgggcaagtcggaacattgacacctattaaattggtatcaacatagacctagggaccgcccctaagctcctaatctatgactgcatccagtttgctaaagtgggtcccatcgaggttcagtgcagtggatcgtggacagntttcactcgtcaccatctagtaatctcgactaacgtgtaatattttgactaacttacttacgttagtaccaaacgtataaacgttactaagttgttttaccggaacgtaacgggacctacgtaacttaaccgtaaaagttaaacctaacgtgttacgacttacgaccgtaacctattaccgttacggttaccttacgtaccttcccgtttaccccggtacctaacgttaccttacgttaaccg

SEQ ID NO: 141527 - DNA, 650 bp, Homo sapiens
  misc_feature: GYAE6OF02JJKPR.46.67.G01.1.454.CMB.1.raw
  modified_base (258)..(259): a, c, t, g, unknown or other
  misc_feature (258)..(259): n is a, c, g, or t
  modified_base (377)..(377): a, c, t, g, unknown or other
  misc_feature (377)..(377): n is a, c, g, or t
  modified_base (402)..(402): a, c, t, g, unknown or other
  misc_feature (402)..(402): n is a, c, g, or t
  modified_base (408)..(408): a, c, t, g, unknown or other
  misc_feature (408)..(408): n is a, c, g, or t
  modified_base (462)..(462): a, c, t, g, unknown or other
  misc_feature (462)..(462): n is a, c, g, or t
  modified_base (473)..(473): a, c, t, g, unknown or other
  misc_feature (473)..(473): n is a, c, g, or t
tcagactagcagtacacgaccggtgctcgatttagagtatacatattgggtttgggggtaccgtcctgtgcaagaacatgaagcacctgtggtttgtcctcctgctggtggcagctcccagatgggtcctgtccctggtgcaactgcaggagtcggcccacgactggtgaggccttcggagaccctgtcccctcacctgcgctgtcctctggtcgcctccatcacgttagttcggtttctcgtggggctggggtccgnngctcccgagggtacgggctggaactacagttggagtgtctctcgataggtgaggttcctattacgagttccgtctctacgaagtagtcgacgtaccacctattactctctacggtacnccgtcagacaattctacgtttcccngaagtntgtagttctgtcgccgcgctgaccgtacggtcgtttacgtacgtgtcggtacgngacggtacgtntagtttagtaggttagttttcgggtagtttaggtttactttcggaccgttaaccgtagtacgttaccggtacggggttccgacccggtacccgggttaggggacctaacgggggttaactaccgggttaccggtccgtaacccggttcgtacccccggtttagacccgttaaccccg

SEQ ID NO: 141528 - DNA, 749 bp, Homo sapiens
  misc_feature: GYAE6OF02IFR6L.46.67.G01.1.454.CMB.1.raw
  modified_base (277)..(277): a, c, t, g, unknown or other
  misc_feature (277)..(277): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtctccatccctccctgtcctgaccaaccggtgggacacagtcgtcaccatcacgttcggccgggacaaggtcggaaacagttacgacctaccttaagttttaaatggtatacaanatagacgagggaccgccctaagctacctatctatcactgactactccgtagtttcgacgtaaacggtcgggtccctagtcgtaggttcgaggtcggactaggtaggactcggttacggggaactacggttaactttccgacttaccctaccgtaacccgtaagttaccctaaaggtttaaccgttacgttacggaaccgtaaacggttacgtaaacggtttacttttacggtaaaccttaactttttacgtaaccgtttcgtaacctaaaacgtaacttaaaatttacaacgtttttacggttttaccggaacccgtaaacgggtaaacctaaccgtaaacttaaactaaaaggttaaaacccgtaagtcggttagtaccgtaacgtaccaacccgttacttacgttaccggttacctttacgttaaccgttaccccgtttacccgtaaccctaacgtttcgtaacgtaccg

SEQ ID NO: 141529 - DNA, 602 bp, Homo sapiens
  misc_feature: GYAE6OF02F146X.46.67.G01.1.454.CMB.1.raw
  modified_base (285)..(285): a, c, t, g, unknown or other
  misc_feature (285)..(285): n is a, c, g, or t
  modified_base (332)..(332): a, c, t, g, unknown or other
  misc_feature (332)..(332): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctccagggagggctggaatacattggaagtgtctctcatagtggaggttcctattacagtccgtctctcaagngtcgagtcaccatatctctggacacgtccagcaatctagttttcccngaagatgagttctgtgaccgcgctgacacgggtcgtttatacgtgtgcgagagacgctatatgtattttggagttggttatttcgactaccctagacgtcggacggggtctccggaccccgtgggggaccgtaggggaactacgttcggtccgtaccggttcctcccgttacgcccttacccgaacccgaacgggacccctacgttacccggttcccgtttccccccgtcggtccctacccccgttccctacccgtaacgacgtaccccg

SEQ ID NO: 141530 - DNA, 617 bp, Homo sapiens
  misc_feature: GYAE6OF02FGO5Y.46.67.G01.1.454.CMB.1.raw
  modified_base (170)..(170): a, c, t, g, unknown or other
  misc_feature (170)..(170): n is a, c, g, or t
  modified_base (282)..(282): a, c, t, g, unknown or other
  misc_feature (282)..(282): n is a, c, g, or t
  modified_base (286)..(286): a, c, t, g, unknown or other
  misc_feature (286)..(286): n is a, c, g, or t
  modified_base (305)..(305): a, c, t, g, unknown or other
  misc_feature (305)..(305): n is a, c, g, or t
tcagactagcagtacacgaccggtgctcgatttagagtatacatattgggtttgtcctcctgctggtggcagctcccagatgggtcctgtccctggtgcaactgcaggagtcggcccacgactggtgaggccttcggagaccctgtccctcacctgcgctgtctctggtncctccatcagtagtggtttctcgtggggctgggtccggcagctccgaggggagggctaggaatacattggaagtgtctctcatagtggagttcctattacagtccgtctctnaagngtcgagtcaccatactctntgacacgtcagcaatctacgttttccagaacgtatgtagttctgtcgaccgccgctcgacgcgggttactttatacgtgtgacgagagacgtctaattatgttattttgggagttggttactttcggactaccgtagtacgtcggacggggtcctccggaccccggtggggaccgtaagggtacttacgtcggtacctaccgttcttacccgttacgtccctacccgaccggtaaccgggtccctacgttcccggttccccgttcccccgtcggtcccctacccccgtccctacccgaaccgtcgtaccccg

SEQ ID NO: 141531 - DNA, 695 bp, Homo sapiens
  misc_feature: GYAE6OF02JJ5SG.46.67.G01.1.454.CMB.1.raw
  modified_base (230)..(230): a, c, t, g, unknown or other
  misc_feature (230)..(230): n is a, c, g, or t
  modified_base (254)..(254): a, c, t, g, unknown or other
  misc_feature (254)..(254): n is a, c, g, or t
  modified_base (326)..(326): a, c, t, g, unknown or other
  misc_feature (326)..(326): n is a, c, g, or t
  modified_base (338)..(338): a, c, t, g, unknown or other
  misc_feature (338)..(338): n is a, c, g, or t
  modified_base (357)..(357): a, c, t, g, unknown or other
  misc_feature (357)..(357): n is a, c, g, or t
  modified_base (383)..(383): a, c, t, g, unknown or other
  misc_feature (383)..(383): n is a, c, g, or t
  modified_base (407)..(407): a, c, t, g, unknown or other
  misc_feature (407)..(407): n is a, c, g, or t
tcagactagcagtacacgaccggtgctcgatttagagtatacatattgggtttgggttccgtcctgctggtcggctagcgtcccagatgggtcctgtccctcggtacgcaactgcaggagtccgggccccaccgactggtgaaggccttacggagaccctggtccctcgacctggcgctgtctctggtgctcccccatcagtagtggtttcttcgtgggctgggtcggcngctccgagggagggctaggaatanattggaagtgtctctcagtagtggagttcctattacagtcctctctacaagagtcgacgtcaccatagtctntggacacgtcanacatctactttcctagaanagtcgtagttctgtcgaccgtccgtntcggacgtcggtacgtttacgttntggttcgaggaagtcggaaggtcttaagttattggttagttttaggtagttagggtttactttcggtaaccgttaccgtagtaaccgttcgggacggggttcctaccggccccggtgggtaccggtaaggtaccgtttaagcggttacccaacccgggtttcttacccgtacgtccccgtaccgaaccggtacccggtaccctacggttccccggttaccccgtttccccggtacccggttaccccgtaccccttacccgtacccggtaaccgtccggtaacccccgg

SEQ ID NO: 141532 - DNA, 748 bp, Homo sapiens
  misc_feature: GYAE6OF02I4J2L.46.67.G01.1.454.CMB.1.raw
  modified_base (196)..(196): a, c, t, g, unknown or other
  misc_feature (196)..(196): n is a, c, g, or t
tcagactagcagtacacgaccggtgctcgatttagagtatacatattgggtttggggagtctcggtcaggacacagcatggacatggacgggtcccgctcagctccgtggggctcctgctactctggctccggaggtgccagatgtgacatcgagctcgacccagtcctccatcctcctgtctgcaaccgtggganacagtgtcaccatcacttggccgggacaaggtcggaacattgacacttatttaaatggtatcaacatacgaaccgagggaccggcccctaagctacctaatctatgctgctactccgtagtttcgacgtaaaggtcggggtacccagtcggtaggttccgaaggttcggacgtaggtcgggtactccgttaggggactaaggttactttaccgactttccgtaccaacctactaccgtaagttaaacttccgtgtaacctaaacggtacggaaagttaactttttacggaacctttaaacgttttaactttacgttaacggtacctaaacgaaggttaaatttaacctaaaagtttcgggtttttaaccgggaccgttaaacggggaacctaacggtaaccttaaaacttaaaacgttaaaaaccgaacgttacggttaggaccgttagtaacccgtaaccgttaacgttaccgtttacggttaccctttttaccgaaccgtttacccgttttaaccccggacccggtaacctttcgtaacgtttaaacccg

SEQ ID NO: 141533 - DNA, 762 bp, Homo sapiens
  misc_feature: GYAE6OF02H6UHO.46.67.G01.1.454.CMB.1.raw
  modified_base (220)..(220): a, c, t, g, unknown or other
  misc_feature (220)..(220): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgacaaccgtggagacagtgtacaccatcacttggccggganagtacggaacattgactactatttaaattggtatacaacagtacgaccgtaagggaccgccctaaagctacctaatctatcgactgactactactagtttagactaaaggtcgggtcccaagtccggaggttcgaggttcggcaggttggactcgtggggaacagtacttttccgacttacgtaccacctaattaccgaagttaacgtacgttacgaccgtaaacggttaggtaaacggtttagttttacgaaccgttaaactttttaacgttaaccgttacggttaacaaaacgtaacgttaaaacgtttaaacgtaaacgttttcgggttttaaccggaaccgtaaccggggtaaacctaacggttaaaccttaaaccgtaaaaacgtttaaaaaccggaaccgtttacggtaacgggtacccgttaccggtaacccgtaaccttaaccgtttacgtaacggtttttacccttaccgtttaaccgttaccccgttttaacccccggacccttaaagttttccccggtaagtttaaacccg

SEQ ID NO: 141534 - DNA, 579 bp, Homo sapiens
  misc_feature: GYAE6OF02FX89L.46.67.G01.1.454.CMB.1.raw
  modified_base (373)..(373): a, c, t, g, unknown or other
  misc_feature (373)..(373): n is a, c, g, or t
  modified_base (378)..(378): a, c, t, g, unknown or other
  misc_feature (378)..(378): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccgcagcctcccgagggagggctggaatacgattggaagtgtctctcatagtggtaggttcctattacagtccgtctctcaagagtcgagtcacatatctcgtgacacgtccagcaatctagtttcccngaagntgagtttctgtcgaccgccgctgacgtacgggtctttatacgtgtcgcgagagacgcttattatgtagttttggagttggtttacttcgactaccgtagacgtcggacggggctaccggaccccggttggggacccgtaagggtaacgtaccgttacgggttccctacccggttccgttacccgttacgcccctaaccccg

SEQ ID NO: 141535 - DNA, 595 bp, Homo sapiens
  misc_feature: GYAE6OF02IST81.46.67.G01.1.454.CMB.1.raw
  modified_base (377)..(377): a, c, t, g, unknown or other
  misc_feature (377)..(377): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtcgcctccatcagtagtggtttcttctggggctgggtccgcagctcccgagggaaggggctggaatacattggaagtgtctctcatagtggaggttcctattacagtccgtctctcaagagtcgagtcaccatatctctggacacgtccagcaatctacgttttcccngaagtatgtagtttctgtcgaccgccgctgacgacgggtctttattacttgtcgcgagacgacggtctagttatgttagtttttggagtttggtttatttccgtactacccttagacgtcgggaccggggtctcccggtacccggttcggggaccgtaaggggtaacttacggttcggttccgtacccgttccgtacccgtttacgccccgtaacccg

SEQ ID NO: 141536 - DNA, 635 bp, Homo sapiens
  misc_feature: GYAE6OF02IOS17.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtcgcctccatcagttagtggtttcttcgtggggctgggtccggcagcctcccgagggaggggctggaatacagttggaagtgttctctcattaggtggtaggttccttattacacgttccgtctctacgaagtagtcgagtcacctatactctcgtaggacacgtccagcaatctacgttttcccagtaagatagtagttcgtcgtcgaccgccgctcggacgtacgggtcgttttagttacgttggtcgacgacggacgacggtctttagttacgttgttagtttttaggagtttggtttacttcgtaacctacccgtagacgttcgggacggggtctacccggcccggtacggggacccgtacgggtaacgttacgttacggtccgtacccggttaccgtaccgttaccgcccgttaaccccgg

SEQ ID NO: 141537 - DNA, 640 bp, Homo sapiens
  misc_feature: GYAE6OF02F86BA.46.67.G01.1.454.CMB.1.raw
  modified_base (228)..(228): a, c, t, g, unknown or other
  misc_feature (228)..(228): n is a, c, g, or t
  modified_base (252)..(252): a, c, t, g, unknown or other
  misc_feature (252)..(252): n is a, c, g, or t
  modified_base (292)..(292): a, c, t, g, unknown or other
  misc_feature (292)..(292): n is a, c, g, or t
  modified_base (343)..(343): a, c, t, g, unknown or other
  misc_feature (343)..(343): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttgccgggcaagtcgaacnttgacacctaatttaaatggtatnaacatagacagggacgcccctaagctcctaatctatgctncatcctagtttgcaaaggtcgggtacccagtcgaggttcagtggcagtggntcgtgggacagtatttcactctcaccatacagtaatctagcgaacgtagaagttattttagactaaacttacttacttcgtacctaaacgtaagtaaactttaacgtaagtttacggtttttacggaccgtaaacgggtaacgtaaccggtaaccgttaaacgtaaaaacgttaaaaccggtaaacgttagttacgggtaccttacggtaccctaaccgtaacgttaccgttacgttaccttttaccgtaacgtttccctttaccccggtaccctaccgtttacgtaccgttaaccg

SEQ ID NO: 141538 - DNA, 636 bp, Homo sapiens
  misc_feature: GYAE6OF02HE9P4.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccggcaagtcggaacattgacacctatttaatggtatcaacatagaccgagggacgacccctaagctacctatctatgctgcatcctagtttgactaaggtcgggtacccagtcggtaggttcaggtggcaggtggatcgtagggactaggtactttcacttctacacctatacgtaagttactctagacctaacgtagtaagttattttacgacttaaactttattacgttacgtactaaacgtaagttaaattaactaacgtttggttttacccgggaaccgtaagggtaaccctaaacgtaaccttaaacgtaaaacgttaaaccgtaacgttagtaccggttactacgtaccgtaaccctagttccgtacgttaccttacgtaccgttacccttaccccgtacctacttccgtagtaaccg

SEQ ID NO: 141539 - DNA, 713 bp, Homo sapiens
  misc_feature: GYAE6OF02H560X.46.67.G01.1.454.CMB.1.raw
  modified_base (212)..(212): a, c, t, g, unknown or other
  misc_feature (212)..(212): n is a, c, g, or t
  modified_base (247)..(247): a, c, t, g, unknown or other
  misc_feature (247)..(247): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtcncctcatcagtgttgttctcgtggggctgggtccgnagctccgagggacgggctggaactacgtagttggaagtgtctcgtcagttaggtggtacgttccgttattaactacggttcccgtacttcgtacaaaggtcggttaccggagttccaacctatacttctcgtaggacctaccggtccaacggtaccaaactttccgttaacgttttttccccgaggtaaaccggtagtttacggtaacgttttccgttacggtacccggaccccgggtccgtccgttacggacccggtaccgggggttacgtttttaacggtttacctggggtcgacggagtacggacgtacttattacgtgttttagttttcgggtaggtttaggtttatttaccggaacctaccgttagacgttacgggacggggtccgtcccggtaccccggtgggaccgaggtaactcggtgttcccgtaccgttccgtacccgttacggcccttaacccgg

SEQ ID NO: 141540 - DNA, 607 bp, Homo sapiens
  misc_feature: GYAE6OF02FRE88.46.67.G01.1.454.CMB.1.raw
  modified_base (334)..(334): a, c, t, g, unknown or other
  misc_feature (334)..(334): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccaggggaagggctggaatacattggaagtgtctctcatagtggaggttcctattacagtccgtctctcaagagtcgagtcaccatatctctggacacgtccagcaatcagttttcccngaagatgagttctgtgaccgccgcgtcgacgacgggtcttttatactgtgcgagagacggtctattatgtattttggagttggttatttcgactaccctagactcgggacggggtcctccggtaccccgtggggaccgaggggtaacttacgttcggtcctaccggttccttcccgttacgtccctacccaaccggaaccgggccctacgttcccggttccctttcccccgtcggtccctacccccgttccctacccgaacggtccgtacccg

SEQ ID NO: 141541 - DNA, 607 bp, Homo sapiens
  misc_feature: GYAE6OF02FHYKG.46.67.G01.1.454.CMB.1.raw
  modified_base (192)..(192): a, c, t, g, unknown or other
  misc_feature (192)..(192): n is a, c, g, or t
  modified_base (295)..(295): a, c, t, g, unknown or other
  misc_feature (295)..(295): n is a, c, g, or t
  modified_base (375)..(375): a, c, t, g, unknown or other
  misc_feature (375)..(375): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcgacattgacacctatttaaatggtatcaacatacgaccagggaccggcccctaacgctcctaactctatgctncgatccagtttagcaaagtggggtccactcgacggttcagtggcagtggatcgtgggacagtatttcactctcgacctancataactctcgtcgaacgtgaaagtattttacgtactaaacttattaccttagtactaacgaacgtaatttactaatttacgtttttaccggaccgtaaacggggtaacaaccgtaacgttaacaaaactttaaaaccgaacttaggtcggtacgtacgacgaacctatacctttacggttaccttcgtaaaccttcccgttaaccccgcctaacgtacgttacggttaacc

SEQ ID NO: 141542 - DNA, 602 bp, Homo sapiens
  misc_feature: GYAE6OF02ID3O9.46.67.G01.1.454.CMB.1.raw
  modified_base (406)..(406): a, c, t, g, unknown or other
  misc_feature (406)..(406): n is a, c, g, or t
tcagactagcagtacacgaccggtgctcgatttagagtatacatattgggtttggggagtctcggtcaggacacagcatggacatgagggtcccgctcagctcctggggctcctgctactctggctccgaggtgccagatgtgacatcgagctgacccagtctccatcctccctgtctgcaaccgtgggagacagtgtcaccatcacttgccgggcaagtcgaacattgacacctatttaaatgtatcaacatagaccaggacgcccctaagctcctaatctatgctgcatccagtttgcaagtgggtccagtcgaggttcagtggcagtgatctagggactagacgtttcactctacacctatcagtatctagacaacgtgtaagtattttgacctaaacgtttnttaacgtgttacgaaactaagtaaacttactaagttacgtttttacggaccctaaggggtaacccaacggtaaccttaaaccgtaaaacgtttaaaaacgaccgttaagttacgggtaccttacggacctaaccttaacgttcttacggttaccttaccgtaacttccttccccggtacctacttactattaaccg

SEQ ID NO: 141543 - DNA, 580 bp, Homo sapiens
  misc_feature: GYAE6OF02ILB69.46.67.G01.1.454.CMB.1.raw
  modified_base (249)..(249): a, c, t, g, unknown or other
  misc_feature (249)..(249): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggcctttcggagaccctgtccctcacctgcgctgtctctggtgcctccatcagtagtgtttctcgtgggctgggtccggnagcctccgagggaggggctggaatacagttggaagtgtctctcatagtggaggttcctattacgagtccgttctctcgaagagtcgagtcactatactctctgacacgtcagcaatctacgttttccctagtaagatagtagttctggtcgaccgtcgctgacgacgggtcgttttatacgtgtcgcgagtacgagtctattagtgttagttttggtagttagtttattcgtaactacctagacgttcggacggggtctaccggtcccggtcgggaccgtaagggtaactacgtcggtaccaccggttcctaccgttaccgaccctacccg

SEQ ID NO: 141544 - DNA, 559 bp, Homo sapiens
  misc_feature: GYAE6OF02GN3Z4.46.67.G01.1.454.CMB.1.raw
  modified_base (249)..(249): a, c, t, g, unknown or other
  misc_feature (249)..(249): n is a, c, g, or t
  modified_base (375)..(375): a, c, t, g, unknown or other
  misc_feature (375)..(375): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtcgcctcatcagtagtgtttctcgtggggctgggtccggnagctccgagggaaggggctggaatacattggaagtgtctctcatagtggaggttcctattacagtccgtctctcaagagtcgagtcaccatactctctggacacgtcagcaatctacgttttcccngaagtatgtacgttctggtcgaccgcgctgacgacgggtctttattactgtcgcgagacgacgtctattatgtatttttggagttgtttattcgactaccgtagacgtcggacggggtctaccggcccgtagggccaagggtactacgttcggtccgtaccgttcgtccgttacgccctacccg

SEQ ID NO: 141545 - DNA, 621 bp, Homo sapiens
  misc_feature: GYAE6OF02JEOVH.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaatgatcaacatagacagggacgcccctaagctacctaatctaatgctagcatccagtttgacaaaggtcggggtaccccagtcggtaaggttcaggtacggctaaggtggaagtccgtaggggacaggtaatttcgaactctcacctatactagtaaactcgtacgactaacgtagaagttatttcgtacaaactttaattacgttagactaaatacggtaaatttacaacgtttcggttttaccgaccgtaagggaacctaacgtaaccttaaacaaaagttaaaccgaaacgtaggtgacttacgaccgaacctaacttcgtaaccggtttcttaccgtactttacccgtttaccccgacttaactcccttagtaac

SEQ ID NO: 141546 - DNA, 607 bp, Homo sapiens
  misc_feature: GYAE6OF02HMJRR.46.67.G01.1.454.CMB.1.raw
  modified_base (409)..(409): a, c, t, g, unknown or other
  misc_feature (409)..(409): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaattggtatcaacatagaccgagggacgacccctaagctacctaatctatgctgcatcctagtttgacgtaaaggtcggggtacccagttcggaggttcgaggtggcaggtggatcgtgggacagtattcactctacaccatcgataatctagactaagtgaagttntttagactaacttattacttgtactaaactagtaattaactagtttcgtttaccggaaccgtaagggtaactaaccggtaacttaaacgtaaaacgttaaacgaacgttaggtacgactacgacctaaccgtattaccgtcgtttaccttacgttaccttacccgttacccgtacccttaacttaccgtagttaaccg

SEQ ID NO: 141547 - DNA, 593 bp, Homo sapiens
  misc_feature: GYAE6OF02JZ9U6.46.67.G01.1.454.CMB.1.raw
  modified_base (209)..(209): a, c, t, g, unknown or other
  misc_feature (209)..(209): n is a, c, g, or t
  modified_base (215)..(215): a, c, t, g, unknown or other
  misc_feature (215)..(215): n is a, c, g, or t
  modified_base (239)..(239): a, c, t, g, unknown or other
  misc_feature (239)..(239): n is a, c, g, or t
  modified_base (366)..(366): a, c, t, g, unknown or other
  misc_feature (366)..(366): n is a, c, g, or t
  modified_base (404)..(404): a, c, t, g, unknown or other
  misc_feature (404)..(404): n is a, c, g, or t
  modified_base (420)..(420): a, c, t, g, unknown or other
  misc_feature (420)..(420): n is a, c, g, or t
  modified_base (449)..(449): a, c, t, g, unknown or other
  misc_feature (449)..(449): n is a, c, g, or t
tcagactagcagtacacgaccggtgctcgatttagagtatacatattgggtttggggagtctcggtcaggacacagcatggacatgagggtccccgctcagctcctgggggctcctgctactctggctccgaggtgccagatgtgaccatcggagcctgaccctagtcctccgctccctccctgtctgctaaccggtgggacactggtntcaccntcgacttgccgggcaagtcggaanttcgactactatttaaagtgatacaacatagaccgaggaccgtccccaatctctaatcatgactgctactcctagtttcgactaacgggtcgggtaccagttccgaaggttcaggtcgctaggtcgngtcgtaggacaggtcttcacttcgccactatcaagtancggtacactaacggtnaaattcgttagacctaattactttaacgntaaccaataacggtattaacgtcgtttacggttaccgaacggacgtaacgaactaactaaacgtaaacgttaacgtactgacgtctacgactaactacgttactcgttaccttacctcggttaccctacggctattctacgtac

SEQ ID NO: 141548 - DNA, 558 bp, Homo sapiens
  misc_feature: GYAE6OF02H8QRP.46.67.G01.1.454.CMB.1.raw
  modified_base (364)..(364): a, c, t, g, unknown or other
  misc_feature (364)..(364): n is a, c, g, or t
  modified_base (412)..(412): a, c, t, g, unknown or other
  misc_feature (412)..(412): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctacctaatctatgctgcatccagtttgacaaagtgggtcccatcgaggttcagtcggcagtggatcgtgggacagtatttcactcncaccatcatactctgacaagtagaagttatttgactaacttattactntacaacataattactaattgtttacgaccgtaaggaccacgtaactaactaaaagtaaacgtaaactgtacggactacgaccgtaacctattcgttagttactttaccgtactttccttaccccggtacctacttcctagtaaccg

SEQ ID NO: 141549 - DNA, 548 bp, Homo sapiens
  misc_feature: GYAE6OF02GHBUA.46.67.G01.1.454.CMB.1.raw
  modified_base (211)..(211): a, c, t, g, unknown or other
  misc_feature (211)..(211): n is a, c, g, or t
  modified_base (249)..(249): a, c, t, g, unknown or other
  misc_feature (249)..(249): n is a, c, g, or t
  modified_base (329)..(329): a, c, t, g, unknown or other
  misc_feature (329)..(329): n is a, c, g, or t
  modified_base (380)..(380): a, c, t, g, unknown or other
  misc_feature (380)..(380): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttctcgtggggctgggtccgnagcctcccgagggaggggctggaatacattggaagtgtctctcatagtggtaggttcctattacagtccgtctctcaagngtcgagtcaccatatctctggacacgtcagcaatctagttttccagaagtntgagttctgtcgaccgcgctgacgtacgggtcttttatcgttgtgcgagagacgtcttaagttagtgttagtttttggagtttggtttatttcgacctaccgtagacgtcggacgggctccggcccgtgggccaggtactgtcgtcaccgttctccttacgcctaccg

SEQ ID NO: 141550 - DNA, 650 bp, Homo sapiens
  misc_feature: GYAE6OF02JOW5M.46.67.G01.1.454.CMB.1.raw
  modified_base (191)..(191): a, c, t, g, unknown or other
  misc_feature (191)..(191): n is a, c, g, or t
  modified_base (478)..(478): a, c, t, g, unknown or other
  misc_feature (478)..(478): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgganacagtgtcaccatcacttgccgggactaagtccggaaatgttcgacctacttaatttaaacgtggtatcaacatacgaccgtaggaccgtacccaagctacctaacgtactactgctgcactccgtagtttacgacaacggtcgggtacccaagttcgtaacggttcaacggtggactaaggtcgtagtcgtaggggacagtacgtttacacttcgtacaccagtactacgttaatcgtcgacgtaacgtaagaacttagttttacgacttaaactttacttacgtnttaacctaaacgaacgttaattaaactagtttacgttcggtaaccgtaagggtaaccctaacgtaacttaaccgtaaaagttaaaaccgtacgtacggttaagtccgtacaacctaacgtacttacgtaccgttacttacgtacttcctcccgacctaattccgttagtaac

SEQ ID NO: 141551 - DNA, 632 bp, Homo sapiens
  misc_feature: GYAE6OF02ISO2T.46.67.G01.1.454.CMB.1.raw
  modified_base (171)..(171): a, c, t, g, unknown or other
  misc_feature (171)..(171): n is a, c, g, or t
  modified_base (290)..(290): a, c, t, g, unknown or other
  misc_feature (290)..(290): n is a, c, g, or t
  modified_base (317)..(317): a, c, t, g, unknown or other
  misc_feature (317)..(317): n is a, c, g, or t
  modified_base (351)..(351): a, c, t, g, unknown or other
  misc_feature (351)..(351): n is a, c, g, or t
  modified_base (391)..(391): a, c, t, g, unknown or other
  misc_feature (391)..(391): n is a, c, g, or t
  modified_base (413)..(413): a, c, t, g, unknown or other
  misc_feature (413)..(413): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggttctcgtgggctgggtccggcagcctccgagggagggctggaatacagttggaagtgtctctcaataggtggtacggttcctaagttacagttccgtctctanaaaggtgtacggatacacatatctcgngacacgtcagacctaatctacgttttccagaatntagtacttcacgtcgacccgtcgtctagaccgacgggttnttttaatacgtgtcgagaacgnggaacgtctaattatagttagttttggagttagtttacttccgtaactaccgtagtacgttcgggaccggggtcctaccggacccgtgggtaccgaagggtaacttcgtacgtactaccgtaccttaccgtaccgccctaccgaaccggtaacccggaccttacgtacccgttcccgtccccgtagtccccgacccttccgaaccgtacgacgtacccg

SEQ ID NO: 141552 - DNA, 848 bp, Homo sapiens
  misc_feature: GYAE6OF02JWCZ4.46.67.G01.1.454.CMB.1.raw
  modified_base (97)..(97): a, c, t, g, unknown or other
  misc_feature (97)..(97): n is a, c, g, or t
  modified_base (108)..(108): a, c, t, g, unknown or other
  misc_feature (108)..(108): n is a, c, g, or t
  modified_base (185)..(185): a, c, t, g, unknown or other
  misc_feature (185)..(185): n is a, c, g, or t
tcagactagcagtacacgaccggtgctcgatttagagtatacatattgggtttgtcctcctgctggtgcagctcccagatgggtcctgtccctggtncaactgcaggngtccggccacgactggtcgacggtcccttagggacgtacccttcgtccctacaccgtgcgtcttcgtctcgtggtcncctacatcgtagttggttcgtttcgtcggtcgggtactcggggtaccgcacgtccgtaccggagggggtacgtctacgacttaacgagttggacttcgtctacgtcaaggttacggtacggttacgtttaccttacgttaccgtacggttcctacctacgtaacgaacggtacggttaccgacgttaccaaccttagttacgttaccgtacggtacggaacctaccgttaccgaacgtaacctaacgtttaccgtttaccggttttaccgaaaggtaacgttacgttcggttaacgttccgttacggaccggtaccgtccgtacgtacgtacggtacggggtttactttacgtacgtcgacgacggtacgtacggtacgtactttaagttagttaggtttaggttttaggacgtttacggtttacgtttaccgaacgttacccgtaaggtaccggtacggggtacccggggtacctacccgggtaccggtacggggtaaaccgtaagggtaacctttccgggtaccggttacccttaaccggttccttacccgtaacccgtcccttaacccggaacggtacccgggttcccttaaccgggtttccccgttacccgtacccggtacgacccgtaccctaccgtacggaacgtccggttaacccg

SEQ ID NO: 141553 - DNA, 677 bp, Homo sapiens
  misc_feature: GYAE6OF02GNLJN.46.67.G01.1.454.CMB.1.raw
  modified_base (194)..(194): a, c, t, g, unknown or other
  misc_feature (194)..(194): n is a, c, g, or t
  modified_base (207)..(207): a, c, t, g, unknown or other
  misc_feature (207)..(207): n is a, c, g, or t
  modified_base (251)..(251): a, c, t, g, unknown or other
  misc_feature (251)..(251): n is a, c, g, or t
  modified_base (275)..(275): a, c, t, g, unknown or other
  misc_feature (275)..(275): n is a, c, g, or t
  modified_base (389)..(389): a, c, t, g, unknown or other
  misc_feature (389)..(389): n is a, c, g, or t
tcagactagcagtacacgaccggtgctcgatttagagtatacatattgggtttgtctcctgctggtggcagctcccagatgggtcctgtcctggtgcaactgcaggagtcgggcccacgactgggtgagggccttcgggagaccctgtccctcacctgcgctcgtctctggtgcctcatcagtgtggttctcgngggctgggtccgnagctccgagggagggctaggaactacgagttggaagtgtctctnataggtggaggttcctagttacgngtccgtctctacgaagtgtcgaagtccaactagttactcctcgtgtacaccgttcagcaaacttcgtaacgttttcccgaagaacgtatggtacttcgtagttcgacccggtcncgtacggacgaccggggttatttttactacgtgtacgacggtagaacgggcgtacttagttacgtagttacgtttagggtaggtggtttaactttcgaaccgtaccgttaaggtcgtacggggtaccgggtccgtacggaccccggttggggacccgtaagggacttacggtacggtccgtaacgttcgtaccgtttacggcctaaccgaccgtaaccggggtccctacggtaccggttcccgttaccccgcgtacccctaccgtcccgaccgttaacgccgtacccg

SEQ ID NO: 141554 - DNA, 555 bp, Homo sapiens
  misc_feature: GYAE6OF02HG2PA.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctcctaatctatgctgcatccagtttgacaaaggtgggtcccagtcgaggttcagtggcaggtggatcgtgggacagtattcactctcaccatcagtatctgcacgtagaagtattttgactaacttattactgtacaacagtaattactaattgtttacggacctaagggaccacgtaactaactaaacttaaacgaacttagtacggactagacctaacctactcttcgttactttaccgtacttcccgttaccccgtacctacttctacgtaacg

SEQ ID NO: 141555 - DNA, 561 bp, Homo sapiens
  misc_feature: GYAE6OF02F8DDV.46.67.G01.1.454.CMB.1.raw
  modified_base (401)..(401): a, c, t, g, unknown or other
  misc_feature (401)..(401): n is a, c, g, or t
  modified_base (481)..(481): a, c, t, g, unknown or other
  misc_feature (481)..(481): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgaggggaagggctggaatacagttggaagttgtctctcagtagtggaggttcctattacagtccgtctctcaagagtcgagtcaccatatctctggacacgtccagcaatctacgttttcccagaagatgagttctgtcgaccgccgctgacgacgggtctttatacgtgtgcgagagacggnttattatgtatttttggagttggttatttcgactaccctagactcggacgggctccgcccgtgggccagggatcgtgtcnccgtctcctacgcctaccaccgaacggcccagtccgtccgttccccgtcggccctacccgtccctaccgacgcgtacccg

SEQ ID NO: 141556 - DNA, 637 bp, Homo sapiens
  misc_feature: GYAE6OF02HEEOK.46.67.G01.1.454.CMB.1.raw
  modified_base (281)..(281): a, c, t, g, unknown or other
  misc_feature (281)..(281): n is a, c, g, or t
  modified_base (289)..(289): a, c, t, g, unknown or other
  misc_feature (289)..(289): n is a, c, g, or t
  modified_base (340)..(340): a, c, t, g, unknown or other
  misc_feature (340)..(340): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccgcagctcccgagggaagggctggaatacagttggaagtgtctctcatagtggaggttcctattacagtccgtntctcaagngtcgagtcaccatatctctggacacgtccagcaactcacgttttccagaanagtagtagttctgtcgacccgtccgctagacacgggtcgttttaatacgtggtgcgaaggacgacggtcttaagttatgttagtttttagggagtttaggttactttacgtaactaacccgttagtaacgtcgggaaccgggggtctacccggacccggtcggggaccgaacgggtaacttacgtcgtacgtacccgttctaccgttacgacccttacccgaccgaaccgggccctagttcccggtcccgtttcccccgtacggtccctaccccgttcccaccgtacgccgtacccg

SEQ ID NO: 141557 - DNA, 560 bp, Homo sapiens
  misc_feature: GYAE6OF02GAA6R.46.67.G01.1.454.CMB.1.raw
  modified_base (432)..(432): a, c, t, g, unknown or other
  misc_feature (432)..(432): n is a, c, g, or t
  modified_base (438)..(438): a, c, t, g, unknown or other
  misc_feature (438)..(438): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagcctcccgagggaaggggctggaatacattggaagtgtctctcatagtggaggttcctattacagtccgtctctcaagagtcgagtcaaccatatctctggacacgtccagcaatctagttttcccagaatatgtagttctgtcgaccgccgctgacacgggtctttattctgtgcgagngacgtntattatgtagttttggagttgtttatttcgactacccgtagtacgtcgggacgggtctccggacccgtcggggccgaagggacgtacgtcggtctaccgtccttccgttacgcccgtacccg

SEQ ID NO: 141558 - DNA, 626 bp, Homo sapiens
  misc_feature: GYAE6OF02GIR02.46.67.G01.1.454.CMB.1.raw
  modified_base (230)..(230): a, c, t, g, unknown or other
  misc_feature (230)..(230): n is a, c, g, or t
tcagactagcagtacacgaccggtgctcgatttagagtatacatattgggtttggggagtctcggtcaggacacagcatggacatgagggtccccgctcagctcctgggggctcctgctactctggctccgaggtgccagatgtgacatcgagctgacccagtctccatcctccctgtctgcaaccggtgggagacagtgtcaccatcacttgccgggcaagtcggaacnttgacacctaatttaaatggtatcaacatagaccagggaccgcccctaagctacctaatctatgctgcatcctagtttgacaaaggtcgggtcccagtcggaggttcaggtgcagtgatcgaggacagtattcactctacaccatacagtaactctagactaacgtgtaaagttattttagacttaaactttattacgtagtactaaacgtaagtaaattaactaagtttacggttttaccggaaccgtaaacgggtaacctaacgtaaaccttaaactaaaacgtttaaaaccgtaacgttacggtacggtactacgaacctaaccgtaacttccgttacgttacccttacgtaaccgtttcccgttaccccggtacctacttacgtagtaaccg

SEQ ID NO: 141559 - DNA, 641 bp, Homo sapiens
  misc_feature: GYAE6OF02HO9DK.46.67.G01.1.454.CMB.1.raw
  modified_base (247)..(247): a, c, t, g, unknown or other
  misc_feature (247)..(247): n is a, c, g, or t
  modified_base (352)..(352): a, c, t, g, unknown or other
  misc_feature (352)..(352): n is a, c, g, or t
  modified_base (448)..(448): a, c, t, g, unknown or other
  misc_feature (448)..(448): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtcgcctccatcagtagtgttctcgtgggctgggtccgnagctcccgagggaagggctggaatacgattggaagtgtctctcatagtggaggttcctattacagttccgtctctcgagagtcagtcacatatctacgtggaacncgtccagactaaatcgtacgtttttcccgagaacgatcggtacgtttgtacggtcgtcccgccgtcgtagacgtaccggggtactttaagtttacnggttgacgagacgaggcttattagtgtaagttttggaggttagttttacgttcgtaacctacccgtaagtacgtcgtaaccgggggtcctaccgggaacccccgttgggggaccctaacgggggtaaacctaacggttcggttacccgaaccggtttacccgttaccgtttaccggtccccttaacccccggg

SEQ ID NO: 141560 - DNA, 771 bp, Homo sapiens
  misc_feature: GYAE6OF02HKL9D.46.67.G01.1.454.CMB.1.raw
  modified_base (310)..(310): a, c, t, g, unknown or other
  misc_feature (310)..(310): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcgcctccatcagtagtggtttcttcgtgggtctgggtccggcagcctccgagggagggctaggaatacagttggaagtgtctctcatgtggtaggttactattacagtccgtctctactaagtacgtcgagtccactatntctcgtacggaccacgtccagtacaacttcctacgttttccccaggtaaacgtagtacggtacgttacgtggtaccggacccggtacccgtcgtacggaaccgtaccggggtttacctttttaacgttaccggttgggttcggaaccggtaacggtagggtaacccgggtacgtttactttaagttaggtttagttttttagggtacggtttaggttttacgtttaccggtaaccgttaacccgttaggtacggttacgggaccgggggtcccttaccgggtccccggtaggggtacccgaaaggggtaacgttacgtaccggttaccgtacccgtccgttacccgttccgtacccgtacccgtaaccgtaaccgggtccctaccggttacccggttaccccttccccggtacccggtccctaaccccgttaccccgtacccgtaccggacccgtacccgg

SEQ ID NO: 141561 - DNA, 652 bp, Homo sapiens
  misc_feature: GYAE6OF02J19P4.46.67.G01.1.454.CMB.1.raw
  modified_base (297)..(297): a, c, t, g, unknown or other
  misc_feature (297)..(297): n is a, c, g, or t
  modified_base (318)..(318): a, c, t, g, unknown or other
  misc_feature (318)..(318): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactgggtgaggccttcggagaccctgtccctcacctgcgctgtctctggtgcctccatcagtagtggtttcttctggggctgggtccggcagcctccaggggaaggggctaggaatacagttggaagttgtcctctcagtaggtggtaggttcctattacagtccgtctctcaagngtcgagtccaccatactctcnggaccacgtccacgcaaattccgtaacgttttccccagaagtactggtagtttctggtacggcccgccgtcttcggaaccgtacggggtcttttaataccgtggttacgcggaaggacggtacggtcttaattacgttgtttagtttttgggagtttggtttattacgtacctacctagtcggtcggtccggggtccgtccggtacccggtcgggaccgtaggggtaactccgtggttaccctaccgtcgttaccgtacgtccctaccgaccgtaacgggcctcgtccgttcccttccccgtacgtccccacccttcctcgaccgtcgtacccg

SEQ ID NO: 141562 - DNA, 649 bp, Homo sapiens
  misc_feature: GYAE6OF02G9UYS.46.67.G01.1.454.CMB.1.raw
  modified_base (212)..(212): a, c, t, g, unknown or other
  misc_feature (212)..(212): n is a, c, g, or t
  modified_base (250)..(250): a, c, t, g, unknown or other
  misc_feature (250)..(250): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtcncctccatcagtagtggtttctcgtggggctgggtccgnagctcccgagggagggctggaatacattggaagtgtctctcatagtggaggttcctattacagtccgtctctcaagtgtcgatacacctatatctcgtggacaacgtcagctaatctacgttttcccagaatatgtacttcgtcgtcgacccgccgctacggaccgtacggggttcttttactaccgttggtacgcgaggacggtacggtacttagttagttcggttaagtttttcgggagtttggtttactttcgaacccgtaccttaacgacgttaccggggtaccgggggtcttacccgggtaaccccggttggggggaaccccgtaaggggtaacttaccggtcgggttacccgtacccggtttacgttacccgtttaccggccccttaacccgg

SEQ ID NO: 141563 - DNA, 620 bp, Homo sapiens
  misc_feature: GYAE6OF02JYA34.46.67.G01.1.454.CMB.1.raw
  modified_base (340)..(340): a, c, t, g, unknown or other
  misc_feature (340)..(340): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtgggctgggtccggcagctccgagggaagggctggaatacagttggaagtgtctctcatagtggaggttcctattacagtccgtctctacaagtagtcgagtcaccatatctctggacacgtccagcaatctagttttccagaagntgagttcgtgtacgaccgtcgcgtgacgacgggttcttttaactacgtggttcgacgtaagtacgacggtacttagttacgtggttagttttggaggtttaggttacttccggaactacccgttaggtacgttacgggacggggtcctaccggacccgtggggaccagggtaactcgtcgtcgtaccgtacgtccttacgccctaccgaccggacggtccctacgttcccggttcccttccccggtcggccctacccgttacctaccgacgacgtacccg

SEQ ID NO: 141564 - DNA, 531 bp, Homo sapiens
  misc_feature: GYAE6OF02GNHUZ.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaatggtatcaacatagaccagggacggcccctaagctcctaatctatgctgcatcctagtttgcaaagtggggtcccatcgaggttcagtggcagtggatcgtgggacagatttcactctcaccatcagtaatctgcaacgtgaagtattttgactaacttattacttgtacaacagtaaattactaattcggtttcggaccgtaaagggactaacgaactaactaaaacttaaacgaactagtgctgccaactatctgtcttacacttccttcccgtcctatctagtac

SEQ ID NO: 141565 - DNA, 617 bp, Homo sapiens
  misc_feature: GYAE6OF02IQ1ZW.46.67.G01.1.454.CMB.1.raw
  modified_base (579)..(579): a, c, t, g, unknown or other
  misc_feature (579)..(579): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtccctcacctgcgctgtctctggtgcctccatcagtagtggtttcttcgtggggctggggtccggcagcctcccgagggaggggctaggaatacagttggaagttcgtctctcatagtggaggttcctattacagttccgtctctcaagagtcgagtcaccatatctcgtggacacgttccagcaaatctacgttttccccagaagtatggtagttccgtgtcggacccgccgctcggacgtacgggtcgttttaattcgtggtgcgaggagtacggacttagttatgttagttttggagttggttatttcgactacctagacgtcggacggggctcgaccccggtgggaccgagggtactacgtcgtaccgtaccgtcctaccgttacgcctacccgacgaacggccctaggtcccgttcccttcccccgnggtcccctaccccttcccgtacccgtacgacgtacccg

SEQ ID NO: 141566 - DNA, 684 bp, Homo sapiens
  misc_feature: GYAE6OF02JWYR8.46.67.G01.1.454.CMB.1.raw
  modified_base (190)..(190): a, c, t, g, unknown or other
  misc_feature (190)..(190): n is a, c, g, or t
  modified_base (233)..(233): a, c, t, g, unknown or other
  misc_feature (233)..(233): n is a, c, g, or t
  modified_base (316)..(316): a, c, t, g, unknown or other
  misc_feature (316)..(316): n is a, c, g, or t
tcagactagcagtacacgaccggtgctcgatttagagtatacatattgggtttggggtagtctcggtcaggacacagcatggacatgagggtcccgctcagctcctggggctcctgctactctggcctcgaggtgccagatgtgacatcgagctgaccagtctccatcctcctgtctgcaaccggtgganacagtcgcaccatcacttggacccgggtacaaggttcggaacnttaggaccacttatttaaagtgtaactcaactatacgaccagggacggcccctaagctacctaactctaatgactgctatccngtttagcaaacgttgggggtcccatcggacggttcacggttaggcacggtggaacttcgtcggggaactaggtactttacacgttaccttccgaaccctagttaccgtaacgttaaactccgtcgtaacctaacggtagtaataacgtttttacaccgttaattttaaacgtactttacggttaacaaacttacggttaaacttaaactaagtttacgttttaacgaaccgtaacgggtaactaaccgtaacttaaacgttaaacgttaaacgtaacgtacgttacggacttacgtaccgaacctaccttaggtaccgtttacctaccttaacgttccctaccgtaccgttactcgttaattaacccg

SEQ ID NO: 141567 - DNA, 744 bp, Homo sapiens
  misc_feature: GYAE6OF02IF1JJ.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgaccaaccggtgggacgacagtcgtcacagtcacgttggccgggacaaggtcggaacattacgacctaccttaatttaaagttggtaataccaaactaatacgaccgtaacgggaccggcccctaagcctacctaatctaatgctgcactctagtttcgagtaaaggtcgggtaccagtcggtacggttcgaagtggacaggttacggacgtcggtacggggtaacacggttaactttccgaaccttccgtaccaaccctattacgtaacgtaaacgttccgtacggtaacctaaacgggttacgtaaagtttacgtttttacgaaccgtttaaacttttaacttaaccgttaacgtaaacctaaacggttaaacttaaacgtttaactaacgttttacggttttacccggaaccggtaaacgggtaacctaaaccggtaacttaaacgtaaaacgttaaaaccgaacgttacggtacggtactaacgaccgtaacctaagttccttagttacccgttacttaccggttacccgtcccgtaaccgttacttccgtagttaaccc

SEQ ID NO: 141568 - DNA, 613 bp, Homo sapiens
  misc_feature: GYAE6OF02H5999.46.67.G01.1.454.CMB.1.raw
  modified_base (188)..(188): a, c, t, g, unknown or other
  misc_feature (188)..(188): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcacgtgganacagtgtcaccatcacttcggccgggcaagtcggaacattgaccaccttatttaaattggtatacaacatacgaccgagggaccggcccctaagccttacctaatctatgctgctactcctagtttcgacgaaggtcgggtacccagtccggtaggttcgaggtggacgtagtaggtatcgtagggactagtactttcactctccacctatacagtaactcgtacgctaacgtcgtaaagtatttgaccttaaccgtttaattacctgtaacctaagtaagttaattaacgagtttcggtttacggaccgtaaacggtactaacgtaacttaaacgtaaaacgttaaaccgaaagttgtacgtacgtacgacgtacctacttcgtacgttctcctacgttcccgttcccgactacttcgataacg

SEQ ID NO: 141569 - DNA, 635 bp, Homo sapiens
  misc_feature: GYAE6OF02IJW9E.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagttagtggtttcttcgtggggctgggtccggcagcctccgagggaagggctaggaatacatggaagtgtctctcatagtggtagttcctattacagtccgtctctcaagagtcgagtcactatactctcgtgacaccgtcacgcaattcgtacgttttccctagagtagtgtagtttcgtgttcgacccgcgtcctaggaccgtacgggttacgttttacgttacgttggttacggacggtaggacggacggtacttatttagttacgtttagtttttagggtagtttggtttacgtttacgtacctacctagtacgtacgggtaccgggtccgtacccggtacccggtacgggaccggtaaggtacgttacggtcggttccgaccgttccgtacgttacccgtccgtaaccccg

SEQ ID NO: 141570 - DNA, 785 bp, Homo sapiens
  misc_feature: GYAE6OF02GM9E9.46.67.G01.1.454.CMB.1.raw
  modified_base (173)..(173): a, c, t, g, unknown or other
  misc_feature (173)..(173): n is a, c, g, or t
  modified_base (212)..(212): a, c, t, g, unknown or other
  misc_feature (212)..(212): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgacgtggtgaggccttcggagaccctgtccctcacctgcgctgtctctggtcncctccatcagtagtggtttcttcgtggggctgggtccgnacgcctccgaggggagggctaggaatacagttagggaagtgtctctacagttaggtggtacggttacctagttaccacggttccgtctcgtacaaggtagtcgacgtcaacctatatctctacggacacgtccagactaatctacgtttccagaatatgtagttctgtcgaccgcgtcgtacgaccgtacgggttcttttaagtacgttggtacggacggaggtacggacgtacgttaaagtttacgtaggtttaagtttttgggtacggtttaggttttaacgttttaccggaacccttaacccgttaaggtaaccggttccggggaaccgggggtacccttaccccgggtaaccccgggtcggggtacccgggaacgggtaaacctttaccgggtacgggttaccccgtaaccggtttcccgttacccgtttaaccggccccgttaaccccggaaccggtaaccggggcccccttaaccgggttcccccggtttaccccgttcccccccggttaccggtaccccgtaccccccgttacccgttaacccggaaccggtccccggtaaccccg

SEQ ID NO: 141571 - DNA, 528 bp, Homo sapiens
  misc_feature: GYAE6OF02IAUG8.46.67.G01.1.454.CMB.1.raw
  modified_base (492)..(492): a, c, t, g, unknown or other
  misc_feature (492)..(492): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattgtatcaacatagaccagggacgcccctaagctctaatctatgctgcatccagtttgacaaagtcgggtcccatcgaggttcagtgcagtggatctgggacagatttcactctcaccatcaagtatctgacaacgtagtaagtatttgactaacttattactgtacaacaataattactaattgtttacgacgtaaggacacgtactaactaaaataacgtaaatgtagctacgactaccattcgtntactttacacttcctaccccgtctacttctagtaac

SEQ ID NO: 141572 - DNA, 700 bp, Homo sapiens
  misc_feature: GYAE6OF02H7MQU.46.67.G01.1.454.CMB.1.raw
  modified_base (96)..(96): a, c, t, g, unknown or other
  misc_feature (96)..(96): n is a, c, g, or t
  modified_base (198)..(198): a, c, t, g, unknown or other
  misc_feature (198)..(198): n is a, c, g, or t
  modified_base (208)..(208): a, c, t, g, unknown or other
  misc_feature (208)..(208): n is a, c, g, or t
  modified_base (220)..(220): a, c, t, g, unknown or other
  misc_feature (220)..(220): n is a, c, g, or t
  modified_base (231)..(231): a, c, t, g, unknown or other
  misc_feature (231)..(231): n is a, c, g, or t
  modified_base (648)..(648): a, c, t, g, unknown or other
  misc_feature (648)..(648): n is a, c, g, or t
tcagactagcagtacacgaccggtgctcgatttagagtatacatattgggtttggggagtctcggtcaggacacagcatggacatgagggtccccntcagcctcctggggctcctgctactctggcctcgaggtaccagatcgtggacactcgagtctgaccccagtcctccactcctccctgtctgcaccggtgganacagtgcacntcacttgccggnaagtcggaacngtcgaactaccttaatttaacgttgtacttacaactatacgaccgaaggaccggtaccccaaggcctacctaactctacgtacgcctacgacctagtccaggtttcgacgtaaggtcgggtaccacgtacggtacggttcgtacggcggtacgtaggtcggtaacttcggtacgggtacgtagttaacgtttcacgttactaccgtaaccgtacgttaaccgtaacgttaacgttccgttaacggaaccgttaaaccgggtagtaaaaccgttatttttacggaaccttaaactttagttaccgtaacgttaacgtaaccgttaagtaaccttttaagactttacgggttacgtaaccgaaggtaccaacggtaactaaacgtaattaaacgagacgttcgacacgtacgtaccctntaccgtgtaccgttacctagttcccctaccgctactttcgaccgttataccg

SEQ ID NO: 141573 - DNA, 610 bp, Homo sapiens
  misc_feature: GYAE6OF02H8ZYE.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctggggtccggcagctcccagggaaggggctggaatacattggaagtgtctctcatagtggaggttcctattacagtccgtctctcaagagtcgagtcaccatatctctggacacgtccagcaatctaagttttcccctgaacgtatgagttctgtgaccgccgctgacacgggtcttttattactgtagcgagacgacggcttaattatgtagttttggaggttggttatttcgaacctaccgtagacgtcgggacggggcctcggaccccgtgggggcccgaagggtaacgttacgtcgggtcctaccggtcttccgttacgcccgtaccgaaccgaacgggcccctaagtcccggttaccctttcccccgtcggtacccctacccgttccctcccgaacgcgtacccg

SEQ ID NO: 141574 - DNA, 568 bp, Homo sapiens
  misc_feature: GYAE6OF02IMCGV.46.67.G01.1.454.CMB.1.raw
  modified_base (172)..(172): a, c, t, g, unknown or other
  misc_feature (172)..(172): n is a, c, g, or t
  modified_base (365)..(365): a, c, t, g, unknown or other
  misc_feature (365)..(365): n is a, c, g, or t
  modified_base (507)..(507): a, c, t, g, unknown or other
  misc_feature (507)..(507): n is a, c, g, or t
  modified_base (556)..(556): a, c, t, g, unknown or other
  misc_feature (556)..(556): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtccctcacctgcgctgtctctggtncctccatcagtagtggtttcttcgtgggctgggtccggcagctccgagggaagggctggaatacattggaagtgtctctcataggtggaggttcctattacagtccgtctctcagagtcgagtcaccatatctctggacacgtccagctaaatctagttttccccagtaagactgtagttctgtcgaccgccnctgacacgggtcgtttattacgtgtgcgagacgacggtctaattatgttagttttggaagttggttatttccgactacctagacgtcggcggggtctccgacccgtcgggacagggatacgtgtaccaccgtctccgttacncctccgaccgtacggcccagtccgtccttccccgtcgccctaccctccnccaacgctcccg

SEQ ID NO: 141575 - DNA, 615 bp, Homo sapiens
  misc_feature: GYAE6OF02HKCQM.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgccaaccgtgggagacagtgtcaccatcacttggccgggcaagtcggaacattgacacttatttaaatgtatcaacatagacaggacgccctaagctcctaatctatgctgcatcctagtttcgacaaaggtcgggtacccagtaccgtaggtttcaaggttggacgagtaggatcgtggggactagtactttcactctacacctatcaagtaatctagactaacgtagtaagtattttagactaacgttattacgtagtacaaatagtaaattactaagtttcgtttacgaaccgaagggtaccaacggtaactaagtaaaaacttaaacgaacgttaggtacggtacttacggacctaacctacttaccgttacgttacccgtttactacgtttaccccgttaccccgtaccctaatttaccgtacgttaaacg

SEQ ID NO: 141576 - DNA, 565 bp, Homo sapiens
  misc_feature: GYAE6OF02INJ0Z.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacacctatttaaatggtatcaacatagaccagggacgcccctaagctcctaatctatgctgcatccagtttgcaaagtgggtcccatcgaggttcagtggcagtggatcgtgggacagtattcactctcaccatcagtaatctagacaacgtgaaagtattttcgactaactttattacttgtacaaactaagtaatttacaatttggtttacggaccgtaaagggtacaaacgtaactaaactaaaacgttaaacgaacttaggtacgactacgacctaacctacttacttcgttactttacctacttccttacccgacctacttctagtaac

SEQ ID NO: 141577 - DNA, 587 bp, Homo sapiens
  misc_feature: GYAE6OF02G8D3U.46.67.G01.1.454.CMB.1.raw
  modified_base (209)..(209): a, c, t, g, unknown or other
  misc_feature (209)..(209): n is a, c, g, or t
  modified_base (285)..(285): a, c, t, g, unknown or other
  misc_feature (285)..(285): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccgnagctccgagggagggctggaatacattggaagtgtctctcatgtggaggttcctattacagttccgtctctcaagngtcgagtcaccatatctctggacacgtccagcaatctacgttttcccagaagtatgtagttctgtcgaccgccgctcgacgacgggtctttattacgtgtgcggagagacgtactattatgttagttttggagttgttagttcgactacctagactcggacgggtctccgcccgtcgggcgagggtactacgtcgtaccgtaccgtcgttccgttacgccctccgaaccgacgggaccctacgttccggtcccctttccccgtcggtccctaccccgttacccgtaccgacgaccgtacccg

SEQ ID NO: 141578 - DNA, 652 bp, Homo sapiens
  misc_feature: GYAE6OF02GVSTA.46.67.G01.1.454.CMB.1.raw
  modified_base (289)..(289): a, c, t, g, unknown or other
  misc_feature (289)..(289): n is a, c, g, or t
  modified_base (349)..(349): a, c, t, g, unknown or other
  misc_feature (349)..(349): n is a, c, g, or t
  modified_base (357)..(357): a, c, t, g, unknown or other
  misc_feature (357)..(357): n is a, c, g, or t
  modified_base (390)..(390): a, c, t, g, unknown or other
  misc_feature (390)..(390): n is a, c, g, or t
  modified_base (394)..(394): a, c, t, g, unknown or other
  misc_feature (394)..(394): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagaccctgtccctcacctgcgctgtctctggtgcctccatcagtagtggtttcttcgtggggctgggtccggcagctccgagggagggctggaatacattggaagttgtctctcatagtggaggttcctattacagtccgtctctcaagngtcgagtcacatatctctggacacgtccagcaatctacgttttcccagaagatgagttcngtcgaccncgctgacgcgggtctttatactgtcgcgagacncggntattagtgttagttttggagttggtttacttacggtacctacccgttagtacgtacgggtaccggggtcgtacccggtaccccggttcggggacccgtaaggggtaaccttacggtcggttacccgtacccgttccgttcccgtttaacgccccgttacccgaacccggtaaccgggcccctaacggttcccggttacccgtttcccccgtcggaccccgttacccccttaccccgtaccgaccggtaccgtaccccg

SEQ ID NO: 141579 - DNA, 784 bp, Homo sapiens
  misc_feature: GYAE6OF02G4DEU.46.67.G01.1.454.CMB.1.raw
  modified_base (218)..(218): a, c, t, g, unknown or other
  misc_feature (218)..(218): n is a, c, g, or t
  modified_base (231)..(231): a, c, t, g, unknown or other
  misc_feature (231)..(231): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttgccgggnaacggtcggaacnttgacaccttaatttaattggtatcaacatagacagggacgccctagctctaatctatgctgcactcctagtttacgacgtaaaggttcggggtacccagtaccggtaggtttcgtaggtacggcgtacggtgggtagtcggtagggaccgtaggtactttaccaacgttcctaccgtaacctaacttccgtaaggtttaaacgtccgtttacggaacctaaaccgggttaggtaaaacggtttaatttttcgggaacccttaaacgttttaacgtttaaccgttaacggtaaccgttaaactaaacggtttaaaactttaacgttaaacgggttttaccggtttttaaccggggaaacccgttaaacggggtaaacccgttaaccggtaaaccgttaaaaccgttaaaaacgttaaaaacccggttaaacggttacgggttaccggtccgttaaccgtaacccgtaaccttaacgttaccgttaacggttaactttaacccgtaccttacccggtttaccccgaaccctttaccgttaccgttagttaaccg

SEQ ID NO: 141580 - DNA, 624 bp, Homo sapiens
  misc_feature: GYAE6OF02IUSDE.46.67.G01.1.454.CMB.1.raw
  modified_base (171)..(171): a, c, t, g, unknown or other
  misc_feature (171)..(171): n is a, c, g, or t
  modified_base (364)..(364): a, c, t, g, unknown or other
  misc_feature (364)..(364): n is a, c, g, or t
  modified_base (387)..(387): a, c, t, g, unknown or other
  misc_feature (387)..(387): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttctcgtggggctgggtccggcagcctccgaggggagggctaggaatacagttggaagtgtctactcataggtggacggttcctagttacaggtccgtctctacaagagtcgagtcaccatatctcgtgacacgtcagcatctattttccagaagatgtatctgtcgaccgtccgntgactacgggtctttatacgtgngcgagacgacgtactatatgtagttttggagttgttattcgaacgtactagacgtcggtacggggtcctccgtacccggtagggtccgaagggtaactacgttacggtccgtaccggtccgttaccgttacgcccttacccgaaccgtaaccgggtccctaacggtcccggttaccccgtttcccccgacgggttacccctacccttacccggtaacccgtacgacccgtaccccgg

SEQ ID NO: 141581 - DNA, 840 bp, Homo sapiens
  misc_feature: GYAE6OF02IM8S1.46.67.G01.1.454.CMB.1.raw
  modified_base (248)..(248): a, c, t, g, unknown or other
  misc_feature (248)..(248): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtgggctgggtccgcagctccgagggagggctaggaatacagttggaagtgtctntcataggtggaggttcctattacagtccgtctctgaagagtcgagttccaccgtattactctcgtacggacctacgttccgagacctaaattcctacgtttttaccccgaggaaacgtagttaggtaacgtttcctacgggtacgtacccggtccgacgttacggaaccggtacggggttaccgtttttaacgttaacgttcggttcggacggaacggttacgggtaaccggtacgtttaaacgtttaaggttacggtttaaggtttttttacggggaaggttttacgggttttaactttaccgggaaacccttacccggttaagttaaccgggttccggggtaaccgggggtccgttacccggtaccccgggttaggggcccgtaaacggggtaacgttacccggttagggtacccgttaacccggttcccgtttaaccgttacccgtaccccgttaaccccggtaacccggtaacccggggtacccccttaacgggttttccccggttaacccccgttttccccccggtacgggtaccccttacccccccggtttacccgtaacccgtaacccggtaccgttacccccgg

SEQ ID NO: 141582 - DNA, 799 bp, Homo sapiens
  misc_feature: GYAE6OF02F2RT8.46.67.G01.1.454.CMB.1.raw
  modified_base (113)..(113): a, c, t, g, unknown or other
  misc_feature (113)..(113): n is a, c, g, or t
  modified_base (264)..(264): a, c, t, g, unknown or other
  misc_feature (264)..(264): n is a, c, g, or t
tcagactagcagtacacgaccggtgctcgatttagagtatacataagtaggggtttggggagtctcggtaacaggacaactagacgatgggaacaattggtagggtcccccgnttcaagaccttcctaggggtcgtttcctgctacgtctggcgttcccgaggtcgccagggatagttgacatcgagctgtacccagtctacctatcctccctgtctgccaaaccggtgggaacacacgtgtccaccatccgacttgccggganaaggtcggtaacgtattacggactaaccttatttaaacgttcggtatacaaacgatacgaccgtacgggacggcccctaacgactcctaatcctatacgcgtgactatcctagtttccgacgtaaacggtcgggtaccctacggttcgggtaccggttcgacgggttgacgtaggtcggaagttcggtagggactaggtaactttacgtaactttcctacctaacctaacgtctaacgttaaacgttccgtagaaccgaaacggttagtaaagttaacgttttagacccgttaaactttaagttaaccgttagttaaccgtaaactaacggtaaacttaactaagtttaggttttaaccggtaaccgttaaacgggtacctaaccggtaaccttaaaccgtaaaacgttaaacccgtaaaggtaccgttagggtaccttaaggtaaccgtaaacccgtaattccggttaagttacccgttaccgttacctttaccgttaaccccgttacctttaacgttaccgttagttaacccg

SEQ ID NO: 141583 - DNA, 546 bp, Homo sapiens
  misc_feature: GYAE6OF02GG13N.46.67.G01.1.454.CMB.1.raw
  modified_base (197)..(197): a, c, t, g, unknown or other
  misc_feature (197)..(197): n is a, c, g, or t
  modified_base (218)..(218): a, c, t, g, unknown or other
  misc_feature (218)..(218): n is a, c, g, or t
  modified_base (250)..(250): a, c, t, g, unknown or other
  misc_feature (250)..(250): n is a, c, g, or t
  modified_base (253)..(253): a, c, t, g, unknown or other
  misc_feature (253)..(253): n is a, c, g, or t
  modified_base (542)..(542): a, c, t, g, unknown or other
  misc_feature (542)..(542): n is a, c, g, or t
tcagactagcagtacacgaccggtgctcgatttagagtatacatagtttggggtttggggagtctcggtcaggacacagcatcggacatgagggtaccccgctcagctcctggggctccttgctactctggctcgagtgccagatgtgacatcgagctgacccagtctcatcctccctgtctgcaaccgtggagacngtgtcaccatcacttgccggnaagtcgacattgacactattaatgtatcaacntanaccagggacgccctagctctaatctatgctgcagtccgagtttgactaaagtcgggtacccagtacgaggttcagtgcaggtgatctagggacagtacttcactctcactatcagtaactcgtcgactaacgtagaagtatttcgtacttaacttattactagtacaacagtaacttacaattgttttacggaccgtaagggtacacgtactaactaaacttaaacgaacgtgtacgtctcgacaacctacttacgtacttcttactacttccgttcccgcctactctntacg

SEQ ID NO: 141584 - DNA, 745 bp, Homo sapiens
  misc_feature: GYAE6OF02JOZKS.46.67.G01.1.454.CMB.1.raw
  modified_base (191)..(191): a, c, t, g, unknown or other
  misc_feature (191)..(191): n is a, c, g, or t
  modified_base (319)..(319): a, c, t, g, unknown or other
  misc_feature (319)..(319): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgganacagtgtcacatctacttcggccggacaacggtacggaactagttacgaacctaaccttaaattttaaagttgtaatacaaactagtaacgaccgagggacccgtaccctaagccttacctaatctancgtctcgactactccgtagtttacgacgtaaagggtccgggtacccagttcggtaggttacagggtcggactagggtaggtacttcggtacgggaactaggttactttccgacctttcgacctaaccgtacttacgtaacgtaattcgtacgtacctaaaggtagtaaagttacttttacgaaccttaacgtttaacttaccgttagtaaacctaaacgttaacgttaaaactttaactaaacggttttcggttttaacccgggtaacggtaaaccgggtaaaccgtaccggtaaaacttaaacgttaaaaacggtttaaaaccgaaacgttgggttaacggcttaacgtaccgtaacgtaacgttccttacggttaccttaactcgtttaccccggacccgttactaacgttacgtacttaaccg

SEQ ID NO: 141585 - DNA, 598 bp, Homo sapiens
  misc_feature: GYAE6OF02H42W5.46.67.G01.1.454.CMB.1.raw
  modified_base (217)..(217): a, c, t, g, unknown or other
  misc_feature (217)..(217): n is a, c, g, or t
  modified_base (301)..(301): a, c, t, g, unknown or other
  misc_feature (301)..(301): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacactatttaaatggtatcaacatagacagggacgccctaagctctaatctatgctgctatcctagtttncgaaaggtgggtccagtcgaggttcagtgcagtgatcgtagggactagtactttcgactactcaaccattacagttaatctacgactaacgtagtaaagtatttcgacttaattacttactagttacaaactaataattactaacgttggttttaccggacgtaacgggaactaacgtaaccttaaacgaaaacttaaaacgaacgttacgtacggtactacgtacctaccgtaattctacggttttaccttacgtacctttacccgttcccccgacttaccttccgttagtaaccg

SEQ ID NO: 141586 - DNA, 541 bp, Homo sapiens
  misc_feature: GYAE6OF02F849O.46.67.G01.1.454.CMB.1.raw
  modified_base (365)..(365): a, c, t, g, unknown or other
  misc_feature (365)..(365): n is a, c, g, or t
  modified_base (536)..(536): a, c, t, g, unknown or other
  misc_feature (536)..(536): n is a, c, g, or t
tcagactagcagtacacgaccggtgctcgatttagagtatacatattgggtttggggagtctcggtcaggacacagcatggacatgagggtccccgctcagctcctgggggctcctgctactctggctccgaggtgccagatgtgacatcgagctgacccagtctccatcctccctgtctgcaaccgtgggagacagtgtcaccatcacttgccgggcaagtcggaacattgacaccttatttaaattggtatcaacatagaccagggacgcccctaagctctaatctatgctgcatccagtttgcaaagtcggggtcccagtcgaggttcagtggcagtggatcgtgggacagtattcacttcncacatcagtactctgacaagtagaagtattttgactaacttattacttgtacaatagtaaattactaattgtttaccgacgtagggaactacgaactaaactaaataaacgtaacgtgtagactgacctactattctcgttccttactacttccttcccgactacttcgtntaacc

SEQ ID NO: 141587 - DNA, 558 bp, Homo sapiens
  misc_feature: GYAE6OF02FKR1M.46.67.G01.1.454.CMB.1.raw
  modified_base (213)..(213): a, c, t, g, unknown or other
  misc_feature (213)..(213): n is a, c, g, or t
  modified_base (330)..(330): a, c, t, g, unknown or other
  misc_feature (330)..(330): n is a, c, g, or t
  modified_base (378)..(378): a, c, t, g, unknown or other
  misc_feature (378)..(378): n is a, c, g, or t
  modified_base (433)..(433): a, c, t, g, unknown or other
  misc_feature (433)..(433): n is a, c, g, or t
  modified_base (438)..(438): a, c, t, g, unknown or other
  misc_feature (438)..(438): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggcctttcggagaccctgtcccctcacctgcgctgtctctggtncctccatcagtagtggtttctcgtggggctgggtccgcagcctccgagggaagggctggaatacattggaagtgtctcgtcatagtggaggttcctattacagtccgtctctcaagngtcgagtcaccatactctctggacacgtccagcaatcacgttttcccngaacgatgagtttctgtcgaccgccgctgacacgggtctttattactgtgcgagngacgntattatgtattttggagttggtttatttcgaactacctagacgtcgacggggctccggtacccgtcggggccgaagggtaacttacgtcggtacacccgtctccgttacgccctaccccg

SEQ ID NO: 141588 - DNA, 550 bp, Homo sapiens
  misc_feature: GYAE6OF02FWNPW.46.67.G01.1.454.CMB.1.raw
  modified_base (385)..(385): a, c, t, g, unknown or other
  misc_feature (385)..(385): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgccccctaagctacctaatctatgctgcatccagtttgcaaaggtcgggtcccatcgaggttcagtggacagtggatcgtgggactagtactttacactctacacctatcaatatcngacaagtataagtatttcgactaacttattacttagtacaactagtaaattactaattcgtttacgaccgtaacggacaacgtactaactaaactaaacgaatagtgtactgtaccaactatactcgttacttctacttacgttccccgactattacctagtaac

SEQ ID NO: 141589 - DNA, 590 bp, Homo sapiens
  misc_feature: GYAE6OF02JHD4A.46.67.G01.1.454.CMB.1.raw
  modified_base (412)..(412): a, c, t, g, unknown or other
  misc_feature (412)..(412): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggagacagtgtcaccatcacttgccgggcaagtcggaacattgacacctatttaaattggtatcaacatagaccagggacgcccctaagctacctaatctatgctgcatccagtttgactaaaggtcgggtcccagtcgaggttcagtggcagtgatcgtgggacagtatttcacttctcaccatcagtatctgacaacgtgaatatttgactaacttattactntacaactagtaattactaagttcgtttacggactaagggtaccaacgtaacttaaaccaaaacgtttaaaccgaacgttacgtacggtacgttagacccgtaaccttaacttccgttacgttacctttaacctacgtttaccctttaccccggacccttacgttccgttagttaaccg

SEQ ID NO: 141590 - DNA, 690 bp, Homo sapiens
  misc_feature: GYAE6OF02JQVK3.46.67.G01.1.454.CMB.1.raw
  modified_base (141)..(141): a, c, t, g, unknown or other
  misc_feature (141)..(141): n is a, c, g, or t
  modified_base (169)..(169): a, c, t, g, unknown or other
  misc_feature (169)..(169): n is a, c, g, or t
  modified_base (187)..(187): a, c, t, g, unknown or other
  misc_feature (187)..(187): n is a, c, g, or t
  modified_base (198)..(198): a, c, t, g, unknown or other
  misc_feature (198)..(198): n is a, c, g, or t
  modified_base (223)..(223): a, c, t, g, unknown or other
  misc_feature (223)..(223): n is a, c, g, or t
  modified_base (289)..(289): a, c, t, g, unknown or other
  misc_feature (289)..(289): n is a, c, g, or t
tcagactagcagtacacgaccggtgctcgatttagagtatacatattgggtttggggagtctcggtcgtaggacacagcatggacatgagggtcccgctcagctcctggggctcctgctactctgctcgagtgccagatgngacatcgagctgacccagtctccatccncctgctgcaccgtggacncagtgtccacntccattgccgggacaagtcggaacntgacactattaaagtgtatacaacatacgacctagggacgacccctaagcctactaatactatgcngtacactcctaagttcgaacgtaacggtacgggtccccaagtacccggtagttaccgaaggtccggtactacgggtaggtacgttacggttgggaaccgagttaccgtttaccaacgtttaccgccaacccttagtaccaacgttaacgtccgttacgacgtaaccggttagtaaacggtattttaacggacttaaaccggttattacgttacgttactaacctaagtaacgttaataacgttagtttacccgtaacgtaacggtacgtaaccgtaactttaaaccgtaaagttaaaccgaaaacgttcggttagtaccgttcgtaacggtaacccctaagttaccgtacggttaccctttacgaaccgttacctaccccgtacgtactcgtaaccttaac

SEQ ID NO: 141591 - DNA, 515 bp, Homo sapiens
  misc_feature: GYAE6OF02IJ35K.46.67.G01.1.454.CMB.1.raw
  modified_base (193)..(193): a, c, t, g, unknown or other
  misc_feature (193)..(193): n is a, c, g, or t
  modified_base (478)..(478): a, c, t, g, unknown or other
  misc_feature (478)..(478): n is a, c, g, or t
  modified_base (493)..(493): a, c, t, g, unknown or other
  misc_feature (493)..(493): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacagtcgagctgacccagtctccatcctccctgtctgcaaccgtggganacagtgtcaccatcacttgccgggcaagtcggaacattgacactatttaatgtatcaacatagaccagggacgcccctaagctcctaatctatgctgcatccagtttgactaaaggtgggtcccatcgaggttcagtggcagtgatcgtgggacagtatttcactctcaccattcagtaatctgacaacgtgaagtatttgactaactttattactgtacaacagtaattacaattcgtttacgacgtaaggacaacgtactaactaaattaacgaactgtgctnacacatctgttcttnacttcctcccgctattctatac

SEQ ID NO: 141592 - DNA, 672 bp, Homo sapiens
  misc_feature: GYAE6OF02H606P.46.67.G01.1.454.CMB.1.raw
  modified_base (313)..(313): a, c, t, g, unknown or other
  misc_feature (313)..(313): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggccttcggacgaccctgtccctcacctgcgctgtctctggtcgcctccatcagttagtggtttcttcgtgggctgggtccgcagctccgagggagggctaggatacagttggaagtgtctctcatagtggtacggttcctattacagtccgtctctcaagacgtcgacgtcaccatatctcnggacacgtccagcaatctacgttttccagaagatgtagttctgtcgaccgcgtctgaccgacgggttcttttattacgtgtcgcggagaggtaccggtactttaattagttagtttagtttttgggaggtttggttttactttaccgacctacccgtagtacgtccgggacggggtcctacccggaccccggttggggacccgaaggggtaacttacgttacgggttaccctaccgttaccttccgttaccgtcccttacccgaaccggtaaccgggtcccctaacggttcccggttaccccttaccccccgttgggtacccctacccccgttaccctacccgaacgtccgtaaccccg

SEQ ID NO: 141593 - DNA, 724 bp, Homo sapiens
  misc_feature: GYAE6OF02J3AX8.46.67.G01.1.454.CMB.1.raw
  modified_base (137)..(137): a, c, t, g, unknown or other
  misc_feature (137)..(137): n is a, c, g, or t
  modified_base (599)..(599): a, c, t, g, unknown or other
  misc_feature (599)..(599): n is a, c, g, or t
tcagactagcagtacacgaccggtgctcgatttagagtatacatattgggtttgggggacctcctgtgcaagaacatgaagcacctgtggtttgtcctcctgctggtggcagctccagatgggtcctgtccctggtncaactgcaggagtccggccctacgtactgggtgacggtcccttggacgtaccccttgtccctcaccgttgccgtcttgtctcgtcggtctcctaccgattcaggttacgttcggtttctacggtgggggtcttacggggtccgactacgtcccgttaccggaaggggtaacggggtctaggtaacgtacgtaggttacggtaacgttcgtaccttcgtacgtagttaggtacggtacgttacctacgttaacgtcgtaccgtctcgacgtacgtacgtcgtacgtcacctatactctcgtacgacctacgtcacgactacgtacgtaccgtttaccgaagtacggtaattcggtaacgtttcgtccgtacggtcccgtccgtaccggtagttaacccggtaggtttacgtttactacggtaggtcgtaggtaacggtactacgttacttagtttaacggttnttacggtttcggtaacttagtttacctcgactaccgagtcgacgggtaccggtctaaccggccggtcggtaaccgtaggtacgttcgtacgtaccgtccttacggtaccctcgtacccgtaaccg

SEQ ID NO: 141594 - DNA, 608 bp, Homo sapiens
  misc_feature: GYAE6OF02JF50C.46.67.G01.1.454.CMB.1.raw
  modified_base (328)..(328): a, c, t, g, unknown or other
  misc_feature (328)..(328): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtgtttctcgtggggctgggtccggcagctcccgagggaagggctggaatacattggaagtgtctctcatagtggaggttcctattacgagtccgtctctcaagngtcgagtcaccatatctctggacacgtccagcaatctacgttttccctagtaacgtatgtaagttcgttcgtcgacctccgggggctcgacgacgggtcgtttacttactgtgcgagagacgtctagttagtgttagttttggtagttggtttacgtttacgtactaccgttagtacgttcggtacggggtccgtaccggtaccccggtcggggccgtacgggtaacgttacggtcggttaccgtacccggttccgttacccgttaccgtcccgtacccg

SEQ ID NO: 141595 - DNA, 577 bp, Homo sapiens
  misc_feature: GYAE6OF02JBVBJ.46.67.G01.1.454.CMB.1.raw
  modified_base (274)..(274): a, c, t, g, unknown or other
  misc_feature (274)..(274): n is a, c, g, or t
  modified_base (314)..(314): a, c, t, g, unknown or other
  misc_feature (314)..(314): n is a, c, g, or t
  modified_base (320)..(320): a, c, t, g, unknown or other
  misc_feature (320)..(320): n is a, c, g, or t
  modified_base (400)..(400): a, c, t, g, unknown or other
  misc_feature (400)..(400): n is a, c, g, or t
  modified_base (412)..(412): a, c, t, g, unknown or other
  misc_feature (412)..(412): n is a, c, g, or t
  modified_base (490)..(490): a, c, t, g, unknown or other
  misc_feature (490)..(490): n is a, c, g, or t
  modified_base (507)..(507): a, c, t, g, unknown or other
  misc_feature (507)..(507): n is a, c, g, or t
  modified_base (546)..(546): a, c, t, g, unknown or other
  misc_feature (546)..(546): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcgacctgcgctgtctctggtgcctcatcagtagtggtttcttcgtggggctgggtccggcagcctcccgagggagggctggaatacagttggaagttgtctctcatagtggagttcctattanacccccgtcgtctctacaagagtcgacgtcaccatatctntggacncgtccagcaactctacgttttccagaagtatgtacgttctgtcgaccgcgtctgaacgacgggtctttattacgtgtcgngagacgtcggtnttagtatgttagttttggagttggttattcgaactacctagcgtcggcgggctccggaccctgggaccaggtactcgngtcaccgtctcgttacnccttaccacggacggtccacgttccggtcccttccccgngacccgtacccctccgtaccaagcccgtacc

SEQ ID NO: 141596 - DNA, 550 bp, Homo sapiens
  misc_feature: GYAE6OF02IB3AA.46.67.G01.1.454.CMB.1.raw
  modified_base (192)..(192): a, c, t, g, unknown or other
  misc_feature (192)..(192): n is a, c, g, or t
  modified_base (217)..(217): a, c, t, g, unknown or other
  misc_feature (217)..(217): n is a, c, g, or t
  modified_base (339)..(339): a, c, t, g, unknown or other
  misc_feature (339)..(339): n is a, c, g, or t
  modified_base (417)..(417): a, c, t, g, unknown or other
  misc_feature (417)..(417): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggnaagtcggaacattgacactatttaaatgtatacaacatagacgaggacgcccctaagctacctaatctatgctgcatccagtttgcaaagtgggtacccatcgagttcgagtggcagtggancgtgggacagtattcactctcacatcagtaatctagtcaaacgtgtaaatattttgactaacttattactgtaccaanaagtaacttacaattgtttcgaacaagggaacacgaactaaactaaaattaaacgaaactgtacggcttacgactaaccaattcgtacttacgttacctacgttacccttaccccgaccaattccgtataacg

SEQ ID NO: 141597 - DNA, 525 bp, Homo sapiens
  misc_feature: GYAE6OF02G17LM.46.67.G01.1.454.CMB.1.raw
  modified_base (514)..(514): a, c, t, g, unknown or other
  misc_feature (514)..(514): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctcctaatctatgctgcatccagtttgacaaagtgggtcccatcgaggttcagtggcagtggatcgtgggacagtatttcacttctcaccatcagtaatctgacaacgtgaagtatttgactaacttattacttgtacaacagtaattacaattgtttacggacctaagggacaacgtactaacaaattaaacgaacttgtaggctagactaccattctgtcttcacttccttcccnctactctatac

SEQ ID NO: 141598 - DNA, 599 bp, Homo sapiens
  misc_feature: GYAE6OF02GA1UP.46.67.G01.1.454.CMB.1.raw
  modified_base (384)..(384): a, c, t, g, unknown or other
  misc_feature (384)..(384): n is a, c, g, or t
tcagactagcagtacacgaccggtgctcgatttagagtatacatattgggtttgtcctcctgctggtggcagctcccagatgggtcctgtccctggtgcaactgcaggagtcggcccacgactggtgaggccttcggagaccctgtccctcacctgcgctgtctctggtgcctccatcagtagtggtttcttctgggctgggtccgcagctccagggagggctggaatcattggaagtgtctctcatagtggaggttcctattacagtccgttctctcaagagtcgagtcacatatctctggacacgtcagcaatcagttttcccagaacgattgattctgtcgaccgcgctgacacggtcgttatactgtgcgtagagacgtntatatgtacgttttggagttggttattcgactacccgtagacgtcggacggggtctacgaccccggttgggaccgtaaggggtaactacgttacggttccaaccggttccttaccgttaaccgtcctacccgtaaccgtaaccggccctaacggttccgtacccgttcccccgtcgtcccgtaaccccgtccctacccgaacgtaccgtaacccg

SEQ ID NO: 141599 - DNA, 552 bp, Homo sapiens
  misc_feature: GYAE6OF02HLG08.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccaggacgcccctaagctcctaatctatgctgcatccagtttgcaaagtgggtcccagtcgagttcagtggcagtgatctgggacagtatttcactctacacatcagtaatctgcaacgtgaagtattttagactaacttatacttgtacaactagtaattacaagttcgtttacgggacctaagggacaacggtaactaaacgtaaaattaaacgaactagtagactagtaccaacctaacttcgtagttccttactactttaccttaccccgtactacttccgtagtaacg

SEQ ID NO: 141600 - DNA, 655 bp, Homo sapiens
  misc_feature: GYAE6OF02JAZIL.46.67.G01.1.454.CMB.1.raw
  modified_base (328)..(328): a, c, t, g, unknown or other
  misc_feature (328)..(328): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctcatcagtagtggtttctcgtggggctgggtccgcagcctccgagggagggctggaatacgattggaagtgtctctcatagtgggacgttcctattacacgtccgtctctcaagngtcgagtcacctatatctcgtggaccacgtccagctaactctacgttttcccagaagtattcgagtttcgtggtacgacccgtccgtctacggaaccgtacgggttacttttaagttaccgtggtcggtacggaaggtaacgggtacggtactttaaagtttagttcggtttaagttttttgggaagttttagggttttactttccgaactacccgttaagacgttcgggacgggggtcctccgggaaccccggtggggacccgtaaggggtaacttcggttacggtccgtacccggttaccgtccgttaccgtccccgtaacccgg

SEQ ID NO: 141601 - DNA, 603 bp, Homo sapiens
  misc_feature: GYAE6OF02H4XBE.46.67.G01.1.454.CMB.1.raw
  modified_base (229)..(229): a, c, t, g, unknown or other
  misc_feature (229)..(229): n is a, c, g, or t
  modified_base (310)..(310): a, c, t, g, unknown or other
  misc_feature (310)..(310): n is a, c, g, or t
  modified_base (441)..(441): a, c, t, g, unknown or other
  misc_feature (441)..(441): n is a, c, g, or t
  modified_base (584)..(584): a, c, t, g, unknown or other
  misc_feature (584)..(584): n is a, c, g, or t
tcagactagcagtacacgaccggtgctcgatttagagtatacatattgggtttggggagtctcggtcaggacacagcatggacatggacgggtccccgctcagcctccgtggggctcctgctactctggctccggaggtgccagatgtgacatcgagctcgacccagtctccatccctccctgtctgacaaccggtgggagacagtgtcaccatcacttggcccggganaaggtcggaacattgacctacttaatttaaattggtatacaacaatagaccgagggaccgaccctaagctacctaatctancgtctgctactcctagtttgacgtaaagggtcgggtaccctatcggtaggttcgaagtcggcgaagtcgggatcggtagggaactagtactttcactctacacatactaagtatctgacaacgtgaaagtntttcgactaatttacttatgtacaaactagtaattacagtttgttaccgacgaaggacaacgtaactaaataaattaaaacgattggagcttacgacctaactacttcttacgttaccttacgttacttacccggttaccccncttaacttccgtagtaacc

SEQ ID NO: 141602 - DNA, 605 bp, Homo sapiens
  misc_feature: GYAE6OF02HPBQG.46.67.G01.1.454.CMB.1.raw
  modified_base (247)..(247): a, c, t, g, unknown or other
  misc_feature (247)..(247): n is a, c, g, or t
  modified_base (325)..(325): a, c, t, g, unknown or other
  misc_feature (325)..(325): n is a, c, g, or t
  modified_base (379)..(379): a, c, t, g, unknown or other
  misc_feature (379)..(379): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtgtttctctggggctgggtccgnagctccgagggaagggctggaatacgattggaagtgtctctcatagtggaggttcctattacagtccgtctctcaagngtcgagtcaccatatctctaggacacgtccagcaatctagttttcccagaagtntgtacgttctgtcgaccgcgctgacgtacgggtctttaattacgtgttgcgagacgacgcttattatgttattttggtagtttggtttactttcgactacccgtagtacgtcgggtaccggggtccttacccgggaccccggtcggggtacccgtaacgggtaacgttacggtacgggttacccgtaccggtttcccgttacccgtttaccggcccctaaccccgg

SEQ ID NO: 141603 - DNA, 568 bp, Homo sapiens
  misc_feature: GYAE6OF02GH1FY.46.67.G01.1.454.CMB.1.raw
  modified_base (334)..(334): a, c, t, g, unknown or other
  misc_feature (334)..(334): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttcccngaagtatgagttctgtgaccgccgctgacgacgggtcgttttattactgtgcgagagacggctattatgtattttggagttggttatttcgactacctagcgtcggacgggctccgacccgtgggccgagggactacgtcggtcaccgtctaccgttacgcctaccgaccgaacggccctacgtccggttcccttccccgtcggcctaccccttcctcccgtacgacgtacccg

SEQ ID NO: 141604 - DNA, 558 bp, Homo sapiens
  misc_feature: GYAE6OF02HQABE.46.67.G01.1.454.CMB.1.raw
  modified_base (252)..(252): a, c, t, g, unknown or other
  misc_feature (252)..(252): n is a, c, g, or t
  modified_base (392)..(392): a, c, t, g, unknown or other
  misc_feature (392)..(392): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaatgtatcaanatagaccagggacggcccctaagctcctaatctatgctgcatccagtttgacaagtcgggtcccatcgaggttcagtgctagtggatgtgggacagtactttcacttctacaccatcaagtaatctgacaacgtgaagtnttttgacctaacttattactactacaactagaaacttactaatttcggtttaccggacgtaaggacaacgtaactaaacgtaaattaaacgaacttgtagtactacgactaaccacttcttcgttaccttacctacttccttaccccgacctacctagtacttacg

SEQ ID NO: 141605 - DNA, 610 bp, Homo sapiens
  misc_feature: GYAE6OF02IQA9L.46.67.G01.1.454.CMB.1.raw
  modified_base (193)..(193): a, c, t, g, unknown or other
  misc_feature (193)..(193): n is a, c, g, or t
  modified_base (230)..(230): a, c, t, g, unknown or other
  misc_feature (230)..(230): n is a, c, g, or t
  modified_base (257)..(257): a, c, t, g, unknown or other
  misc_feature (257)..(257): n is a, c, g, or t
  modified_base (355)..(355): a, c, t, g, unknown or other
  misc_feature (355)..(355): n is a, c, g, or t
  modified_base (359)..(359): a, c, t, g, unknown or other
  misc_feature (359)..(359): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccgtggganacagtgtcaccatcacttgccgggacaagtcggaacnttgacacctatttaaagttgtatcaanatagtacagggacgcccctaagctcctaatctactgctgcatcctagtttgacaaaggtcgggtacctagtcgtaaggttcagtggacagtggatcgngganagtattcactctcaccatacagtaatctagactaacgtgtaagtatttagtactaactttattaacgttgtaacctaaagaacgttaaacttactaaagtttcggttttaccggtaaccgtaaacgggtactaaacggtaaccttaaacgttaaaacttaaacgaaccgtagttaccgacgttacggaacctaccgaattccgttagttaccttaacgacttcccgtccgtaccctagtaccgtacgtaac

SEQ ID NO: 141606 - DNA, 525 bp, Homo sapiens
  misc_feature: GYAE6OF02F3A97.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctacctaatctatgctgcatcctagtttgcaaagtgggtcccatcgaggttcagtgcagtggatcgtgggacagtattcactctcaccatcagtaatctgacacgtgaatatttgactaacttattactgtacaacagtaattacaattgtttcgacgaaggactaacgactaacaaattaaacgaactgtagctagctaacctatctagtccttacgacttccgttaccccgacctactctagtac

SEQ ID NO: 141607 - DNA, 792 bp, Homo sapiens
  misc_feature: GYAE6OF02HBI15.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggacattgacacctatttaaatggtatcacatagacagggacgccctaagctctaatctatgctgcatcctagtttcgacgtaaaacggttcggggtacccctaagtccggtagggtttacgaacgggttgggacctagggttacgggtacgttccggtagggggtaactaaggtaacttttaccgaaccgtttacccgtacctaaaccctaacgtttacctaaacggtttaaacttccgttacggtaaccgttaaaccgggttaggtaaaaccggtttaagttttttacgggaaccttaaaaccgtttttaacgtttaacccgtttaggttaacccttaaaaccgttaagttaaacttttaaacgtaaacgttttacggtttttaacccggggtaaacccgtaaacgggggtaccctaaaccggtaaaccctttaaaaacgttaaaacgtttaaaaaccggtaaacgttacggttaacggtaccgtacggtaccctaaccgtaactttccgttacgttacctttacgtactttcccttaccccgtacgtactttaccgtaagttaaccg

SEQ ID NO: 141608 - DNA, 632 bp, Homo sapiens
  misc_feature: GYAE6OF02HW204.46.67.G01.1.454.CMB.1.raw
  modified_base (252)..(252): a, c, t, g, unknown or other
  misc_feature (252)..(252): n is a, c, g, or t
  modified_base (335)..(335): a, c, t, g, unknown or other
  misc_feature (335)..(335): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggcctttcggagaccctgtccctcacctgcgctgtctctggtgcctccatcagtagtggtttctctggggctgggtccggcagcctcccgagggaagggctggaatacagttggaagtgtctntcatagtggaggttcctattacagtccgtctctcaagagtcgagtcaccatatctctggacacgtcagcaatcagttttcccngaacgatgattctgtgaccgccgctgactacgggtctttattactgtcgcgagagacggcttattatgtattttggagttgttatttcgactaccctagtacgtcggacggggcctacggaccccgttggggcccgtaagggaacgttaccgttcgggtaccgaccgttccgttacctttaacggcccttacccgaacccgaaccggggtcccctaacgttcccgggttacccctttccccccggtcggtaccccgtacccccgttccccgttaacccgacggtaccgtaaccccgg

SEQ ID NO: 141609 - DNA, 616 bp, Homo sapiens
  misc_feature: GYAE6OF02H4ZXW.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaattgtatcaacatagaccagggacgccctaagctacctaatctatgctgcatcctagtttagacaaacggttcggggtacccagtcggtaggttcaggtggcgagtggatcgtagggactaggtatttcgactctaccactatcagtaatctagactaaacgtgtaagtagtttgactaattattactgttacaaactaagtaaacttataacgttacggtttaccgaaccgtaacgggtaacctaacggtaacttaaactaaaacgttaaacgaaacgttgtacgtacgttacggacctaaccgtaacttcgtacgtttacctacgtaccgttacccgttaccccggtaccctacgttccgttacgtaaaccg

SEQ ID NO: 141610 - DNA, 733 bp, Homo sapiens
  misc_feature: GYAE6OF02GS7TF.46.67.G01.1.454.CMB.1.raw
  modified_base (209)..(209): a, c, t, g, unknown or other
  misc_feature (209)..(209): n is a, c, g, or t
  modified_base (233)..(233): a, c, t, g, unknown or other
  misc_feature (233)..(233): n is a, c, g, or t
tcagactagcagtacacgaccggtgctcgatttagagtatacatattgggtttgggggacctcctgtgcaagaacatgaagcacctgtggtttgtcctcctgctggtggcagctccagatgggtcctgtccctggtgcaactgcaggagtcgggcccagactggtgaggccttggagaccctgtccctcacctgcgctgtctctggtcncctcatcagtagttggtttctcgnggggcttgggtccggcagccgtcccgaaggggaggggtctaggaactacagtttggaagtggtctctcagtagtggtaggttcctattacacgtccgtctctacgaagagttcgagttaccaactattaatcctagtcggaactacgtacccaggtaccaattaccgtacgtttttacccctaggaaaagtcttaggaaccgttttcgtacggttacggaaccccggtccgtacgtttaggaacccggttaacggggttacttttaagttaaccgttggttacggacgacggtaaccgacggttcgtttaaatttaaggttagttagttttttaaggggagttttaacggtttacgttttaccgaacctaaccggtttaagagttcccgggggtacggtccgtacccgggttaacccgggtgggtacccggaacggtaacgtttaccggtacggttacccgaccgtttaccgttacccgtttacggacccctaaccccgg

SEQ ID NO: 141611 - DNA, 593 bp, Homo sapiens
  misc_feature: GYAE6OF02FQ1QK.46.67.G01.1.454.CMB.1.raw
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatccctccctgtctgcaaccgtgggagacagtgtcaccatcacttgccgggcaagtcggaacattgacacctaatttaaattgtatacaacatagaccgaggacggcccctaagctcctaatctatgctgcatccagtttgacgtaaaggtcggggtacccagtcggtaggtttacaggtggctaggtggactcgtgggacagtattcactctcacatcatatctgcgagtgaattatttacgtaactttattactagttacaactagtaaacttactaatttacgtttaccggacgtaagggtaccaacgtaactaaactaaaagttaaaccgaacgttaggtacggtactaggaccctaacgtacttcgttacgttacccttactacttcccgtttacccgacctacttctacggtattaaccg

SEQ ID NO: 141612 - DNA, 572 bp, Homo sapiens
  misc_feature: GYAE6OF02G7CJ8.46.67.G01.1.454.CMB.1.raw
  modified_base (331)..(331): a, c, t, g, unknown or other
  misc_feature (331)..(331): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccgcagctccagggagggctggaatcattggaagtgtctctcatagtggaggttcctattacagtccgtctctcaagagtcgagtcaccatatctctggacacgtccagcaaatctagttttcccngaagatgagttctgtcgacccgcgctgacgacgggtcgttttaattactgtgcgagagacggctattatgtatttttggagttgttattcgactaccctagactcggacggggctcggacccgtggggccagggatacgtgtcaccgtctcctagcctccaccgaacgggccctagttcccggtaccctttcccccgtcggtaccctacccccgttccctacccgaacggtaccgtacccg

SEQ ID NO: 141613 - DNA, 678 bp, Homo sapiens
  misc_feature: GYAE6OF02G5LR2.46.67.G01.1.454.CMB.1.raw
  modified_base (332)..(332): a, c, t, g, unknown or other
  misc_feature (332)..(332): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccgcagctcccgagggaaggggctgggaatacagttggaagtgtctctcatagtggtaggttcctattacagtccgtctctcaagngtcgagtcaccatatctctggacacgtccagacaagtctaacgttttcccagaacgtattgtacgtttcgtggttacggacccgcccgtctggaaccgtacggggttaccgttttatttaccgttggttcggtcggtaagaacggtacgggtactttaagtttagttggtttaacgttttttgggaaggttttcggtttaacgttttccggaaccgtacccgttaagtacgtaccggtaccgggggtcctacccggtacccccggttcggggtaccgaacggggtaacgttacggtccggttaccgtacccggttcccgttaccgttaccggcccgttaaccccgg

SEQ ID NO: 141614 - DNA, 697 bp, Homo sapiens
  misc_feature: GYAE6OF02IGNN7.46.67.G01.1.454.CMB.1.raw
  modified_base (173)..(173): a, c, t, g, unknown or other
  misc_feature (173)..(173): n is a, c, g, or t
  modified_base (210)..(211): a, c, t, g, unknown or other
  misc_feature (210)..(211): n is a, c, g, or t
  modified_base (215)..(215): a, c, t, g, unknown or other
  misc_feature (215)..(215): n is a, c, g, or t
  modified_base (234)..(234): a, c, t, g, unknown or other
  misc_feature (234)..(234): n is a, c, g, or t
  modified_base (247)..(247): a, c, t, g, unknown or other
  misc_feature (247)..(247): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgagggccttcggagactctgtccctcacctgcgctgtctctggtcncctccatcagtagtggtttctcgtgggctgggtccgnngccnccgagggaggctagaatanagttggagtcgtntctgagtgtggtacgttcctaattacgtagtccgtctcgtacgaagtcgtcgagtaccaactatacgtctagtggacctacggtcagactaacttcgttcgtttaccagtaagtacgtggttactcggtagtaccgacccggtccgatacggaccggttacgggtttacgtttactgtcggtacggacggtacgaagggtaccgtctttaaagttagttagttttaggttttagggtacggtttaggtttacgttaccggtaaccttaccgttaggtacgtaccggggccgggtacccgtcccgggtacccgggtacgggaacggtaacgggttaattcccggtcggtaccgttacccgtcttaccgtactaccccgtaccgaacgtaaccggtcctaaccgtttcgtccccgttcccgtacggcccctacccgtcctaccgacgtcccg

SEQ ID NO: 141615 - DNA, 547 bp, Homo sapiens
  misc_feature: GYAE6OF02GPZW2.46.67.G01.1.454.CMB.1.raw
  modified_base (334)..(334): a, c, t, g, unknown or other
  misc_feature (334)..(334): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccgcagctcccgagggaagggctggtaatacattggaagtgtctctcatagtggaggttcctattacagtccgtctctcaagagtcgagtcaccatatctctggacacgtccagcaatcagttttcccngaagatgagttctgtgaccgcgctgacacgggtctttattactgtgcgagagacggctattatgtatttttggagttggttattcgactacctagactcgacggggctcgacccgtgggccagggaactcgtgtcaccgtctccttacgcctccaccgaacggcccagtccggttccttccccgtggccctacccttccaccacgcgtacccg

SEQ ID NO: 141616 - DNA, 546 bp, Homo sapiens
  misc_feature: GYAE6OF02HKU1J.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccaggacgcccctaagctcctaatctatgctgcatccagtttgacaaaagtcgggtccatcgtaggttcagtggacagtggatcgtgggacagattcactctcaccatcagtatctgacaacgtagaagtattttagactaaacttattacttagtacaacagaaattacaagttgtttacggacctaaagggacaacgtaactaacaaaattaaaccgagtagtagactcgacacctagtacctacgttcttacgtacttccgttaccctctaacttctagtaac

SEQ ID NO: 141617 - DNA, 587 bp, Homo sapiens
  misc_feature: GYAE6OF02HTHO6.46.67.G01.1.454.CMB.1.raw
  modified_base (226)..(226): a, c, t, g, unknown or other
  misc_feature (226)..(226): n is a, c, g, or t
  modified_base (356)..(356): a, c, t, g, unknown or other
  misc_feature (356)..(356): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctccatcctccctgtctgcaaccgtgggagacagtgtcaccatcacttgccggcaagtcggaacnttgacacttattaaatggtatacacatagaccaggaccgaccctaagctactaatctatgctgctatcctagtttacgactaaaggtcggggtaccagttacggtagttcgagttcggacgtaggtaggntcgtggactagtattcactctacaccgtatacagtaatcgtagactaagtacgaattatttagacttaattattacgtatacaataataattaataattagtttacggtaacgtaacggactaacggtacttaaacgtaaagtaaactaacgttagtacggtactacggtaccaactacgttactacgttaccttacactttcccgttacccgtcctataccgtgtaaccg

SEQ ID NO: 141618 - DNA, 542 bp, Homo sapiens
  misc_feature: GYAE6OF02IPVX3.46.67.G01.1.454.CMB.1.raw
  modified_base (251)..(251): a, c, t, g, unknown or other
  misc_feature (251)..(251): n is a, c, g, or t
  modified_base (365)..(365): a, c, t, g, unknown or other
  misc_feature (365)..(365): n is a, c, g, or t
  modified_base (398)..(398): a, c, t, g, unknown or other
  misc_feature (398)..(398): n is a, c, g, or t
  modified_base (435)..(435): a, c, t, g, unknown or other
  misc_feature (435)..(435): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccggcaagtcggaacattgacactatttaatggtatcaanatagaccgagggacgcccctaagcctacctaatctatgctgcactcctagtttgactaaagtcgggtccagtcgaggttcagtgcagtgatcgtgggactagtatttcacttcnctacatcgataactctgactaacgtagtaagtntttagactaacttattactgtacaactagtaattaanagttacgtttcggaactaacgggactacgtaactaactaaattaaacgaactgtagtctagacctaactattctagtcttactcttaccttcccgctacttctatac

SEQ ID NO: 141619 - DNA, 702 bp, Homo sapiens
  misc_feature: GYAE6OF02JBAVE.46.67.G01.1.454.CMB.1.raw
  modified_base (212)..(212): a, c, t, g, unknown or other
  misc_feature (212)..(212): n is a, c, g, or t
  modified_base (249)..(249): a, c, t, g, unknown or other
  misc_feature (249)..(249): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtcncctcatcagtagtggtttctcgtggggctgggtccgnagcctaccgagggagggctaggaatacgtagttaggaagttcgtctcgtacagttaggtaggtacggttccttagttacacggtccgtctactacgaagtacgtcgagtactaccattatctacgtggacctaccgtacagacctaacgttcttaacgttttccctagaaagtgtacgtacgtttctggttaccgacccgcgtacgtcgtaccgtacgggttacgtttagttacgtggtcggtacgaaggacgtaccgtattacttagttagttagttttacggagtttaggttttactttaccgtaaccttaccgtaaggtacgttaccgggtacggggtaccgtacccggtaaccccgggttcggggaaccgtaacggggttacgttaacccggttccgggttaacccttcccggttacccgttacccggtttaccgcccccttaacccgg

SEQ ID NO: 141620 - DNA, 570 bp, Homo sapiens
  misc_feature: GYAE6OF02G27S7.46.67.G01.1.454.CMB.1.raw
  modified_base (447)..(447): a, c, t, g, unknown or other
  misc_feature (447)..(447): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgagggaaggggctggaatacattggaagtgtctctcatagtggaggttcctattacagtccgtctctcaagagtcgagtcaccatatctctggacacgtccagcaatctacgttttcccagaagtatgtagttctgtcggacccgccgcgtacgacgacgggtcgtttattacgtgttgcgagagacgntattatgtagtttttggagttggtttatttcgactaccgtagtacgtcggacggggctccggacccggtcggggaccagggtaactacgtcggtcctaccgttcttccgttacgccctacccg

SEQ ID NO: 141621 - DNA, 555 bp, Homo sapiens
  misc_feature: GYAE6OF02F01G5.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgaccccagtctccatcctccctgtctgcaaccgtgggagacagtgtcaccatcacttgccggcaagtcgaacattgacacctatttaatggtatcaacatagaccagggaccggcccctaagctcctaatctatgctgcatccagtttgacaaagtgggtcccagtcgaggttcaggtggcaggtggatcgtgggacaggtattcgactctcacctatctagtaactctgacacgtagtaagtattttagactaacttattactgtacaactagtaattactaagttcgtttacgacgtaaggacaacgacttaaacaaaacttaaacgtaactgttagctacgacctaaccgattcctcgttacttaccacttccttccccggactacttccacgttaac

SEQ ID NO: 141622 - DNA, 540 bp, Homo sapiens
  misc_feature: GYAE6OF02GI6I0.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacgcccctaagctcctaatctatgctgcatccagtttgcaaagtggggtcccatcgaggttcagtggcagtggatctgggacagtatttcactctcaccatcagtaatctgcaacgtgaagtattttagactaacttattacttgtacaacagtaattactaattgttttacggacgaagggacaacgtaactaactaaattaaacgaactgtacggctaggaccacctaattctgttcttactacttccttccccgacctacttcctagtaacc

SEQ ID NO: 141623 - DNA, 599 bp, Homo sapiens
  misc_feature: GYAE6OF02JCL84.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttggccgggacaagtcggaacattgacactatttaatggtatcaacatagaccgagggaccgccctaagctctaatctatgctgcatcctagtttgacaagtcggggtacccagtcgtaggtcagtggacgagtggatcgtgggactaggtactttacactcctacaacctatacgtagttaaactcgtagactaacgtagtaagttatttagtactaacttattacttagtacaacaagtaacttactaagttcgtttacggtaccgaacgggtactaacgtaacttaactaaagttaaacgtaaacgttgtaagtacgtacgtaccacctaacttcgtacgttcttaaccgtactttacccttacccgtacctacgtactagttaaccg

SEQ ID NO: 141624 - DNA, 660 bp, Homo sapiens
  misc_feature: GYAE6OF02JU5TA.46.67.G01.1.454.CMB.1.raw
  modified_base (391)..(391): a, c, t, g, unknown or other
  misc_feature (391)..(391): n is a, c, g, or t
  modified_base (404)..(404): a, c, t, g, unknown or other
  misc_feature (404)..(404): n is a, c, g, or t
tcagactagcagtacacgaccggtgctcgatttagagtatacatattgggtttggggtagtctcggtcaggacacagcatggacatgagggtccccgctcagctcctggggctcctgctactctggctccgaggtgccagatgtgacatcgagctgacccagtctccatcctccctgtctgccaaccgtgggagacagtgtcaccatcacttgccgggtcaaggtccggaacagttgaactaccttaattttaaacgttggttaatcaactaatagaccaagggaccggtacccctaaggccttacctaatctactagctgacactacagtttgacaaaggtcgggtccagtcgtagtcacggtgcagtgatcgtgggacagtagttaacnctacgaccacgtnaagtttacacgtgacctaacgtagaagttatttagacttaaactttagttaactacgttaactaaaccggtaattaacgttaaacctagttttacgtttaccggaaccgtaaagggttaaccaaccgtaacgttaaaacctaaagttaaaaccgaccgttagttacgacgtacggtaacccacgttaacgttcgtaactttacgtacccgttattaccccgttaccccgtagtaccttacgtttagtaaccgtacc

SEQ ID NO: 141625 - DNA, 537 bp, Homo sapiens
  misc_feature: GYAE6OF02IJXS1.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactattaaatgtatcaacatagaccagggacgcccctaagctctaatctatgctgcatccagtttgactaaagtgggtcccagtcgaggttcagtggcagtgatctagggacagtattcactctcacatctagtaactctagctaacgtgaaagtattttagactaacttattacgtgtacaacagtaaattaactaatgtttaccggacaaaggaccaacgaactaataaattaaacgtaactgtaggctagacaacctatcttagtcttacacgttacctttcccgacctaactctagtaac

SEQ ID NO: 141626 - DNA, 558 bp, Homo sapiens
  misc_feature: GYAE6OF02FMUAI.46.67.G01.1.454.CMB.1.raw
  modified_base (252)..(252): a, c, t, g, unknown or other
  misc_feature (252)..(252): n is a, c, g, or t
  modified_base (344)..(344): a, c, t, g, unknown or other
  misc_feature (344)..(344): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatccgagctgacccagtctccatcctcctgtctgcaaccgtggagacagtgtcaccatcacttgccggcaagtcgacatgacacctatttaaatgtatcaacatanaccaggacggcccctaagctcctaatctatgctgcatcctagtttgactaaagtcggggtaccctatcgaggttcagtggctaggtgatcgnggacagtattcatctcacatcagtactctgcaacgtgaagtatttgactaacttattactacgtacaactagtaactttaacaagtttacgttttacgaccgtaaggactaacgtaactaaactaaattaaaacgaatttagcggtactacggacctaacattacgttacgttcctaccttacgttcccttacccgcctacttcgtagttaacc

SEQ ID NO: 141627 - DNA, 587 bp, Homo sapiens
  misc_feature: GYAE6OF02FT06G.46.67.G01.1.454.CMB.1.raw
  modified_base (340)..(340): a, c, t, g, unknown or other
  misc_feature (340)..(340): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagaccctgtccctcacctgcgctgtctctggtgcctccatcagtagtggtttcttcgtggggctggggtccggcagcctcccgaggggaaggggctgggaatacgattggaagtgtctctcagtagtggaggttcctattacagtccgtctctcaagagtcgagtcacatatctctgacacgtcagcaatcagttttcccngaagatgtagttctgtcgaccgtccgctgacgtacgggtcttttaattactgtcgcgagacgacggcttattatgttagttttggagttggttattcgactaccgttagacgtcggacggggtctcggacccgtgggccgagggtaactcgtcggtacgtaccgttctccgttacgccctaccaccgaacgggcccacgtcccggttccttccccgtggcccctaccctccctccgtacgctacccg

SEQ ID NO: 141628 - DNA, 558 bp, Homo sapiens
  misc_feature: GYAE6OF02HH2SE.46.67.G01.1.454.CMB.1.raw
  modified_base (255)..(255): a, c, t, g, unknown or other
  misc_feature (255)..(255): n is a, c, g, or t
  modified_base (436)..(436): a, c, t, g, unknown or other
  misc_feature (436)..(436): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtcccctcacctgcgctgtctctggtcgcctccatcagttagtggtttcttcgtggggcttggggtccgnagctcccgagggaaggggctggaatacattggaagtgtctctcatagtggaggttcctattacagtccgtctctcaagtagtcgatcaccatatctctgacacgtccagcaatctacgttttcccagaagatgtagtttctgtcgaccgccgcgtcgacgacgggtctttatacgtgtcgngagagcgctatatgtatttggagttgttattcgacacctagacgtcggacgggtctccggtacccgtgggacccgagggtaactccgtaggtccaccgttcctaccttacgccctaaccccg

SEQ ID NO: 141629 - DNA, 588 bp, Homo sapiens
  misc_feature: GYAE6OF02FWI9B.46.67.G01.1.454.CMB.1.raw
  modified_base (192)..(192): a, c, t, g, unknown or other
  misc_feature (192)..(192): n is a, c, g, or t
  modified_base (406)..(406): a, c, t, g, unknown or other
  misc_feature (406)..(406): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaaggtcggaacattgactacctatttaaatggtatcaacatagaccagggacgcccctaagctactaatctatgctgcatccagtttgacgtaaaggtcgggtacccagtcgtaggttcagtggcagtggatcgtgggacagtattcactctacactatacgagtaatctacgacgaacgtgaaagttntttcgacttaacgtttattacttagtactaaagtagtaaattactaagtttcggtttacgacgtaagggactaacgaacttaaactaaaacttaaacgaattcggtacgactacggacctaaccgtattccctaggtttaccttacacgtttccgttaccccgacttacttccgtataaccg

SEQ ID NO: 141630 - DNA, 771 bp, Homo sapiens
  misc_feature: GYAE6OF02JHVN2.46.67.G01.1.454.CMB.1.raw
  modified_base (211)..(211): a, c, t, g, unknown or other
  misc_feature (211)..(211): n is a, c, g, or t
  modified_base (322)..(322): a, c, t, g, unknown or other
  misc_feature (322)..(322): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtccctcacctgcgctgtctctggtcgcctccatcagtagtggtttcttcgtgggctgggtccgnagcctccgaggggtaacgggctaggaatacagttaggaagtgtctctcatagtggtaggttcctattacagtcgtctctacaagagtcgagtcaccatactctcgtggacncgtccagctaatcgtacgttttccctagaagtactgtacgttcgtaggtcgacccgtccgtcgtcggaccgtacggggttacttttaagttacgtggttacggacgtaaggacggtaaccgtatttaacgttaagttcgtttagtttttagggtaacgtttgggtttaactttaccgaacccgttaacccggtaagttaccggtccggggtaaccggggtcccgttacccgggtaccccgggtacgggtaacccgggtaacggggtaaaccgtttaccggttacggttacccgtaacccggttacctttaccgttaccgtccccgttaacccgtaaacccggtaaccgggtacccccgttaaggttcccccgggtttcccccttaccccggtaccggttaccccgtaccccctttaccggtaacccgtaaccggtacccgtaaccccgg

SEQ ID NO: 141631 - DNA, 614 bp, Homo sapiens
  misc_feature: GYAE6OF02HQUMD.46.67.G01.1.454.CMB.1.raw
  modified_base (395)..(395): a, c, t, g, unknown or other
  misc_feature (395)..(395): n is a, c, g, or t
tcagactagcagtacacgaccggtgctcgatttagagtatacatattggggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagttgcaccatcacttggccgggcaaggtcggaacattagacctaaccttaatttaaagttggtattacaaactataagaccgaggggaccgcccctaaagctacctaattctatgctgcatcctagtttagacgtaaaggttcggggtaccagttcggtaggtttcaaggttggactaggtggatcgtagggacagtnttcactctacaccatcagtatcgtgactaagtgaattatttgaactaactttattactgtacaaatagtaaattactaagttcgtttaccggacgtaaacgggtaccaaacggtaacttaaacgtaaacgttaaacgtaacgttggttacgacgtacgtacaacctatacgttcgttacttcgtaacttcccgtttacccgacttacgtactagttaac

SEQ ID NO: 141632 - DNA, 564 bp, Homo sapiens
  misc_feature: GYAE6OF02FNXI8.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtacccagtcgaggttcagtggcagtggatctgggacagattcactctcaccatcagtaatctgcaacgtgaagtattttgactaacttattacttagtactaacgagtaattactaattcgttttacggacctaagggacaacgaacttaactaaaacgttaaacgaacgttacgtaggtctacgacctaacctatccgttagtacctttactactttccgtacccctaccgtacttaccgtgtaaccg

SEQ ID NO: 141633 - DNA, 574 bp, Homo sapiens
  misc_feature: GYAE6OF02IMNVZ.46.67.G01.1.454.CMB.1.raw
  modified_base (311)..(311): a, c, t, g, unknown or other
  misc_feature (311)..(311): n is a, c, g, or t
  modified_base (340)..(340): a, c, t, g, unknown or other
  misc_feature (340)..(340): n is a, c, g, or t
  modified_base (395)..(395): a, c, t, g, unknown or other
  misc_feature (395)..(395): n is a, c, g, or t
  modified_base (489)..(489): a, c, t, g, unknown or other
  misc_feature (489)..(489): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggttttcttcgtggggctgggtccggcagctcccgagggaggggctaggaatacagttggaagtgtctctcagtagtggaggttcctattacagtccgtctctcaagagtcgagtcaccatatctntggacacgtccagcaatcagtttttcccngtaagatgtagttctgtgaccgccgctgacacgggtcgtttattactgtgcgagngacgctattatgtagttttggagttggttatttcgacctaccctagatcggacggggcctcgacccgtgggccgtagggaactacgtcggtacnccgtctccttagtccctaccaccgaacggccccagttccggtcccttccccgtcggccctacccctccctaccacgacctacccg

SEQ ID NO: 141634 - DNA, 556 bp, Homo sapiens
  misc_feature: GYAE6OF02GJ4UX.46.67.G01.1.454.CMB.1.raw
  modified_base (386)..(386): a, c, t, g, unknown or other
  misc_feature (386)..(386): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccggcagctccgagggaaggggctggaatacattggaagtgtctctcatagtggacggttcctattacagtccgtctctcaagagtcgagtcaccatatctctggacacgtccgagcaatctaacgttttccctagaacgntgtagttctgtgaccgccgctgacgacgggtcgtttacttacgtgtcgcgagagacgctattatgtattttgggagttggtttatttcgactacctagacgtcggacggggctccggcccgtgggaccgagggaactacgtcggtctaccgtctccttacgccctacccg

SEQ ID NO: 141635 - DNA, 621 bp, Homo sapiens
  misc_feature: GYAE6OF02H0IN8.46.67.G01.1.454.CMB.1.raw
  modified_base (254)..(254): a, c, t, g, unknown or other
  misc_feature (254)..(254): n is a, c, g, or t
tcagactagcagtacacgaccggtgctcgatttagagtatacatattgggtttggggagtctcggtcaggacacagcatggacatgagggtccccgtctcagctcctgggggctcctgctactctggctccgaggtgccagatgtgacatcgagctgacccagtctccatcctccctgtctgcaaccgtgggagacagtgtcaccatcacttggccggcaagtcgaacattgacactatttaaattgtatcaanatagaccgagggaccgcccctaagcctacctaatctatgcttgctatcctagttttcgacgtaaaggttcggggtacccagtcggtagttcgaggtggctagtggatcgtgggactagtatttcactctacactatcaagttaatctagactaacgtagtaagtattttacgactaactttattactagtacaactaagtaattaactaagtttcggtttaccgaaccgtaacgggtacctaacgtaacttaaactaaaacgttaaaacggaacttaggtacggtacgtagtaccgtaacctacgttacctacgttacctttccgtaacttcccgttaccccgtaccttacgttacctacgttaacg

SEQ ID NO: 141636 - DNA, 562 bp, Homo sapiens
  misc_feature: GYAE6OF02G5VSJ.46.67.G01.1.454.CMB.1.raw
  modified_base (329)..(329): a, c, t, g, unknown or other
  misc_feature (329)..(329): n is a, c, g, or t
  modified_base (382)..(382): a, c, t, g, unknown or other
  misc_feature (382)..(382): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccgcagctcccgagggaagggctggaatacgagttggaagtgtctctcagtagtggaggttcctattacagtccgtctctcaagngtcgagtcaccatatctcgtggacacgtccagcaatctagtttcccagaagtntgtagttctgtcgacccgtccgctcgacgtacgggtctttattacgtgtgcgagacgcgtactattatgttagttttggagttgttatttcgactaccgtaagagtcggacgggctccggacccgtgggacccgtaggtaacgtcgtacggtcctaccgttcctccgttacgcctacccg

SEQ ID NO: 141637 - DNA, 570 bp, Homo sapiens
  misc_feature: GYAE6OF02IN6M0.46.67.G01.1.454.CMB.1.raw
  modified_base (249)..(249): a, c, t, g, unknown or other
  misc_feature (249)..(249): n is a, c, g, or t
  modified_base (358)..(358): a, c, t, g, unknown or other
  misc_feature (358)..(358): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcacatcacttgccgggcaagtcgaacattgacactattaatgtatcaanatagaccagggacgcccctaagctacctaatctatgctgcatccagttgacaaaggtcgggtacccagtcgtagttcagtggcagtggatcgtgggactagattcactncaacatcagtaatctagacaacgtgaagttatttgactaactttattacgttcgtactaaacataaacttacgaattacggttttacgaaccgtaggtaaccaacggtaattaaccgtaaaacgttaaacgaaactaggtcgtactacgacctaaccagttcgttcgttacttacctacttccgtttccccaccgttaagtcctagttaacg

SEQ ID NO: 141638 - DNA, 694 bp, Homo sapiens
  misc_feature: GYAE6OF02GJ0B3.46.67.G01.1.454.CMB.1.raw
  modified_base (346)..(346): a, c, t, g, unknown or other
  misc_feature (346)..(346): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgagggccttcgggagaccctgtccctcacctgcgctgtctctggtgcctccatcagtagtggtttcttcgtgggctgggtccgcagctcccgaggggaagggctggaatacgagttggaagtgtctctcatagtggaggttcctattacagtccgtctctcaagagtcgagtcaccatactctctggacacgtccagcaatctacgttttccagaagtntgtagttctgtcgaccgcgctacgacgtacgggtcgttttatacgtgtcgcgagagcgacttagttagtgttagttttggagtttaggttactttccgaactacccgttagacgttcgggtaccggggtccttaccggtaccccggtacgggggtacccgtaaacggggtaaccgttaccggttacgggttacccgttaccccggtaccgttacccgttaccggtcccctaccccgtaacccggaacccgggtacccgtacggttccccggttcccctttcccccccggttacgggtccccctaaccccccgttccccgtaaccccgtaacggtacccgtaaccccgg

SEQ ID NO: 141639 - DNA, 602 bp, Homo sapiens
  misc_feature: GYAE6OF02F6KJ9.46.67.G01.1.454.CMB.1.raw
  modified_base (321)..(321): a, c, t, g, unknown or other
  misc_feature (321)..(321): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccgcagctccagggagggctggatacattggaagtgtctctcatagtggaggttcctatacagtccgtctctcaagngtcgagtcaccatactctctggacacgtccagcaatctagttttcccagaagtatgtagttctgtcgaccgccgtctcgacgaccgggtctttattacgtggtcgcgtagacgacggtcttagttacttggtagttttggagtttaggttacgtttaccgaccgtaccgtagtacgtcgggaccggggtcctaccggtaccccggtggggtacccgtaacgggtaacttccggttacggtcccgtacccggttccgttcccgttacgtccccgtaacccgg

SEQ ID NO: 141640 - DNA, 554 bp, Homo sapiens
  misc_feature: GYAE6OF02FLVZZ.46.67.G01.1.454.CMB.1.raw
  modified_base (314)..(314): a, c, t, g, unknown or other
  misc_feature (314)..(314): n is a, c, g, or t
  modified_base (398)..(398): a, c, t, g, unknown or other
  misc_feature (398)..(398): n is a, c, g, or t
  modified_base (403)..(403): a, c, t, g, unknown or other
  misc_feature (403)..(403): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggagacagtgtccaccatcacttgccgggcaaggtcggaacattgacctacctaattttaaattggtatcaacatacgaccagggaccgcccctaagctcctaatctatgctgcatcctaggtttnacgaaaggtcgggtcccagtcgaggttcagtgcagtgatcgaggacagtattcactctcacatcagtaatctgacagtgaagtntttanacttaattatcttagtacaactataattacaagtttcgttacggacgtaaggtacaacggtactaacgtaaataacgtaactgacgtctacgacctaactattaccgtcgttacttacacgttcccttaccccgctacttcgtagtaaccg

SEQ ID NO: 141641 - DNA, 581 bp, Homo sapiens
  misc_feature: GYAE6OF02G0GIL.46.67.G01.1.454.CMB.1.raw
  modified_base (256)..(256): a, c, t, g, unknown or other
  misc_feature (256)..(256): n is a, c, g, or t
  modified_base (348)..(348): a, c, t, g, unknown or other
  misc_feature (348)..(348): n is a, c, g, or t
  modified_base (352)..(352): a, c, t, g, unknown or other
  misc_feature (352)..(352): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacaccttatttaaattggtatcaanatagaccagggacgcccctaagctcctaatctatgctgcatccagtttgactaaaggtcgggtcccatcgaggttcagtggcagtggatcgngganagtatttcactctcactatcagtatctgacaacgtgaagtatttcgactaacttatacttgtacaacagtaacttacattacggtttacgaccgtaaagggtacctaacggtaacctaacgtaaaacgtttaaacgaacgttagtacggtacttacggacctaccgttaactttccgttttacctactaaccttcccgttacccgtacctacgttctacgtaacttacg

SEQ ID NO: 141642 - DNA, 555 bp, Homo sapiens
  misc_feature: GYAE6OF02HQ4OS.46.67.G01.1.454.CMB.1.raw
  modified_base (250)..(250): a, c, t, g, unknown or other
  misc_feature (250)..(250): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccagactggtgaggccttcggagaccctgtccctcacctgcgctgtctctggtgcctccatcagtagtggtttcttctggggctgggtccggcngctcccgagggaaggggctggaatacattggaagtgtctctcatagtggaggttcctattacagtccgtctctcaagagtcgagtcaccatatctctggacacgtccagcaatctaagttttcccagaagatgtagtttctgtgaccgccgctgacgacgggtcgtttattacgtgtgcgagagacgctattatgtatttttggagttggtttatttcgactacctagacgtcggacggggtctccggaccccgtggggccgagggtaactacgtcggtcgaccgttctccgttacgcctacccg

SEQ ID NO: 141643 - DNA, 662 bp, Homo sapiens
  misc_feature: GYAE6OF02HBSUC.46.67.G01.1.454.CMB.1.raw
  modified_base (338)..(338): a, c, t, g, unknown or other
  misc_feature (338)..(338): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctgggctgggtccggcagctccagggagggctggaatacattggaagtgtctctcatagtggaggttcctattacgagttccgtctctcaagacgtcgagtcaccatatctctggacacgtccagcaatctacgttttccagaagntgtagttctgtcgaccgccgctgacgacgggtctttattacgtgtcgcgaggagacggtcttatttagtgttagttttgggagtttggtttacgttcggtacctacccgtagtacgtcgggaccgggggtcctccggaccccggtcggggacccgagggtaacgttacgttcgggtaccgtaccggttccttacccgttacgtacccgttcccgaacccggtaaccgggtaccccgtaacggttccccgggtttacccctttccccccggttccgggtacccctacccccgttaccccgtacccgtaaccggtccgtaaccccg

SEQ ID NO: 141644 - DNA, 597 bp, Homo sapiens
  misc_feature: GYAE6OF02GB1N3.46.67.G01.1.454.CMB.1.raw
  modified_base (337)..(337): a, c, t, g, unknown or other
  misc_feature (337)..(337): n is a, c, g, or t
  modified_base (343)..(343): a, c, t, g, unknown or other
  misc_feature (343)..(343): n is a, c, g, or t
  modified_base (451)..(451): a, c, t, g, unknown or other
  misc_feature (451)..(451): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagcctcccgaggggaaggggctggaatacattggaagtgtctctcatgtggaggttcctattacagtccgtctctcaagagtcgagtcaccatatctctggacacgtccagcaatcagttttcccngaacgntgagttctgtcgaccgccgctgacacggggtctttaattacgtgtagcgagacggacggtacttattagtagttagtttttggagttggtttattcgactaccgtagngtcggacggggtctccgacccgtggggccagggtaactacgtggtccaccgttcctccgttacgccctaccgaccgtaacgggccctacggtccggttacccttccccgtcggccctacccctccctacccgtaacgcgtaccccg

SEQ ID NO: 141645 - DNA, 504 bp, Homo sapiens
  misc_feature: GYAE6OF02F358W.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacacctatttaaatggtatcaacatagaccagggacgcccctaagctcctaatctatgctgcatccagtttgctaaagtggggtcccatcgaggttcagtggcagtggatcgtgggacagtatttcactctcaccatcagtaatctgcaacgtgaagtattttgactaacttattactgtacaactagaattacattgtttcgacaagggacacgactaacaaattaacgactgtgctgcacatctgtcttcattcctacccgcactctgtac

SEQ ID NO: 141646 - DNA, 547 bp, Homo sapiens
  misc_feature: GYAE6OF02F43XN.46.67.G01.1.454.CMB.1.raw
  modified_base (534)..(534): a, c, t, g, unknown or other
  misc_feature (534)..(534): n is a, c, g, or t
  modified_base (540)..(540): a, c, t, g, unknown or other
  misc_feature (540)..(540): n is a, c, g, or t
  modified_base (545)..(545): a, c, t, g, unknown or other
  misc_feature (545)..(545): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactgggtgaggccttcggagaccctgtccctcacctgcgctgtctctggtgcctccatcagtagtggtttcttctggggctgggtccggcagctcccgagggaagggctggaatacattggaagtgtctctcatagtggaggttcctattacagtccgtctctcaagagtcgagtcaccatatctctggacacgtccagcaatctagttttcccagaagtatgagttctgtcgaccgccgctgacctacggggtctttattacgtgtgacgagagacggctaagttatgtattttggtagttggttattcgactacccgtagtacgtacgacggggctccgacccgtcgggcgtaggaatacgtgtcaccgtctctacgtcctccacgacggccacgtcgtcctccctcgccncctccncacgncg

SEQ ID NO: 141647 - DNA, 576 bp, Homo sapiens
  misc_feature: GYAE6OF02GQ9I1.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgcccctaagctcctaatctatgctgcatccagtttgcaaagtgggtcccatcgaggttcagtggcagtgatcgtgggacagtattcactctacacatcagtaatctgactaacgtgaagtatttgactaacttattactagtacaaactagtaaacttactaattgtttacggaccgtaagggtaaccaacgtaacttaaactaaaacgttaaacgaacgtagttacggacttacggacctaaccgtattccgttagttacctttactaacgttcccgtttaccccgacctacgttaccgtagtaacc

SEQ ID NO: 141648 - DNA, 577 bp, Homo sapiens
  misc_feature: GYAE6OF02GVA17.46.67.G01.1.454.CMB.1.raw
  modified_base (378)..(378): a, c, t, g, unknown or other
  misc_feature (378)..(378): n is a, c, g, or t
  modified_base (451)..(451): a, c, t, g, unknown or other
  misc_feature (451)..(451): n is a, c, g, or t
  modified_base (465)..(465): a, c, t, g, unknown or other
  misc_feature (465)..(465): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgagggaaggggctggaatacattggaagtgtctcgtcatagtggaggttcctattacagtccgtctctcaagagtcgagtcaccatactctctggacacgtccagcaatcagttttcccngaagatgagtttctgtgacccgccgctgaccgacgggtcgttttattactgttgcgagagacggtcttaattntagtagtttttggngttggtttatttcgaacgtaccctagtagtccggtacggggctaccggaccccggttggggacccgagggtaacttacgtggtccgaccgttcctaccttagccctaccccg

SEQ ID NO: 141649 - DNA, 682 bp, Homo sapiens
  misc_feature: GYAE6OF02JMTMN.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacacctatttaaattgtatcaacatagacaggacgcccctaagctcctaatctatgctgcatcctaagtttgacaaagtcggggtaccctagtcgtaggttcgagttggcaacggtggagtcgtgggaactaggtactttacacttctacgaaccctatactaacgttaactcttagacctaacggtagtaaaggttattttacgactaactttaatttaacgttacgttacgtaaacgtaagttaaactttaactaagtttacggttttaccggaaccctaaaggggtaaccctaccggtaaacttaacctaaaaagttaaacccgtaaacgttacggttacggtacgttaacggaccctaaacccgtagtttacccgtacggtttacctttaccggtaacctttacccgttacccccgtaaccgttaccttacggtttacgttaaaccg

SEQ ID NO: 141650 - DNA, 766 bp, Homo sapiens
  misc_feature: GYAE6OF02G60BN.46.67.G01.1.454.CMB.1.raw
  modified_base (297)..(297): a, c, t, g, unknown or other
  misc_feature (297)..(297): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtgggctgggtccgcagcctccgaggggagggctaggaatacgagttggaagtgtctctcaagtaggtggacgttacctattacacgttccgtctctcaaggngtcgagtccacatatctctggacacgtccagcaatcgtactttccagtaagtatgtattctagtcgaccgtccgctaggacgtacggttcttttaactacgtgtgtacgagtacggtacggtacttaatttacgttaggtttaggttttagggtaggtttaggttttacgtttaccggtaaccgttaaccccgttaggtacggttacccggggaccggggttacccgttaccccgggtacccccgggttacgggggtaacccgtaaagggggttaaaccgttacggttaccgggttacccgtaaacccggtttcccgtttacccgttaacccggtaccccgtaaccccggtaacccggtaaacccgggtccccggttaaccgtttccccgggttaccccgtttacccccggtccggtacccccttaccccccggttacccggttacccgaccgggtacctacccccggg

SEQ ID NO: 141651 - DNA, 579 bp, Homo sapiens
  misc_feature: GYAE6OF02GQHJK.46.67.G01.1.454.CMB.1.raw
  modified_base (236)..(236): a, c, t, g, unknown or other
  misc_feature (236)..(236): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgnggggctggggtccgcagctcccgagggaaggggctggaatacattggaagtgtctctcatagtggaggttcctattacagtccgtctctcaagagtcgagtcaccatatctctggacacgtccagcaatctagttttcccagtagatgtagtcttgtgccgccgctgacgacggtcgttattacgtgtgcgagagacgcgtattattagttagtttagttagtaggtttagtttacgtactaccgttacgtagtacggtacgggtcggtaccgtcccggtaccgggtcggaacggtagtacgttacggtcgtaccgtaccgtccgttaccgtaccctaccccg

SEQ ID NO: 141652 - DNA, 654 bp, Homo sapiens
  misc_feature: GYAE6OF02IK8JH.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctccgagggagggctggatacattggaagtgtctctcatagtggtaggttctattacacgtccgtctctcaagagtcgagtcacctatatctctggacacgtccagcaatcttacgtttcccagaagatgtagttctgtacgaccgccgtctggaccgtacgggtacttttaagtacgtggtcgacgtagacggacggtcttaagttagtagttagttttggaggtttggtttagttccgtaacgtaaccctagtacgttacgggtaccggggccttacccggtaccccggtaggggacccgtaaggggtaacttaccggttcgggtacctaacccggtccttaccgttaccgtcccgtacccgacccggtaaccggaccccgtacgtcccggttacccttccccgtacgccctaccccttccctaccgacgtaccgcccg

SEQ ID NO: 141653 - DNA, 526 bp, Homo sapiens
  misc_feature: GYAE6OF02JDGZO.46.67.G01.1.454.CMB.1.raw
  modified_base (353)..(353): a, c, t, g, unknown or other
  misc_feature (353)..(353): n is a, c, g, or t
  modified_base (422)..(422): a, c, t, g, unknown or other
  misc_feature (422)..(422): n is a, c, g, or t
  modified_base (470)..(470): a, c, t, g, unknown or other
  misc_feature (470)..(470): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtggagacagtgtcaccatcacttgccgggcaagtcggaacattgactacctatttaaaattggtatcaaacatagaccaggacggcccctaagctcctaatctatgactgcatccgagtttgcaaagtcggggtcccagtcgaggttcagtggcagtgatcgtggacngattcactctacaccatcagtaatctgcaacgtgaagtattttgactaacttattactgtacaacgtanaattacattgtttcgactaaggacacgactaactaaataaacgatagngctagacgtaccattcgtcttacttactacttccttccgacctactcctagtaacc

SEQ ID NO: 141654 - DNA, 686 bp, Homo sapiens
  misc_feature: GYAE6OF02F1E3T.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtcttcaaccgtggganacagtgtcacatcacttgccggcaagtcgaacattgacacctattaattgtatcaacatagaccagggaccgtcccctaagctacctaatctatcgtctgcatcctagtttcgacgtaaaggtcggggtaccctaagtcggtaacggttcgaaggtcggactaggtgacttcgtgggacagtactttcacgttctcaccgtataccgtagttaactcgtagaccgtaagtagtaacgttagttttcaacgttaacctttagttaccgttagttaaccaaacgtacgttaaacgttaacttaacgtttaccggtttacggtaaccggtaaacgggaccgtaaaccgtaacttaaccgtaaaaacgttttaaacggaacgtttaacggacggttacttacggaaccctaaccgttaacgttaccgttacggtttacccttacgtaaccgtttcccggttaacccctaccttacgtcctttaacggacctttacccg

SEQ ID NO: 141655 - DNA, 779 bp, Homo sapiens
  misc_feature: GYAE6OF02IRZX3.46.67.G01.1.454.CMB.1.raw
  modified_base (262)..(262): a, c, t, g, unknown or other
  misc_feature (262)..(262): n is a, c, g, or t
tcagactagcagtacacgaccggtgctcgatttagagtatacatattggggttgggagtctcggtcaggactacgacgcagtacggacagtaccgagggtccccgctcgactctccttcggggccttcctgactactcgtggcctacggaggttcgacccgagaatagttggacactcgagctgacccgtacggtcctcattcctcctcgtcggtagacgaaccgtcggacgactggtcgtacgaccattcagttgcggtanacgtacgaactattcgacctacgtaactttaaagtggaacttcaacgactaaggaccgtacgggaccggtacccctaagccttactaagtactatcgaccgtgactacgtcctagtttcgacgtaaacggtcgggtaccagttcggagttcgaggtgacagtagctacgtggactacgtactttacacttcgtacacgtaagtcgaaggttaactcgtaagaacgttaaacgtttgaaacgtttaagttttacgtaacgttaaaccttttaagttaccgacgttaaccgaaacgttaaagtaacgttaacccttaagtttccgttttacccggtaaccgtaaacgggttaaccgttaaccggtaaccgttaaagggtaaaacctttaaacggaacggttggtaacggtacgttaaaccgaaccgttaaaccgtcggtttacgtaccggtttaccttaccttaacccgttaaccgtttccccgaacccgttttactttacccgtaacgtttaacccgg

SEQ ID NO: 141656 - DNA, 655 bp, Homo sapiens
  misc_feature: GYAE6OF02HZ0NK.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtcccctcacctgcgctgtctctggtgcctccatcagtagtgtttctctggggctgggtccggcagctcccgaggggaaggggctaggaatacagttggaagtgtctctcatagtggtagttcctattacgagtccgtctctacaagagtcgagtcacatatctctggactcgtcagcaatctacgttttcccagaagtatgtacgttctgtacgaccggccgtcgtacggacgtacggggtacttttaagttacgtggtcgacgtagacggtacggtactaatttgtagttagttttttacgggaggtttagtttacgtttccgtaaccttacccgtaaggtacgttaccgggtaccgggggtccgtacccgggtaccccggttacgggggaccgtaacgggttaagtaccggttacggttacccgtaacccggttccgtttacccggttaccgtccccgtaaccccgg

SEQ ID NO: 141657 - DNA, 572 bp, Homo sapiens
  misc_feature: GYAE6OF02FLWLE.46.67.G01.1.454.CMB.1.raw
  modified_base (396)..(396): a, c, t, g, unknown or other
  misc_feature (396)..(396): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctgggctgggtccggcagctcccgagggaagggctaggaatacagttggaagtgtctctcatagtgaggttcctattacagtccgtctctcaagagtcgagtcaccatatctctgacacgtccagcaatctagttttccctgaagtactgtagttctgtgaccgccgctgacacgggtctttaattactgtgcgagagacggntattatgtattttggagttggttatttcgactacctagagtcgacgggctcgacccgtgggaccagggaatacgtcgtcctaccgtctccgtacgtccctaccgaccgaacggtccacgttccggttcccttcccccgtcggtcccaccccgttcccgtaccctacggactacccg

SEQ ID NO: 141658 - DNA, 550 bp, Homo sapiens
  misc_feature: GYAE6OF02GOFQN.46.67.G01.1.454.CMB.1.raw
  modified_base (373)..(373): a, c, t, g, unknown or other
  misc_feature (373)..(373): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaggggctggaatacattggaagtgtctctcatagtggaggttcctattacagtccgtctctcaagagtcgagtcaccatatctctggacacgtccagcaatcagttttcccngaagatgacgttctgtcgaccgcgctgacgacgggtcgtttattctgtgcgagagacgctatatgtattttggagttggttatttacgactacctagtacgtccggacggggtctcggacccgtgggacccgagggtactacggtcggtacgtaccgtcgtccgttacgcctacccg

SEQ ID NO: 141659 - DNA, 530 bp, Homo sapiens
  misc_feature: GYAE6OF02HRN4R.46.67.G01.1.454.CMB.1.raw
  modified_base (356)..(356): a, c, t, g, unknown or other
  misc_feature (356)..(356): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtgggagacagtgtcaccatcacttgccgggcaagtcgaacattgacactatttaaatggtatcaacatagaccaggacggccctaagctcctaatctatgctgcatccagtttgcaaagtgggtcccatcgaggttcagtggcagtgatcgtgggaactagatttcactcncaccatcagtaatctagacaacgtgaagtattttagactaacttattacttagtacaacagtaattactaattgtttacggaccgtaaggacacgtaactaactaaaattaaacgaatgtagctagactaaccatctagttccttactacttcctacccgctaacttctagtac

SEQ ID NO: 141660 - DNA, 756 bp, Homo sapiens
  misc_feature: GYAE6OF02JY0QZ.46.67.G01.1.454.CMB.1.raw
  modified_base (195)..(195): a, c, t, g, unknown or other
  misc_feature (195)..(195): n is a, c, g, or t
tcagactagcagtacacgaccggtgctcgatttagagtatacatattgggtttggggagtctcggtcaggtacacagcatggacatgaggtcccgctcagctcctggggctcctgctactctggctccgaggtgccagatgtgacagtcgagctgacccagtctccatcctccctgtactgccaaccggtgggancagtcgtcaccatcacgttcgccgggataagtacggaactattggaaccacttaagttttaaatggtattaccgaactagtagaaccagggaaccggtacccccttaaagccttacctaactacctaacgtgtacctgtacccaagttccctaaggtttctaaccggtaaaacggttcggggtttacccaacgttaccggtaaacggttttcgaaaccgtttgggaccgtaacggggttaagttcgttacccgggaggggttaactaacgggtttactttaccgtaactccgttaacccggtaaccttactacgtttaacggtactttaccgtacgtaacgtaaccgtaacggtaagtttacgtttacgaacttaacctttagttacttacggtaactacgtaaacttaaacgtaacttaacgtttacgtttaaccgacgtaaacggtaacctaacggtaacttaaacgttaaactaaaccaacgttaagtacgtacgtactacgaacttacgtactacttacgtctaaccgttctacccgtataccgttacaggttaacc

SEQ ID NO: 141661 - DNA, 519 bp, Homo sapiens
  misc_feature: GYAE6OF02GYQQX.46.67.G01.1.454.CMB.1.raw
  modified_base (392)..(392): a, c, t, g, unknown or other
  misc_feature (392)..(392): n is a, c, g, or t
  modified_base (417)..(417): a, c, t, g, unknown or other
  misc_feature (417)..(417): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgacaaagtgggtcccatcgaggttcaggtggcagtgatcgtgggacagtatttcactctcaccatcagtaatctgacaacgtgaagtntttgactaacttattactgtacaanagtaattacaattgtttcggacaaggacacgataacaaattaacgaactgtagtctgacaacctatcttgtacttcgtacttccttcccgacctctctgtac

SEQ ID NO: 141662 - DNA, 557 bp, Homo sapiens
  misc_feature: GYAE6OF02IHYVI.46.67.G01.1.454.CMB.1.raw
  modified_base (290)..(290): a, c, t, g, unknown or other
  misc_feature (290)..(290): n is a, c, g, or t
  modified_base (336)..(336): a, c, t, g, unknown or other
  misc_feature (336)..(336): n is a, c, g, or t
  modified_base (362)..(362): a, c, t, g, unknown or other
  misc_feature (362)..(362): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgagggaaggggctggaatacattggaagtgtctctcatagtggaggttcctattacagtccgtctctcaaagngtcgaagtcaccatatctctgacacgtccagcaaatcagttttccngaaagtatgagttcctgtgacctcgntgacacgggtctttatactgtgcgagagacggctatatgtattttggattggttattcgacacctaagctcgacggggctaccgacccgtagggcccaagggaacttacgtgtaccaccggtctcttacgcccttaccgacgaacgggccacgtccggtccttccccgtcgcctacccgtcctaccgatacgccc

SEQ ID NO: 141663 - DNA, 708 bp, Homo sapiens
  misc_feature: GYAE6OF02HKFP3.46.67.G01.1.454.CMB.1.raw
  modified_base (96)..(96): a, c, t, g, unknown or other
  misc_feature (96)..(96): n is a, c, g, or t
  modified_base (197)..(197): a, c, t, g, unknown or other
  misc_feature (197)..(197): n is a, c, g, or t
  modified_base (238)..(238): a, c, t, g, unknown or other
  misc_feature (238)..(238): n is a, c, g, or t
tcagactagcagtacacgaccggtgctcgatttagagtatacatattgggtttggggagtctcggtcaggacacagcatggacatgaggtccccgntcagctcctggggctcctgctactctggctccgaggtgccagatgtgacatcgagctcgacccagtctccatccctccctgtctgacctaaccggtggganactagtgtccaccatcacttcggccgggcaagttccggaanagttgacctacttaagtttaaattcggtatacaaacatacgacgtaagggaccgacccctaagcctacctaattctatcgctcgctactcctagttcacgaaaggtcggtccagtcgaagttcaggtgctagtgagtcgtgggatagtattcactactaccgaccattacgtaatactactcgtaaccgtaaggtacgttaaagttactttacggtaacttaaacgttttaaacttaacgtttaacgttaacctaaacgtaaccgtaaaattttaccctaaaaggttttcggtttttaacccggaaccggtaaacgggtaacctaaaccggtaaaccttaaacgtaaaaactttaaaaccgaccgtttaacgggtactaccggttacgtaacgtaaccctacgttacgtttaccgttactttaaccttacgttaacccgttcccaccccgttaattccctaaggtaaccc

SEQ ID NO: 141664 - DNA, 697 bp, Homo sapiens
  misc_feature: GYAE6OF02IYNQ9.46.67.G01.1.454.CMB.1.raw
  modified_base (347)..(347): a, c, t, g, unknown or other
  misc_feature (347)..(347): n is a, c, g, or t
  modified_base (357)..(357): a, c, t, g, unknown or other
  misc_feature (357)..(357): n is a, c, g, or t
  modified_base (371)..(371): a, c, t, g, unknown or other
  misc_feature (371)..(371): n is a, c, g, or t
tcagactagcagtacacgaccggtgctcgatttagagtatacatattgggtttgtcctcctgctggtggcagctcccagatgggtcctgtccctggtgcaactgcaggagtcgggtccacgactggtgaggccttcggagaccctgtccctcacctgcgctgtctctggtgcctccatcagtagtggtttcttcgtgggctgggtccggcagctcccgagggaagggctggaatacagttggaagtgtctctcatagtggaggttcctagttcagttccgtctctcaagtgtcgagtccaacctatatctactggactacgtccagacaatctacgttttccagaanatgtagttcngttcgaccgccgtntgaccgtacggggtctttaattacgtgtgacgtaggaacgtacggtcttaattagtgttagttttgggtagtttggtttattttccgactaaccgttaagtacgttacgggtaccgggggtaccttccgggtaaccccggttcgggggacccgtaaacggggtaacttaccggttacggtacccgtaaccgttcccgttaccgtttaccggtcccttacccggtaacccggtaacccgggtaccctacggttaccccggtttcccttacccccggttcggtacccctacccccgtttcccgtaacccgtaacggacccgtacccgg

SEQ ID NO: 141665 - DNA, 556 bp, Homo sapiens
  misc_feature: GYAE6OF02G8YMO.46.67.G01.1.454.CMB.1.raw
  modified_base (284)..(284): a, c, t, g, unknown or other
  misc_feature (284)..(284): n is a, c, g, or t
  modified_base (339)..(339): a, c, t, g, unknown or other
  misc_feature (339)..(339): n is a, c, g, or t
  modified_base (345)..(345): a, c, t, g, unknown or other
  misc_feature (345)..(345): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccgcagcctcccgaggggaaggggctggaatacagttggaagtgtctctcatagtggaggttcctattacagtccgtntctcaagagtcgagtcaccatatctctggacacgtccagcaatctagttttcccngtaagntgagttctgtcgaccgccgctgacgacgggtctttaatactgtgcgagagacgtctattatgttattttggagttgttattcgactacctagatcggacgggctccgcccgtgggccgagggaatcgtgtcaccgtctaccttcgcctccaccgtacggccctagtccggtcccttccccgtcggccctaccctccctacacgcgtacccg

SEQ ID NO: 141666 - DNA, 792 bp, Homo sapiens
  misc_feature: GYAE6OF02J3EI0.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcggcccagactggtgaggccttcggacgaccctgtccctcacctgccgctgtctcgtggtcgtcctccactctagtacgttgggttttccttccggtggggtccgttcggggttcccgggaccgtaacggtccttacccccggtaagggggaaacgggggtccttagggtaaacttaacgtaggtttagggaacggttcggtccttacctacgtaagttaacgggtcgggtaacggttcccttagttaaccgacggtccgttacctcgttacgaaagtcggttacgacgtccgtaaccattaactccgtgtacggaccgtaccgtcaacgcgtaaacttccgttacgtttcccagaagtcgtgtacgtcgtggtaccgcccgtacggcttacggaaccgtacggggtttcctttaataccgtggtcgtaccggtaggtacgtaccgggttactttaacgttgttacggtttacggttttgggtacgttagtttaccgtacgtaacccgtacgttaggaccgtcgggtacccgggtaccttccggaacccgggttgggactaacgggtaacgtcgtccgtctacccgtcgtcgtaccgtacccgactacccgggaacggtccacgttcccgttacccgtccccgttacggccccttacctccggtacccagtacccgtccgg

SEQ ID NO: 141667 - DNA, 570 bp, Homo sapiens
  misc_feature: GYAE6OF02G23TD.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattgtatcaacatagaccagggacgcccctaagctctaatctatgctgcatccagtttgcaaaggtcgggtcccatcgaggttcagtggcagtgatcgtggacagtatttcactctacacatctagtatctagacaacgtgaagtatttgactaacttattacttgtaccaactagtaaactttactaagtttcgtttaccggaacctaagggtaccaacgtaactaaacgtaaaacgttaaacgaacgttagtacgtactacgaccgtaacctattaccttcgttaccttactacttccgttacccgacctacttacgtagtaacg

SEQ ID NO: 141668 - DNA, 556 bp, Homo sapiens
  misc_feature: GYAE6OF02HRKZJ.46.67.G01.1.454.CMB.1.raw
  modified_base (248)..(248): a, c, t, g, unknown or other
  misc_feature (248)..(248): n is a, c, g, or t
  modified_base (320)..(320): a, c, t, g, unknown or other
  misc_feature (320)..(320): n is a, c, g, or t
  modified_base (328)..(328): a, c, t, g, unknown or other
  misc_feature (328)..(328): n is a, c, g, or t
  modified_base (433)..(433): a, c, t, g, unknown or other
  misc_feature (433)..(433): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccgnagcctccgagggaaggggctggaatacgattggaagtgtctctcatagtggaggttcctattacagtccgtntctcaagngtcgagtcaccatatctctggactacgtccagcaatctagttttcccagaagtatgatttctgtgacccgtccgctgacgtacgggtctttatacgtgtgcgagngacgctattatgtattttggagttggtttattcgactacctagacgttacggacggggtctacccggacccggtcgggaccagggtactacgtggtccaccgttcctaccgttcgccctaccg

SEQ ID NO: 141669 - DNA, 560 bp, Homo sapiens
  misc_feature: GYAE6OF02G5UFY.46.67.G01.1.454.CMB.1.raw
  modified_base (334)..(334): a, c, t, g, unknown or other
  misc_feature (334)..(334): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttcccngaagatgagttctgtcgaccgcgctgacacgggtcgtttattacgtgtgcgagagacggctattatgtattttggagttggttatttcgactaccctagatcggacggggtctccgacccgtggggccagggatacgtggtccaccgtctccttagcccttcaccgaacgggccctagtccggtcccttccccgtcggccctaccctccctaccgagtactacccg

SEQ ID NO: 141670 - DNA, 784 bp, Homo sapiens
  misc_feature: GYAE6OF02JTSSV.46.67.G01.1.454.CMB.1.raw
tcagactagcagtacacgaccggtgctcgatttagagtatacatattggtttggggtaccgtcctgtgcaagaacatgaagcacctgtggtttgtcctcctgctggtggcagctcccagatgggtcctgtccctggtgcaactgcaggagtcgggcccagactggtgaggccttcggagaccctgtccctacacctgcgcctgtctctggtcgcctccatcagtagttggtttctcgtggggctggggtccggcaagcctccgagggtacggggctggaagtccgagttggaacgtgtctcgtacatagtcgggtaggttccttaagttactaggttcccggttcttccgtactaaacggacgttacgaacgttccgaaccctattaactccttcgtaggtacctacggttccgacgtacgtaaacttcgttaaccgtttttccccgaggaaacgttagtaccggttaagtttccttaggtacggtaccccgtccggtacgttccgaaccgtaccggggttaccttttaagttaaccgttggtttacggacgtaacggtacggacgttacgttaacgttcgttaggtttaagttttcgggtaaggttttcgggtttaacgttttaccgtacccgttaacccttaacgggtattacccgggggaccggggttaccggttccgtaacccccggggttggggtccccgtaaggggtaaccgtttacggggtaaccggtttccgaacccggttaccccgttcgtttaacccggccccgttaaccccgg

SEQ ID NO: 141671 - DNA, 573 bp, Homo sapiens
  misc_feature: GYAE6OF02JJOLR.46.67.G01.1.454.CMB.1.raw
  modified_base (191)..(191): a, c, t, g, unknown or other
  misc_feature (191)..(191): n is a, c, g, or t
  modified_base (216)..(216): a, c, t, g, unknown or other
  misc_feature (216)..(216): n is a, c, g, or t
  modified_base (291)..(291): a, c, t, g, unknown or other
  misc_feature (291)..(291): n is a, c, g, or t
  modified_base (372)..(372): a, c, t, g, unknown or other
  misc_feature (372)..(372): n is a, c, g, or t
  modified_base (390)..(390): a, c, t, g, unknown or other
  misc_feature (390)..(390): n is a, c, g, or t
  modified_base (398)..(398): a, c, t, g, unknown or other
  misc_feature (398)..(398): n is a, c, g, or t
  modified_base (405)..(405): a, c, t, g, unknown or other
  misc_feature (405)..(405): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgganacagtgtacaccatcacttgccggnaagtcggaacattgaccacctaattaatggtatcaactatagactagggacgcccctaagctccaatctatgctncatcagttcgacaaggtcggtccatcggtaggttcagtggtcgagtggtagtcgtgggactagtacttcactctacactanactttacgaattctacgnaaccggtnaacgttnttacgataacttatacttagactaaagattaattagtaagttcgttacgaaccgaagggtacctaacgttaaccgtaataaaacgttaaaccgaagttcggttaacggtcacggtaccaaacgtacttacgtcgtaacttcactacctttcccgactatcttcgtaac

SEQ ID NO: 141672 - DNA, 600 bp, Homo sapiens
  misc_feature: GYAE6OF02HHUKI.46.67.G01.1.454.CMB.1.raw
  modified_base (513)..(513): a, c, t, g, unknown or other
  misc_feature (513)..(513): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtgggctgggtccgcagctccgagggagggctggaatacattggagtgtctctcataggtggaggttcctattacagtccgtctctcaagagtcgagtcaccatactctctggaccacgtccagcaatctacgttttcccagaagatgagttctgtcgaccgccgtctcgacgacgggtcttttattccgtgtgcgagtagacggtcttattatgttattttggagttgttagttcgactacctagacgtcggacggggtctccgacccggtcggggccaagggtactacgttcggtcctaccgtccgttccgttaccnccctaccacccggaacggtccccgagtcccggttccctttcccccgtacggcccctaccccgttccccgaccgtacgacgtaccccg

SEQ ID NO: 141673 - DNA, 627 bp, Homo sapiens
  misc_feature: GYAE6OF02F46CX.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtccctcacctgcgctgtctctggtgcctccatcagtagttggtttcttcgtggggctgggtccgcagcctccgaggggagggctggaatacagttggaagtgtctctcagtagtggaggttcctattacagtcctctctcaagagtcgagtcaccatatctcgtggacaccgtccagacaatctacgttttcccagaagatgagttctgtcgaccgcgctgacgcggtctttatactgtgcgagagacgctattatgttatttggagttggtttacttcgactaccgtagacgtcgggacgggtcctaccggcccggtaggggccgtaaggggaaccttacggtcgttacccgtacccgttaccgttacccgttaccgcccttaccccgaaccggtaaccgggcccctaaccggttcccggttccccttcccccggtcggaccccctaccccgttaccctacccgtacgacgtacccccg

SEQ ID NO: 141674 - DNA, 566 bp, Homo sapiens
  misc_feature: GYAE6OF02HQCFY.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagcctcccgaggggaaggggctggaatacagttggaagtgtctctcatagtggaggttcctattacagtccgtctctcaagagtcgagtcacatatctctgacacgtcagcaatctacgtttcccagaagatgtagttctgtcgaccgtcgctgacgacgggtcgtttatacgttgtgcgagagacgtctagttatgttatttttggagtttgttagtttcgactaccgtaagtacgtcggacggggtctccggacccgtggggaccgagggtaattaccgtcggtccgaccgttcctaccgttacgccctacccg

SEQ ID NO: 141675 - DNA, 540 bp, Homo sapiens
  misc_feature: GYAE6OF02G596J.46.67.G01.1.454.CMB.1.raw
  modified_base (286)..(286): a, c, t, g, unknown or other
  misc_feature (286)..(286): n is a, c, g, or t
  modified_base (332)..(332): a, c, t, g, unknown or other
  misc_feature (332)..(332): n is a, c, g, or t
  modified_base (336)..(336): a, c, t, g, unknown or other
  misc_feature (336)..(336): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctgggctgggtccggcagctcccagggaagggctggaatacattggaagtgtctctcatagtggaggttcctattacagtccgtctctcaagngtcgagtcaccatatctctggacacgtccagcaatcagttttcccngaantgattctgtcgaccgtcgctgacacgggtctttaatactgtgcgagagacggctatatgtattttggagttggttattcgtacaccgtagactcggacggggctcgacccgtgggcagggatcgtgtcaccgtctccttcgccctccaccgacggccctagtccgtccttccccgtggccctaccctcctaccacgcgtacccg

SEQ ID NO: 141676 - DNA, 578 bp, Homo sapiens
  misc_feature: GYAE6OF02F5BP1.46.67.G01.1.454.CMB.1.raw
  modified_base (348)..(348): a, c, t, g, unknown or other
  misc_feature (348)..(348): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacaccttatttaaattggtatcaacatagaccagggacgcccctaagctcctaatctatgctgcatccagtttgactaaagtgggtacccagtcgaggttcagtggcagtggatcgngggacagtattacactctcacatcagtaatctgacaacgtgaaagtattttagactaacttattactagtacaaactagtaaattactaattcggttttacggaccgtaagggtaacctaacgtaacttaaacaaaacgttaaaaccgtaacgttagtacggacttagaccgtaacctattaccgtgttaccttactacttccttaccccgacctacttactagtaaccg

SEQ ID NO: 141677 - DNA, 597 bp, Homo sapiens
  misc_feature: GYAE6OF02GC7C7.46.67.G01.1.454.CMB.1.raw
  modified_base (220)..(220): a, c, t, g, unknown or other
  misc_feature (220)..(220): n is a, c, g, or t
  modified_base (592)..(592): a, c, t, g, unknown or other
  misc_feature (592)..(592): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtcctgcaaccggtgggagacagtgtcaccatcacttgccgggnaagtcggaacattgacacctatttaaatggtatacaacatagaccagggaccggcccctaagctcctaatctatgctgcacttcctagtttcgacgtaaaggtcggggtacccagtccggtaggtttcaggtggacgtaggtggatcgtagggactagtactttcactctaccactatacagtatcgtgactaacgtagtaagtatttcgactaacttattacttagtacaacgtaataacttactaagtttcgtttacggaccgtaaggtacaacgtaactaaactaaacgttaaacgaacgttgacggtactacgctaaccctattaccttagttccttactacttccgttacccgtactacttacgttntaacg

SEQ ID NO: 141678 - DNA, 648 bp, Homo sapiens
  misc_feature: GYAE6OF02F2PHA.46.67.G01.1.454.CMB.1.raw
  modified_base (193)..(193): a, c, t, g, unknown or other
  misc_feature (193)..(193): n is a, c, g, or t
  modified_base (219)..(219): a, c, t, g, unknown or other
  misc_feature (219)..(219): n is a, c, g, or t
  modified_base (348)..(348): a, c, t, g, unknown or other
  misc_feature (348)..(348): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgtcaccatccacttgccgggnaagtcggaacattgacacctatttaatggtatcaacatagaccgaggaccggccctaagctactaatctatgctgctatcagtttgacgaagtcgggtaccagtcgagttcagtgcagtgatcgagganagtattcactctcactatacgtagtatctcgtacaacgtagtaagtagttttcgacttaacttagttactagtactaacgtaacgttaaacttactaacgtttacggtttaccggaacgttaaccgggtaaaccttaaccggaacctttaaaactaaaaacgtttaaaaccgggtaaaccgtttaggtaaccggttcgttaacggtaccctaaacccgttaattacccggttaagtttaccctttaaccgtaacttttccccggttaaccccggtaccctacgtttacccgtagtaaccg

SEQ ID NO: 141679 - DNA, 627 bp, Homo sapiens
  misc_feature: GYAE6OF02I2MMA.46.67.G01.1.454.CMB.1.raw
  modified_base (206)..(206): a, c, t, g, unknown or other
  misc_feature (206)..(206): n is a, c, g, or t
  modified_base (367)..(367): a, c, t, g, unknown or other
  misc_feature (367)..(367): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtgttcttctgggctgggtccgnagctccgagggagggctaggaatacgagttggaagtcgtctctcatagtggtaggttcctattacgacgtccgtctctacaagagtcgagtcaccatatctctgacctacgtccagacaactctagttttcccagaagatagagttctgtcgaccgccgtntacgacgtacggtctttattacgtgtgcgagacgtacggtctagttatgttagttttggagtttgttactttcgactacctagacgttcgggacgggcctaccggacccgttcggggacccgtagggtaactaccgtggtcctaacccggttccttaccgtacgtccctaccgaacccgtaacgggtcccctaaggtcccggttccccgttacccccgtcggtacccctaccccgttccctacccgacgtaccgtacccg

SEQ ID NO: 141680 - DNA, 695 bp, Homo sapiens
  misc_feature: GYAE6OF02ITT59.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtggagacagtgtacaccatcacgttgccgggactaaggtcggaaacattcgactaccttaatttaaacttggtaatcaaacatagaaccgagggaccggacccctaagcctacctaatctaatcgctagctatccgtagtttcgacgtaaacggtcgggtacccaagttcggtaaggttcgaagttgggactaggtggaacgtcgtagggactaggtactttacgtacgtccgtacaaccgtattaccgaagtaacgttcgttacgacgtaaacggttagtaaagttacgttttacgaaccgtttaaactttactttaacgttacggttaactaaacgtaacgttaaactttaactaaacggtttcggttttacggaaccgtaaacgggtactaacggtaactaaactaaaacgttaaacgaacgttacgtacggtacgtacgaccgtaacttatcttaacgttcttaccgtacttacccgttacccgacgtactttaccgtataaccgg

SEQ ID NO: 141681 - DNA, 660 bp, Homo sapiens
  misc_feature: GYAE6OF02H37ZA.46.67.G01.1.454.CMB.1.raw
  modified_base (252)..(252): a, c, t, g, unknown or other
  misc_feature (252)..(252): n is a, c, g, or t
  modified_base (292)..(292): a, c, t, g, unknown or other
  misc_feature (292)..(292): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtcgcctcatcagttagtggttttctcgtggggctgggtccggnagctcccgagggagggctggaatacagttggaagtgtctntcattagtggtaggttccttattacagtccgtctctcaagagtcgagtcaccattactctctggacacgccagcaatctagttttcccagaatatgtagtttctgtacgacccgtccgtcgtacgaccgtaccgggttacgttttaagttacgttggttacgacggtaaggacgtacgggtacttaagtttagttagtttagttttttacgggagttttaggttttacgtttaccgacctaaccgttagtacgtaccgggtaccgggggtccttcccggaaccccggttcggggaccggaagggttaacgtaccggttcgggttaccctacccggttcctttacccgttaccggtccccgtaaccccg

SEQ ID NO: 141682 - DNA, 719 bp, Homo sapiens
  misc_feature: GYAE6OF02IC108.46.67.G01.1.454.CMB.1.raw
tcagactagcagtacacgaccggtgctcgatttagagtatacatattgggtttggggagtctcggtcaggacacagcatggacatgaggtccccgctcagctccgtggggctcctgctactctggctccggaggtgccagatgtgacatcgagctgacccagtcctccatcctccctgtctgcaaccgtggagacagtgtacaccatcacttgccgggacaagtcggaacatgacactaatttaatgtatacaacatacgaccgtagggaccgcccctaagcctacctaatctaatcgcttcgactactaccgtagttttcgactaaaagggtcgggtaccctaagttcggtaggtttcgaacggttcggaccgtaggttacggaacgtaccggttaggggaactaagggtaacttttcccgaaacgtttcgtaccgtaaccctagtaccgtaaggttaaactcgtacgtaccgtaaacgtaggtaagttagtttacgacttaactttacttaccgtagtacctaaataacggttaaattaacgtaactttacggttttaccggaacgtaaaggggtaacctaaccggtaaactaaacgttaaaacgtaaaccgtaaagttcgggttaaccggtacgtaccgacctaaacctagttccgtttacgtaacctttccttaagttccccgttacccgtacctaacgttacgtagtttaaccg

SEQ ID NO: 141683 - DNA, 552 bp, Homo sapiens
  misc_feature: GYAE6OF02GSK3G.46.67.G01.1.454.CMB.1.raw
  modified_base (523)..(523): a, c, t, g, unknown or other
  misc_feature (523)..(523): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattgtatcaacatagaccagggacggcccctaagctcctaatctatgctgcatccagtttgacaaaggtgggtcccatcgaggttcagtggcagtggatcgtgggacagtactttcacttctcaccatcagtaatctagactaacgtgaagtattttacgactaacttattacttagtacaactaagtaattacaattgtttacgacgtaagggacaacgtaactaactaaaattaaacgaactggtacggactaggacctactattcgtagttaccttntacttcccttcccgacctattcagtaacc

SEQ ID NO: 141684 - DNA, 648 bp, Homo sapiens
  misc_feature: GYAE6OF02JTWUD.46.67.G01.1.454.CMB.1.raw
  modified_base (228)..(228): a, c, t, g, unknown or other
  misc_feature (228)..(228): n is a, c, g, or t
  modified_base (338)..(338): a, c, t, g, unknown or other
  misc_feature (338)..(338): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctagcaaccgtggagacagtgtcaccagtcacttgccgggtcaagtcgaacnttgacactatttaaactggtatcgaacatagaccagggaccgccctaagctctaatctatgctagcactccagttgactaaggtcggtaccagtcgagttcagtgctagngtatcgtaggacagtcttcactctacgacctatacgtagtaactcgtagactaacggtagtaagttacgtttagacttaacttagttactacgttacgaaacgttagtaaacttaacgttaacgtttacggtttacggaacccgtaaagggtaccaaaccggtaacttaaaaccgtaaaacttaaaccggtaaccgtttaacgggtacgtaccgttaacgggtaaccctaaccgtaacttccgttaaccgttaccgtttacctaccgtttaccggttaccccttaccgtaactttacccgtagttaaccc

SEQ ID NO: 141685 - DNA, 618 bp, Homo sapiens
  misc_feature: GYAE6OF02GTTJC.46.67.G01.1.454.CMB.1.raw
  modified_base (337)..(337): a, c, t, g, unknown or other
  misc_feature (337)..(337): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgaggggaagggctggaatacattggaagtgtctctcatagtggaggttcctattacagtccgtctctcaagagtcgagtcaccatatctctggacacgtccagcaatctacgttttcccngaagatgagttctgtcgaccgcgctgacgacgggtcttttatactggtgcgagacggacggtcttattagtgttagtttttgggagtttaggtttagtttaccgtaccgtaccctagtacgtccgggacggggtccgtcccggtacccggtcggggacccgaacggggtaactacgtcggtcctacccgtcgtccgttacgccctccgaccgaacgggtccctacgtcccggttcccttcccccgtcggtccctaccccgttcccaccgacgacgtacccg

SEQ ID NO: 141686 - DNA, 829 bp, Homo sapiens
  misc_feature: GYAE6OF02JWIE8.46.67.G01.1.454.CMB.1.raw
  modified_base (171)..(171): a, c, t, g, unknown or other
  misc_feature (171)..(171): n is a, c, g, or t
  modified_base (195)..(195): a, c, t, g, unknown or other
  misc_feature (195)..(195): n is a, c, g, or t
  modified_base (208)..(208): a, c, t, g, unknown or other
  misc_feature (208)..(208): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttctcgngggctgggtccgnagcctccgagggagggctggaatacagttggaagtgtctacgtcagtagtggacgttccattacagtccgtactctcaagagtcgagtccactatactctcgtggactacgtcagtcaactccgtagttttcccagaactatacgtacgttccgtacggtcgtaacccgtcgtactacggaacgtaccggggttacgttttaacttaacgtggtttacggacggtaaggtacggtaaccgggtactttaacgttaacgttaggtttaagtttttacggggtaaggttttcggtttaacgtttaccggttaaccgtaacccgtttaggtaaccgtttaccggggtaaccggggttacccgttacccgggttaaccccgggtacggggggtaaccccggtaaaggggttaaaccgtttaccggttaccgggttacccgtaacccggttaccgttacccgtttaccgtaccccggtacccgttaacccggaaacccggggttaccccgttaaccggttaccccggggtttaccccctttacccccgggtacccgggttacccccgttaaccccccggtttaccccgtaacccgggttaaacccggtacccggttaacccccggg

SEQ ID NO: 141687 - DNA, 691 bp, Homo sapiens
  misc_feature: GYAE6OF02JXV37.46.67.G01.1.454.CMB.1.raw
  modified_base (224)..(224): a, c, t, g, unknown or other
  misc_feature (224)..(224): n is a, c, g, or t
  modified_base (389)..(389): a, c, t, g, unknown or other
  misc_feature (389)..(389): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccggtgggacgacagtgtacaccatcacttcggccggganaagtcggaacattgactactaattttaatgtatacaacatagaccgaggaccgacccctaagcctacctaatctatacgctgacactcctagtttacgacgaaacggttcggggtaccctagttacggacggtttacgacggttcggacgagtagggtattcggngggtaccgtaagtacgtttacctacgtacttaccgaaccattacgtaacgttaattccgtacgactaacggtagttaaacgttatttcgtaaacccttaacttttacgttacgttacgttaacaacgttaagtaaacctttataaacgtttcgtttaacggaaccgaagggtaacccgaacgttactaaacgttaaaacgttaaaccgtaagtcgtacgaccgtacgtacgtaaccctagttaccttaacgttcgtttacctacgtttacccgtacccgtacttaccgtcttacgttaaccg

SEQ ID NO: 141688 - DNA, 665 bp, Homo sapiens
  misc_feature: GYAE6OF02JINKD.46.67.G01.1.454.CMB.1.raw
  modified_base (192)..(192): a, c, t, g, unknown or other
  misc_feature (192)..(192): n is a, c, g, or t
  modified_base (255)..(255): a, c, t, g, unknown or other
  misc_feature (255)..(255): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattcgactacctatttaatggtatcaanatagaccagggaccgaccctaagcctctaatctatgctgcatcctagtttcgacaaaggtcgggtacccagtcgaggttcagtcggacagtcggatcgtgggactaggtactttcgaccttctaccaccgtaactcgaagttaactcgtagtaccgtaaacggttggtaaacgttattttacgaacgtaaaccttttacgttaccgttacgtaaccgtaaacgttaaggtaaactttaccgtaatttacggttttacccgggaaccgaaacgggtacctaaaccggtaaccttaaacttaaaaacgttaaacccgtaagttacggtacgtaccgtacggacctaaccgttacttcgttaccgtacttttaccacctttacccgttacccgacctaagttcctaggtaacc

SEQ ID NO: 141689 - DNA, 565 bp, Homo sapiens
  misc_feature: GYAE6OF02F2ZZW.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttgccgggcaagtcggaacattgacacctatttaatgtatcaacatagaccagggacggcccctaagctcctaatctatgctgcatccagtttgcaaagtgggtcccatcgaggttcagtggcagtggatcgtgggacagtattcactctcacatcagtatctgcaacgtgaagtattttagactaacttattactgtactaacagtaattactaattcgttttacggacctaacgggacctaacggtaacttaacgtaaaattaaaccggaacttagtaggtactagaccgtaacctaacttaccgtacgttaccttacgtacttccttaccccgacctacgttcctacgtaacg

SEQ ID NO: 141690 - DNA, 630 bp, Homo sapiens
  misc_feature: GYAE6OF02IK8LI.46.67.G01.1.454.CMB.1.raw
  modified_base (254)..(254): a, c, t, g, unknown or other
  misc_feature (254)..(254): n is a, c, g, or t
  modified_base (325)..(325): a, c, t, g, unknown or other
  misc_feature (325)..(325): n is a, c, g, or t
  modified_base (382)..(382): a, c, t, g, unknown or other
  misc_feature (382)..(382): n is a, c, g, or t
  modified_base (407)..(407): a, c, t, g, unknown or other
  misc_feature (407)..(407): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggcctttcggagaccctgtccctcacctgcgctgtctctggtgcctccatcagtagttggtttcttcgtggggcttgggtccggnagcctccgagggaaggggctggaatcattggaagtgtctctcatagtggtagttcctattacagtcccgtntctcaagagtcgagtcaccatatctcgtggacacgtcagacatctagttttccaganagtgtagtttctgtcgaccgccgtntaggaccgtacgggttcgttttatacgtgttggacggtaggacgtacggtctagtttagtgttagtttttgggagtttggttttaacgtttccgaccgttaaccgtacgtacgttcgggtaccgggggtcctcccgggaccccgttgggggtacccaaggggttactaccggttcggtacccgtaccggtttcccgttaccgttaccgtacccttaaccccgg

SEQ ID NO: 141691 - DNA, 561 bp, Homo sapiens
  misc_feature: GYAE6OF02H3OSR.46.67.G01.1.454.CMB.1.raw
  modified_base (173)..(173): a, c, t, g, unknown or other
  misc_feature (173)..(173): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggcctttcgggagaccctgtccctcacctgcgctgtctctggtncctccatcagtagtggtttcttctggggctgggtccgcagctccagggagggctggaatacattggaagtgtctctcatagtggaggttcctaattacagtccgtctctcaagagtcgagtcaccatatctctggacacgtccagcaatctagttttcccagaagatgagttctagtgaccgcgctgacacggggtcttttatactgtgcgagagcggctatatgtattttggagttggttatttcgactacccgtagtactcggacggggctacggacccgtggggaccaggggaactacgtcgtcacgtctccttagccctccgaccgaacggccctagtccggtccttccccgtcggtccaccccgttcctcctacgacgtaccg

SEQ ID NO: 141692 - DNA, 629 bp, Homo sapiens
  misc_feature: GYAE6OF02I4PLM.46.67.G01.1.454.CMB.1.raw
  modified_base (152)..(152): a, c, t, g, unknown or other
  misc_feature (152)..(152): n is a, c, g, or t
  modified_base (243)..(243): a, c, t, g, unknown or other
  misc_feature (243)..(243): n is a, c, g, or t
  modified_base (343)..(343): a, c, t, g, unknown or other
  misc_feature (343)..(343): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctnacctgcgctgtctctggtgcctccatcagtagtgtttctcgtgggctgggtccgcagctccgagggagggctggaatacattggatgtctntcagtagtggtacggttctatacagtccgtctctcaagagtcgagtcaccatatctcgtaggactacgtccagacaactctacgttttacccagtaagtntcgtagttcgtggtcgacgcctcagacgtacgggttcttaacttacgtgttgacgtagaaggtacgtattattagtgttatttggttagttaggttatttaccgtactacccgttagtcgtacggtaccgggtcgtaccgtacccggtacgggacgtaacggtaacttacggtcgtaccgtacgtccgtaccgtacgtcccgtaccgtaccgaaccgggtcctaaccggtccggttaccccgtcccgttacggccctacccgttacccaccgtacgaccgtacccg

SEQ ID NO: 141693 - DNA, 663 bp, Homo sapiens
  misc_feature: GYAE6OF02IL9UO.46.67.G01.1.454.CMB.1.raw
  modified_base (209)..(209): a, c, t, g, unknown or other
  misc_feature (209)..(209): n is a, c, g, or t
  modified_base (361)..(361): a, c, t, g, unknown or other
  misc_feature (361)..(361): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggttcttcgtgggctgggtccggnagctccgagggaagggctggaatacagttggaagtgtctctcagtagtggagttcctattacgagtccgtctctacgaaggtagtcgaagtccacctaatagtctacgtcggaacacgtcaagctaaatccgtaacgttttcccagaaagtntgtaagttctgtacgacccggtcgacttggaccgtacggggttcttttatacgtgtgcgtagagacggtactagttatgttagttttggagttggttattccgaactaccgtagtacgtacggacggggtcctaccggtaccccgtgggacccgtaaggggtaacctttacgtcgggtaccctaaccgttccgtaccgttaaccgccctacggaacccgtaaacgggcccctaggttaccccggttcccgttcccccgtacggacccctaccccgttaccctacggaacggtccgtaacccg

SEQ ID NO: 141694 - DNA, 589 bp, Homo sapiens
  misc_feature: GYAE6OF02GE4PP.46.67.G01.1.454.CMB.1.raw
  modified_base (337)..(337): a, c, t, g, unknown or other
  misc_feature (337)..(337): n is a, c, g, or t
  modified_base (341)..(341): a, c, t, g, unknown or other
  misc_feature (341)..(341): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgaggggaaggggctggaatacattggaagtgtctctcatagtggaggttcctattacagtccgtctctcaagagtcgagtcaccatatctctggacacgtccagcaatcagttttcccngaanatgagttctgtcgaccgccgctgacgacgggtctttattacgtgtgacgagaggacggtctatttatgttagttttggagtttggttactttcgactacccttagacgtcggacggggtctccggacccgtggggaccagggtactacgtgtacctaccgtcctccgttagccctacaccggaacggccctacgtccggttcccttccccgtcggccctaccccgttcctacccgtaacgcgtacccg

SEQ ID NO: 141695 - DNA, 610 bp, Homo sapiens
  misc_feature: GYAE6OF02JK5HZ.46.67.G01.1.454.CMB.1.raw
  modified_base (300)..(300): a, c, t, g, unknown or other
  misc_feature (300)..(300): n is a, c, g, or t
tcagactagcagtacacgaccggtgctcgatttagagtatacatattgggtttggggtaggtctcggtcaggacacagcatggacatgagggtccccgctcagctcctggggctcctgctactctgctccgaggtgccagatgtgacatcgagctgacccagtctccatcctccctgtctgcaaccgtgggagacagtgtcaccatcacttgccgggacaagtcggaacattgacacctattaaatgtatcaacatagaccaggacgccctaagctcctaatctatgctgcatcgagttnacaagtcgggtccagtcgtacggttcgagtgactaggtcgtagtcgtggacagtacttacacgttctaccaccgtaactcgtaagtactctcgactaacggtagtaagtatttagacttaacttattaacttcgtacaaacgtagtaattactaaatttgttttaccggaccgtaaacgggtaacaaccggttaaccttaacgtaaaaacgttaaaccgtaaacgtggttacgtagttaccgacgtaaccgtataccgttactaccgtttactaccgttcccgtttaacccgccctagttcctactaacg

SEQ ID NO: 141696 - DNA, 564 bp, Homo sapiens
  misc_feature: GYAE6OF02HZR2X.46.67.G01.1.454.CMB.1.raw
  modified_base (219)..(219): a, c, t, g, unknown or other
  misc_feature (219)..(219): n is a, c, g, or t
  modified_base (349)..(349): a, c, t, g, unknown or other
  misc_feature (349)..(349): n is a, c, g, or t
  modified_base (415)..(415): a, c, t, g, unknown or other
  misc_feature (415)..(415): n is a, c, g, or t
tcagactagcagtacacgaccggtgctcgatttagagtatacatattggggtttggggagtctcggtcaggacacagcatggacatgagggtccccgctcagctcctgggggctcctgctactctggctccgaggtgccagatgtgacatcgagctgacccagtctccatcctccctgtctgcaaccgtgggagacagtgtcaccatcacttgccgggnaaggtcgaacattgacactatttaaatgtatcaacatagaccaggacgcccctaagctcctaatctatgctgcatccagttttgactaaaggtcgggtcccagtcggtaggttcagtggcagtggatcgngggacagattcactctcacatcagtatctagcaacgtagaagtatttgactaacttattactgtanaacagtaattacaattgtttacgacaagggacacgaactaactaaacttaaacgtaaccgttaggtacggtactacggtaccaactacttcgttacgtttaccttaccgtacttcccgttaccccgtaccgtacttccgttacgtaacc

SEQ ID NO: 141697 - DNA, 600 bp, Homo sapiens
  misc_feature: GYAE6OF02JYVSJ.46.67.G01.1.454.CMB.1.raw
  modified_base (174)..(174): a, c, t, g, unknown or other
  misc_feature (174)..(174): n is a, c, g, or t
  modified_base (191)..(191): a, c, t, g, unknown or other
  misc_feature (191)..(191): n is a, c, g, or t
  modified_base (218)..(218): a, c, t, g, unknown or other
  misc_feature (218)..(218): n is a, c, g, or t
  modified_base (229)..(229): a, c, t, g, unknown or other
  misc_feature (229)..(229): n is a, c, g, or t
  modified_base (480)..(480): a, c, t, g, unknown or other
  misc_feature (480)..(480): n is a, c, g, or t
  modified_base (582)..(582): a, c, t, g, unknown or other
  misc_feature (582)..(582): n is a, c, g, or t
tcagactagcagtacacgaccggtgctcgatttagagtatacatattgggtttgggagtctcggtcaggacacagcatggacatgagggcccccgctcagctcctggggctcctgctactctggctccgaggtgccagatgtgacatcgagctgacccagtctccatcctcccngtctgcaaccgtggganacagtgtcaccatcacttggccggganaagtcggaacnttcgaccactattttaaatggtatcaacatagaccagggacggcccctaagctacctaatctatcgtactcgctactcctaagtttcgacgtaacggttggggtaccccagtcgtacggtttacaggttcggtactaggttcggaatcggttacgggacgtacgtagtttaccgtactccgtccaacctactacgtaagtaacgttctaggacctaacgtacgtagttatttagactaactttagtacttntacgaatagtatacaattgtttacgacagggtactacgactaaacgtaacttaaacgattcgagtactagacctactaagttctcgttacctatacgttacncccgtacagttctattac

SEQ ID NO: 141698 - DNA, 581 bp, Homo sapiens
  misc_feature: GYAE6OF02GEDY1.46.67.G01.1.454.CMB.1.raw
  modified_base (428)..(428): a, c, t, g, unknown or other
  misc_feature (428)..(428): n is a, c, g, or t
tcagactagcagtacacgaccggtgctcgatttagagtatacatattgggtttggggagtctcggtcaggacacagcatggacatgagggtccccgctcagctactggggctcctgctactctggctccgaggtgccagatgtgacatcgagctgacccagtctccatccctccctgtctgcaaccgtgggagacagtgtcaccatcacttgccgggcaagtcggaacattgacacctatttaaatggtatcaacatagacagggacgcccctaagctcctaatctatgctgcatcctagtttgacaaagtcggggtcccagtcgtaggttcgaagtggcaggtggtatcgtagggacagtatttcactctaccacatacagtaatcgtgactaacgtagaagttatttagacttaaacttattactntacctaaactaagtaaattactaagtttcgtttaccggacgtagggtaacacgtaacttaacgtaaaatttaaacgaacgttagtacgtacgttcaacgtaaccattacttacgttccttactactaccgtttaccccactacttctgttaac

SEQ ID NO: 141699 - DNA, 558 bp, Homo sapiens
  misc_feature: GYAE6OF02JXH68.46.67.G01.1.454.CMB.1.raw
  modified_base (192)..(192): a, c, t, g, unknown or other
  misc_feature (192)..(192): n is a, c, g, or t
  modified_base (228)..(228): a, c, t, g, unknown or other
  misc_feature (228)..(228): n is a, c, g, or t
  modified_base (303)..(303): a, c, t, g, unknown or other
  misc_feature (303)..(303): n is a, c, g, or t
  modified_base (516)..(516): a, c, t, g, unknown or other
  misc_feature (516)..(516): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacnttgacacctatttaaattgtatcaacatagaccagggacgcccctaagctcctaatctatgctgcatccagtttncaagtgggtccatcgaggttcagtggctagtgatctgggacaggtatttcactctcaccatctagtaatctgacaacggtgaagtattttagactaactttagttactgttaacaacgtaagtaaacttaacgtaatttcggtttaccgaccgtaaaggtaccacgtaacttaaacgtaaaattaacgaactgtacgatgaccgtaactactntacgttcttacgactttccgtcccgacttacttccgtagtac

SEQ ID NO: 141700 - DNA, 580 bp, Homo sapiens
  misc_feature: GYAE6OF02G0QUP.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaatggtatcaacatagaccagggacggcccctaagctctaatctatgctgcatccagtttgcaaagtggggtcccatcgaggttcagtggcagtggatcgtgggacagtatttcactctcaccatcagtaatctgcaacgtgaagtattttgactaactttattactagtacaactagtaattactaattcggttttaccggaccgtaaagggacctaacgtaacctaactaaaacgtttaaaccgaaacgttaggtaggacttacggacctaaccgtaagttcctacgttacctttaccgtaacttcctttacccccggacctaacttccgtagtaacc

SEQ ID NO: 141701 - DNA, 585 bp, Homo sapiens
  misc_feature: GYAE6OF02FM4ZH.46.67.G01.1.454.CMB.1.raw
  modified_base (379)..(379): a, c, t, g, unknown or other
  misc_feature (379)..(379): n is a, c, g, or t
  modified_base (384)..(384): a, c, t, g, unknown or other
  misc_feature (384)..(384): n is a, c, g, or t
  modified_base (391)..(391): a, c, t, g, unknown or other
  misc_feature (391)..(391): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagttagtggtttctcgtggggctggggtccggcagcctccgaggggaaggggctggaatacattggaagtgtctctcatagtggaggttcctagttacagtccgtctctcaagagtcgagtcacatatctctggacacgtccagcaatctagttttcccngaagntagattntgtgaccgccgctagacgacgggtcgtttatacgtggtgcgagaggacggtctattatagtagtttttaggagtttggtttatttcgacctacccgtagtacgtcggacggggtctaccggtaccccgtggggtcccgtaagggtaactacggtcggtacctacccggttccttacccgttacgccctacccgg

SEQ ID NO: 141702 - DNA, 572 bp, Homo sapiens
  misc_feature: GYAE6OF02HCIBC.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggaccgcccctaagctcctaatctatgctgcatccagtttgcgtaaagtcggggtacccagtcggaggttcagtggcaggtggatcgtagggacagtatttcacttctcacctatcagtaactctcgacaacgtgaagtatttacgactaacttattactcgtacaacaagtaattactaattcgtttaccggacgtaacgggtaaccaacgtaacttaactaaaacgttaaacgaacttagtacgtctacgacaacctattcgttacgttcttactacttccttacccgtactacttctacgtaacg

SEQ ID NO: 141703 - DNA, 527 bp, Homo sapiens
  misc_feature: GYAE6OF02FNMAH.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctcctaatctatgctgcatccagtttgcaaagtggggtcccatcgaggttcagtggcagtggatcgtgggacagtatttcacttctcaccatcagtaactctagcaacgtgaagtattttgactaacttattacttgtacaactagtaattacaatttgtttacgacgtaaggacacgaactaacaaattaaacgaactgtgactgactaccatctgttcttacacttccttacccgtcacttctagtac

SEQ ID NO: 141704 - DNA, 580 bp, Homo sapiens
  misc_feature: GYAE6OF02FN9JR.46.67.G01.1.454.CMB.1.raw
  modified_base (336)..(336): a, c, t, g, unknown or other
  misc_feature (336)..(336): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagcctcccaggggaaggggctggaatacattggaagtgtctctcatagtggaggttcctattacagtccgtctctcaagagtcgagtcaccatatctctggacacgtccagcaatcagttttcccngaagatgagttctgtgaccgcgctgacacggggtcttttaattacgtgtgcgagagacggctattatgtagtttttggagttggtttatttcgactacccgtagtactcggacgggggcctcggaccccgtggggcccagggaacttacgtcggtcaccgtctaccttcgcctcccacgaacgggcccacgtccggttcccttccccgtcggccctaccccgttaccctcccaacgcgtacccg

SEQ ID NO: 141705 - DNA, 647 bp, Homo sapiens
  misc_feature: GYAE6OF02IXJBH.46.67.G01.1.454.CMB.1.raw
  modified_base (431)..(431): a, c, t, g, unknown or other
  misc_feature (431)..(431): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggcttggggtccggcagcctcccgaggggaggggctggaatacattgggaagtgtactctcagtagtggaggtttacctattacagttccgtctctacaagagtcgagtacaccagtatctcgtggacacgtccagctaatctacgttttcccaggaacgtagtagtagttctggtcgacccgtccgtcgtacgacgtacgggtacttttattacgtgttgcgagacgacgtnttattagtagtttagttttggagtttggttatttacgactaccgttagactacgggacgggtctcccggacccggtggggaccgaagggaacttacgtacggtcctaccgttccgttaccgttaccgccctaccgaaccgtaaccgggtccctacggttccggttcccttaccccgtcggtcccacccccgttccgtacccgaacggtctaacccg

SEQ ID NO: 141706 - DNA, 554 bp, Homo sapiens
  misc_feature: GYAE6OF02JCTYC.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacgcccctaagctctaatctatgctgcatccagtttgacaaggtgggtcccagtcgtaggttcagtggcagtggatcgtgggacagtacttcactctcacatcagtatctagactaacgtgaagtatttgactaacttattacttagtactaactagtaacttacaattcgttacgttaccggaccgtaacggactaacgtaactaaactaaacgttaaacgacgttagtacgtacgtacgaacactacttcttactcttacgtcttccgtacccgtcctactctaacg

SEQ ID NO: 141707 - DNA, 575 bp, Homo sapiens
  misc_feature: GYAE6OF02HJ7E6.46.67.G01.1.454.CMB.1.raw
  modified_base (333)..(333): a, c, t, g, unknown or other
  misc_feature (333)..(333): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccagggagggctggaatacattggaagtgtctctcatagtggaggttcctattacagtccgtctctcaagagtcgagtcaccatatctctggacacgtccagcaatcagttttcccngaacgatgagttctgtgaccgccgctgacacgggtcgttttatacgtgtgcgagagacggctattatgtagttttggagttggtttatttcgactaccctagtatcggacggggctccgacccgtggggccgagggaactacgtggtaccaccgtctccttacgccctaccaccgaacggccctagtccggttcccttcccccgtcggtcccaccccgttccctaccgtaacgacgtacccg

SEQ ID NO: 141708 - DNA, 884 bp, Homo sapiens
  misc_feature: GYAE6OF02JWAME.46.67.G01.1.454.CMB.1.raw
  modified_base (260)..(260): a, c, t, g, unknown or other
  misc_feature (260)..(260): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctcgtggtcgcctccatcagttagttggtttcttcgtggggcgttcggggtcccggnacgtccgtcccggaggggaaggggctaggaactacagttggaagttgtctcgtactagtaggtggtacggttcctagttacgtacgtccgtctactacgaagtcgtacgacgtcaccgattacgtctcgtacggacctacgtaccacggtacctaacgttaccgtaacggtttttacccctagggtaaaacgtacgttacgggttaacgggttttcccgttaggtcccggtaacccccgggtccggttaccgtacgggtaaacccgggttaaccgggtttaccggttttaaacgttttaccgtggggttacggtaacccgggtaacgggtaacggttaacccgggtattttaaaccgtttaggtttacggtttacggttttttaacgggggttacggtttacgggtttttaaaccgttttcccggtaaacccgttaacccggtttaaggggtaccggtttacccgggggtaaccggggggttcccctaaccccgggggttaacccccggggttaacggggtaaccccggggttaaggggttaaaccgtttaccgggtccgggtaaccggtttaacccccgtcccggttttacccggtttacccggaaccccccgttaacccggg

SEQ ID NO: 141709 - DNA, 572 bp, Homo sapiens
  misc_feature: GYAE6OF02GRCQO.46.67.G01.1.454.CMB.1.raw
  modified_base (377)..(377): a, c, t, g, unknown or other
  misc_feature (377)..(377): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggcctttcggagaccctgtccctcacctgcgctgtctctggtgcctccatcagtagtggtttctcgtggggctggggtccggcagcctccgagggaaggggctggaatacattggaagtgtctctcatagtggaggttcctattacagtccgtctctcaagagtcgagtcaccatactctctgacacgtccagcaatcagttttcccngaagatgagtttctggtcgacccggccgctcgaaccgtacggggtcgttttagtactgtggcgagagacggtctattatgtatttttggagttggttatttcgacctaccgtagagtccgggacggggtctccggacccggtcgggccgaagggacttacgtgggtccaccgttctccttacgcccttaacccgg

SEQ ID NO: 141710 - DNA, 630 bp, Homo sapiens
  misc_feature: GYAE6OF02G7JVO.46.67.G01.1.454.CMB.1.raw
  modified_base (332)..(332): a, c, t, g, unknown or other
  misc_feature (332)..(332): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctcatcagttgtgtttctcgtggggctgggtccgcagcctccgaggggaacggggctaggaatacgagttggaagtgtctctcagtagtggaggttcctattacagtccgtctctcaagngtcagtcaccatactctctcggacacgtccagctaatctacgttttcccagtaatagtcgtagtttctggtcgacccgtccgcgtacgaccgtacggggttacttttaacgttacgtggtgtacggagacggtaacgtcttagttacgttagttagtttttgggtagtttaggtttatttacgtacctaccgtagtacgtaccgggtacggggtacctccgggtacccggtaggggtccagggttaacgtcggttcggtccctaccggttaccgtcccgttacgccccgtaaccccgg

SEQ ID NO: 141711 - DNA, 659 bp, Homo sapiens
  misc_feature: GYAE6OF02HLYF8.46.67.G01.1.454.CMB.1.raw
  modified_base (191)..(191): a, c, t, g, unknown or other
  misc_feature (191)..(191): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctccatcctccctgtctgcaaccgtggganacagtgtcaccatcacttggccggacaagtcgaacattgacactatttaaatgtatcaacatagaccagggacgcccctaagctcctaatctatgctgctatccgtagtttgacgtaaaggtcggggtacccagtcgtaggttcaggtgcagtggatcgtgggacagtatttcacgttctcacctatcgagttaatctgtacaacgtagaagttagtttcgacttaacgtttacttacgttacgtactaaactacgtaaactttactaagtttacgttttaccggaaccgtaacggtaacctacgtaaaccttaacgttaaaacgttaaaccggtaaacgttacggttacggaccctttacggaacccgtaaaccgtaccgttacgttaccggtttacccgtttacctaaccgtttccccgtttaacccccggtacccgttaacggttacccgttacggttaaacccg

SEQ ID NO: 141712 - DNA, 508 bp, Homo sapiens
  misc_feature: GYAE6OF02FJP8X.46.67.G01.1.454.CMB.1.raw
  modified_base (376)..(376): a, c, t, g, unknown or other
  misc_feature (376)..(376): n is a, c, g, or t
  modified_base (478)..(478): a, c, t, g, unknown or other
  misc_feature (478)..(478): n is a, c, g, or t
  modified_base (505)..(505): a, c, t, g, unknown or other
  misc_feature (505)..(505): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgtcgggcaagtcgacattgacacctatttaaatggtatcaacatagaccagggacggccccctaagctcctaactctatgctgcatccagtttgcaaagtgggtcccatcgaggttcagtggcagtggatcgtgggacagatttcactctacaccatcagtaatcngcaacgtgaagattttgcaacttattaactgtcaaacagaattacaattacgtttcgacaagggacaacgactaacaaattaaacgactgtgctgacaaccntactgtctcactccttcccgcactctntac

SEQ ID NO: 141713 - DNA, 638 bp, Homo sapiens
  misc_feature: GYAE6OF02GY04F.46.67.G01.1.454.CMB.1.raw
  modified_base (228)..(228): a, c, t, g, unknown or other
  misc_feature (228)..(228): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacnttgacacctatttaaatggtatcaacatagaccagggacgcccctaagctacctaatctatgctgcatcctagtttgacgtaaaggtcgggtacccagtcgtaggttcaggtggactagtgatcgtagggacagtattcacgttctacaccgtatacgtaagttaactccgtagacgtaacgtacgtaaagttagtttacgactaactttacttaactcgtacaaactaagtaacttaactaagtttcggtttaccggaaccgtaaacgggtaaccaaccgtaaccgttaaacgtaaaacgttaaaaccgtaacgttaggtacgtacgtacgtaccgtaactacgttacgttacgttacctttacgtacgtttcccgttaccccgtaccttaacttacgttacgtaaccg

SEQ ID NO: 141714 - DNA, 582 bp, Homo sapiens
  misc_feature: GYAE6OF02HGKE2.46.67.G01.1.454.CMB.1.raw
  modified_base (377)..(377): a, c, t, g, unknown or other
  misc_feature (377)..(377): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtcccctcacctgcgctgtctctggtgcctccatcagtagtggtttcttctggggctgggtccggcagcctcccgagggaaggggctggaatacattggaagtgtctctcatagtggaggttcctattacagtccgtctctcaagagtcgagtcaccatatctctggacacgtccagcaatcagttttcccngaagatgagttctgtcgaccgccgctcgacgacgggtcgtttattactggtgcgagagacggtctattattgtacgtttttggtagttggtttatttcgacctaccgttagacgtcggacgggggtcctccggtaccccgtggggcccgtaaggggtaacttacggtcggtcctacccgttccttccgtttacgcccttaccccg

SEQ ID NO: 141715 - DNA, 626 bp, Homo sapiens
  misc_feature: GYAE6OF02I3FUO.46.67.G01.1.454.CMB.1.raw
  modified_base (171)..(171): a, c, t, g, unknown or other
  misc_feature (171)..(171): n is a, c, g, or t
  modified_base (208)..(208): a, c, t, g, unknown or other
  misc_feature (208)..(208): n is a, c, g, or t
  modified_base (418)..(418): a, c, t, g, unknown or other
  misc_feature (418)..(418): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtncctcatcagtagtggtttcttcgtgggctgggtccgnagcctccgaggggagggctgggaatacagttgggaagttgtctctacagttaggtggacggtttcctattacagttccgtctctacgaagtaggtcgagtccaaccattactcgtcgtcggacaccgtccagacaacttctacgttttccagtaacgatgtagttctgttcgacccgtcgcgtcgacgtacggtcgtttatacgtgtcgngagagtcgtattattagttagttagttttggagtttgttagttaccgaactccctaaggtcgtcgggacgggcctaccggacccggtgggaccgtagggtaactcgtacgtcctaccgttctccgttacgacctaccgaacggccggtacctacggtcccgtcccgttccccgtacggccctaccccgtacctaccacggcctacccg

SEQ ID NO: 141716 - DNA, 553 bp, Homo sapiens
  misc_feature: GYAE6OF02JNX38.46.67.G01.1.454.CMB.1.raw
  modified_base (193)..(193): a, c, t, g, unknown or other
  misc_feature (193)..(193): n is a, c, g, or t
  modified_base (300)..(300): a, c, t, g, unknown or other
  misc_feature (300)..(300): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgccaaccgtggganacagtgtcaccatcacttgccgggacaagtcggaacagttgaccactatttaaatggatcaacatagacaggacgccctaagctcaatctatgctgcatccagtttnacgaagtcgggtaccatcggaggttcagtggacagtgatcgtgggacagtatttcgactacgtcacactctaagtatctgacgaacgtacgaagttactttagacttaattattaactgttacaactaagaattacagttcgtttacggacctaggacctacgtaacttactaaaattaaccgtaagtacgtagtactaggaccaacgtattctacgttacctacgtacttcgtaccctacctatcctagtac

SEQ ID NO: 141717 - DNA, 691 bp, Homo sapiens
  misc_feature: GYAE6OF02IJWMY.46.67.G01.1.454.CMB.1.raw
  modified_base (197)..(197): a, c, t, g, unknown or other
  misc_feature (197)..(197): n is a, c, g, or t
  modified_base (225)..(225): a, c, t, g, unknown or other
  misc_feature (225)..(225): n is a, c, g, or t
  modified_base (340)..(340): a, c, t, g, unknown or other
  misc_feature (340)..(340): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgaccccagtcctccatcctccctgtcctgccaaccggtggganacagtgtccaccatcacttggccggganaagtcggaacattgacctacttatttaaattggtatacaacatagaccgagggacgacccctaagcttacctaatctatgctgcatcctagttgactaaggtcgggtccagtcgngttacagtcggctagtggatcgtagggaactagtactttacacttctaccgacctagtcagttaatcgtagactaacggtagtaagttactttagtaccttaaagtttattaccgtagttaaacctaaacgtaacgttaaacttaacgtaaacgttttcgggtttaccggaaccgtaaacggggtaacctaaacggttaacccttaaacgtaaaacgtttaaaacccgaacgtttagtacgggtacccttaggtaaccctaaacctaccgtttacgttacccgtttacctttaaccgtaaccgtttccccgttaaccccgtacccgttaccgttttaccgaccggtttaac

SEQ ID NO: 141718 - DNA, 729 bp, Homo sapiens
  misc_feature: GYAE6OF02JGPA9.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagttggtttcttcgtggggctgggtccggcagctcccgagggaagggctggaatacattggaagtgtctctcatagtggagttcctattacagtccgtctctcaagagtcgagtcaccatatctctggacacgtacagacaatctacgtttttcccaggtaaacgtagtagtacgttttccgttaggtacggtaacccggtccccgtacgttacggaaccgtaccgggggttacttttttaacgtttaaccgttcggttacggaccggtaaggtaaccgggtaaccgggtacctttaagtttagttaggtttacgttttttttaggggtagttttagggttttaacgttttaccgtaaccctaacccgttaaggtacgttacgggtaccgggggtaccctcccgggtaaccccggttacgggggtacccggtaacggggtaactttaccggtcgggttacccgtacccggttcccgtttacccgttacggtaccccttaaccccggg

SEQ ID NO: 141719 - DNA, 534 bp, Homo sapiens
  misc_feature: GYAE6OF02IKZA5.46.67.G01.1.454.CMB.1.raw
  modified_base (192)..(192): a, c, t, g, unknown or other
  misc_feature (192)..(192): n is a, c, g, or t
  modified_base (254)..(254): a, c, t, g, unknown or other
  misc_feature (254)..(254): n is a, c, g, or t
  modified_base (401)..(401): a, c, t, g, unknown or other
  misc_feature (401)..(401): n is a, c, g, or t
  modified_base (429)..(429): a, c, t, g, unknown or other
  misc_feature (429)..(429): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgactactatttaattggtatcaanatagaccgaggacggcccctaagcctcctaatctatgctgcatcctagtttgcaaaggtcgggtcccagtcgaggttcagtggcagtggatcgtgggacagtactttcactctacaccatcagtaactctcgactaacgtgaagttntttagacttaattattacttagtacaanaataattacatttagtttccgacgtaggactagactaacaaattaaacgatgagctagaccactatcgtacttacttcgacttccttcccgactacttctagtac

SEQ ID NO: 141720 - DNA, 609 bp, Homo sapiens
  misc_feature: GYAE6OF02HT7JC.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccgcagctccgagggaaggggctggaatacattggaagtgtctctcatagtggaggttcctattacagtccgtctctcaagagtcgagtcaccatatctctggacacgtccagcaatctagttttcccagaagatgtagttctgtgaccgcgctggacacgggtcttttaattacgtgtgcgagagacggtctattatgtattttggagttggtttatttcgactacccgttagacgtacgggacggggtctccggaccccggtggggacccgtaaggggtaactacgtcgggttaccacccggttcttccgttacgcccttaccaacccgtaacgggcccctagttcccggttcccttcccccgtggtccctaccccgttccctacccgtaacgacgtacccg

SEQ ID NO: 141721 - DNA, 744 bp, Homo sapiens
  misc_feature: GYAE6OF02ICUSX.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggcctttcggagaccctgtccctcacctgcgctgtctctggtgcctccatcagtagtggtttcttcgtgggctgggtccgcagctcccgagggaagggctaggaatacagttggaagtgtctctcatagtggaggttctattacagtccgtctctcaagagtcgagtcaccctatatctcgtggaccacgtccagacaactcgttacgttttcccagaagatgtacgttctgtcgaccgcgtctacggaccgtacgggttacgttttacttacgtgttcggacggtaaggacggtacggtacttaagtttaagttcggtttagtttttagggtaggtttaggttttacgtttaccggttaaccctaccgttacggaacgttaccggggtaccgggggtaccgttcccggtacccggtccgggggaacccgtaacggggtaaacgttaccggttacggttaccgtacccggttccgttaccgttaccgtacccgttacccctaaccggggggggggtaaccctaccccggtaacggttccccggtttcccccgtttaccccgtcccgggtacccctacccccgttccccgtacccgtaaccggtaccgtaaccccg

SEQ ID NO: 141722 - DNA, 754 bp, Homo sapiens
  misc_feature: GYAE6OF02F06CO.46.67.G01.1.454.CMB.1.raw
  modified_base (206)..(206): a, c, t, g, unknown or other
  misc_feature (206)..(206): n is a, c, g, or t
  modified_base (248)..(248): a, c, t, g, unknown or other
  misc_feature (248)..(248): n is a, c, g, or t
tcagactagcagtacacgaccggtgctcgatttagagtatacatattgggtttgggggagtctcggtcaggacacagcatggacatgtagggtccccgctcagcgtccgtggggctcctcgctactcgtcggctccgagggtgccagatgtgacagtccgagctggacccaggtcctccgatccctcctgtctgcaccggtggganacagtgtcaccatcacttggccgggtctaacgtccggaacgngttcggaccaccttaatttaaacgttggtagtacgaactagtaagaaccgagggtaccggacccctaaggccttacctaatctagtcggctacgactactccgtaggtttcgacgtaaaggtcggggtacccagtacggtacggttacaaggtcggtaccgtaggtggactcgtacggggaactacgtacttactaccttcctacaactactacgtagttactcgtacggactaacgtaggtaacgttagtttacggactttaacgtttacttacgttacgtaccaaacgtaacgtaaactttaccgtaagtttacggtttacggtaccggttaagggtaaccgttaaccgttaaccgttaaacgtaaacctttaaaaccggtaacgttacgggttacgggtaccgttacggacccgtaacccgggtacgttacccggttacggttaccttaaccgttacgtttccccgtttaccccgtaccttaccggttactacccgttaaccg

SEQ ID NO: 141723 - DNA, 751 bp, Homo sapiens
  misc_feature: GYAE6OF02HNPJA.46.67.G01.1.454.CMB.1.raw
tcagactagcagtacacgaccggtgctcgatttagagtatacataagtttgggggtttggggagtactcgggtcagggacacggagcatagggacagtgtagggtccccgctccaggcttcctggggtctcctgtctactctggctccgagtgccagagtgtgtacatcgagcctgacccagtctcctactcctccctgtctgcaaccggtggagacgagtcgtacaccatcacttcgccggacaacgtacggaactatttgaactaccttatttaaacttaggtaatactaaactaagttagtaccgtaacgggaccgacccctaaagacctaccgtaatctatcgtctgctatcctagtttcgtacgtaaacgggttcgggtaccctaacggtcggtacgggttaccgaggtcggtacgtacggtagggtacgtcgtacgggacgtaagtacgtttaccaacgttacttacgaccctagtacctaacgtaactcctaggaccgtaaggtacgtaacgtagttttacggacttaaagttattaacttggtactaaactaagttaatttactaagtttacgtttaccggaaccgtaaaggttacctaacggttaacctttaaaaccgtaaagtttaaaccgaaacggttacggtcggtaaccgtaacggtaccgtaacgtacgttaaacgtacgttaaccgtttacgtaccgtttccgtaccccgtacgtaccttaccgtacggtttaacc

SEQ ID NO: 141724 - DNA, 545 bp, Homo sapiens
  misc_feature: GYAE6OF02IBP9K.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttgccgggcaagtcggaacattgacaccttatttaaattggtatcaacatagaccagggacggcccctaagctcctaatctatgctgcatccagtttgcaaaggtgggtcccatcgaggttcagtgcagtggatctgggacagatttcactctcaccatcagtaatctgcaacgtgagtatttgactaacttattactgtacaatagtaattacaattgttttcggacctaagggactacgtaactaactaaagttaaacgaacgttgtacgactagacgaacctattcttacgttcttacctatttcccgttcccgacctacttcctacgtaacc

SEQ ID NO: 141725 - DNA, 575 bp, Homo sapiens
  misc_feature: GYAE6OF02GAJYT.46.67.G01.1.454.CMB.1.raw
  modified_base (311)..(311): a, c, t, g, unknown or other
  misc_feature (311)..(311): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggacaaggtcggaacattgacaccttatttaaattggtatcaacatagaccgagggacggcccctaagctacctaatctatgctgcatcctagtttnacaaaggtgggtacccagtcgtaggttcagtggcagtggatcgtgggactagtacttcactctcacatacagtaatctgacaacgtgtaagtatttagacttaattattactgttaacaactagtaattactaagttcgtttacggaccgtaagggtacaacgtaactaaactaaagtaaacgtaaacgttgtacggtctacgtaccactaacttcgtacgttccgttactacttcccttacccgaccttacttacgtataccg

SEQ ID NO: 141726 - DNA, 569 bp, Homo sapiens
  misc_feature: GYAE6OF02GQ9VV.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccggcaagtcggaacattgacacctatttaaattggtatcaacatagaccagggacggcccctaagctacctaatctatgctgcatcctagtttgcaaagtcgggtcccagtcgaggttcagtggctaggtggatcgtgggacagtatttcgacttctcaccatcagtaatctgacaacgtagtaagtactttgactaacttattacttagtacaaatagaattactaagttgtttacggacgtaagggacaacgtactaaactaaacgttaaacgaagttagtgtacgtcgacgtaacctacgttcgtacgttccgtttacctacttcccgttccccgacgtacttacgtagtaacg

SEQ ID NO: 141727 - DNA, 568 bp, Homo sapiens
  misc_feature: GYAE6OF02GHFGE.46.67.G01.1.454.CMB.1.raw
  modified_base (338)..(338): a, c, t, g, unknown or other
  misc_feature (338)..(338): n is a, c, g, or t
  modified_base (511)..(511): a, c, t, g, unknown or other
  misc_feature (511)..(511): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtgggctgggtccggcagctcccgagggaaggggctggaatacattggaagtgtctctcatagtggaggttcctattacagtccgtctctcaagagtcgagtcaaccatactctctggacacgtccagcaatctacgttttccngaagatgagttctgtcgaccgccgctgacgtacgggtctttatactgtgcgagacgcgcttatagtgttagttttaggtagttggtttatttcgaacctacccgtagtacgtcggacggggtcctccggacccggtcgggaccgagggaatacgtgtcaccgtctccgttacncctaccgaccgaacggccacgtccgtccttcccgtcgcctccctcccaccacgcgcc

SEQ ID NO: 141728 - DNA, 562 bp, Homo sapiens
  misc_feature: GYAE6OF02GPX3I.46.67.G01.1.454.CMB.1.raw
  modified_base (396)..(396): a, c, t, g, unknown or other
  misc_feature (396)..(396): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgagggaagggctggaatacattggaagtgtctctcatagtggaggttcctattacagtccgtctctcaagcgtcgagtcaccatatctctggacacgtccagcaatctacgttttcccagaagtatgagttctgtcgaccgcgctgacgtacgggtctttatactgtgcgagagacgntattagtgttagttttaggagttggttattcgtactaccgtagtacgtcggacgggtcctcggacccgtggggaccgagggaacttcgtcgtccacgtcctccgttcgcctccgacgaacggcccacgtccgtccttcccgcgccctaccctccgacacgcgaccg

SEQ ID NO: 141729 - DNA, 571 bp, Homo sapiens
  misc_feature: GYAE6OF02FK69R.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtcgggtcccatcgaggttcagtggcagtgatcgtgggacagtattcactctacacatcagtaatctgcaacgtgaagtattttgactaacttattactagtactaacaagtaatttacaagttcgttttacggaccgtaagggtacctaacgtaaccttaaactaaaatttaaacgaacgttgtacggtactgaccgtaacctattacgtcgttacttaccgtacttcccgttaccccggtactacgttcctagttaaccg

SEQ ID NO: 141730 - DNA, 582 bp, Homo sapiens
  misc_feature: GYAE6OF02IMHF2.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactaatttaattgtatcaacatagaccagggacgcccctaagctcctaatctatgctgcatcctagtttgacgtaaaaggttcggggtacccaagttacggtaggttcgaggtggcaggtgtatcgtagggactaggtatttcactctacacctatcagtaactctacgactaaacgtgaagttatttagaccttaaattattacgttcgtaacaactaagtaaacttacaagtttggtttaccgacgaacggtacaacgtaactaaactaaaacttaaacgtaactagtacgactacgcaactactcttcgttcttacgtaccttccttcccgactacttctagtaac

SEQ ID NO: 141731 - DNA, 640 bp, Homo sapiens
  misc_feature: GYAE6OF02F9W0I.46.67.G01.1.454.CMB.1.raw
  modified_base (218)..(218): a, c, t, g, unknown or other
  misc_feature (218)..(218): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttgccgggnaagtcgaacattgacactatttaaatggtatcaacatagaccagggacgcccctaagctacctaatctatgctgcactccagtttgacgtaaaggtcgggtcccaagtcggtaggttcaggtggcgaggtggtactcgtagggactagtactttcactctacacctatacgtagtactctagtacgtaacgtagtaaagtagtttacgactaacgtttacttaacgtacgtactaacgtaagtaaactttactaagttcggttttacggaaccgtaacgggtaacctaaccggtaaaccttaaacgtaaaacgtttaaaaccggaacgttacgtacggtaccttacggacctaaccgtacttacgttacgttactttaccgtacgttcccgttaccccggtactacgtttacgtagttaacg

SEQ ID NO: 141732 - DNA, 606 bp, Homo sapiens
  misc_feature: GYAE6OF02F77YY.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctacctaatctatgctgcactccagtttgacaaagtggggtacccagtcgtaggttcaggttggcagtggatctgggacagtattcactctcaccatcaagtatctgcaacgtgaatattttgactaacttattacttgtacaacaagtaattaactaattacgttttcggaccgtaaagggacctaacggtaacttaaacgtaaaattaaaacgtacgtaaacgttcggtacggtaccgtaggtaccctaacccgtaagttccttagtttaccgtttaccttaaccgtttacccgttacccccgtacccttaacgtacgttaaccgg

SEQ ID NO: 141733 - DNA, 801 bp, Homo sapiens
  misc_feature: GYAE6OF02FMUA7.46.67.G01.1.454.CMB.1.raw
  modified_base (252)..(252): a, c, t, g, unknown or other
  misc_feature (252)..(252): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcgcctccatcagtgtggtttcttcgtgggctgggtccgcagctccgagggaagggctaggaatacagttgggaatgtctctnagtagtggaggttcctattacagtccgtctctcaagtagtcgagtccacgatactctcgtgaccacgtcagactaagtctacgttttcccagtaacgtatggtaagttctaggtcgtaccggcccgtacgtacggaacgtaccggggttcgttttaacgttaccgttgggtcggtacggtaacggaacgggtaccgggtaccttttaagtttaacgtttacggtttaaggttttttacgggtacgggttttgggttttaacgttttaccggtaaccctaaccccggttaagtaccggttaccggggtaccgggggtccgttacccggtaccccgggttcgggggacccgtaagggggtaaaccttaccgggttacgggtacccgtaccggtttacccgttacccgttaccgtaccccgttacccgtaaccccgggtaaccgggtccccgtaaccggttcccccgggtttacccgtttcccccccgttacgggtacccccgttaccccccgttaccccgttaccccggtaaccgtaccggtaacccccgg

SEQ ID NO: 141734 - DNA, 562 bp, Homo sapiens
  misc_feature: GYAE6OF02GYGT1.46.67.G01.1.454.CMB.1.raw
  modified_base (378)..(378): a, c, t, g, unknown or other
  misc_feature (378)..(378): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcgaacattgacacctatttaaattggtatcaacatagaccagggacggcccctaagctcctaatctatgctgcatccagtttgcaaagtggggtcccagtcgaggttcaggtggcagtggatcgtgggacagtatttcactctccacctatcagtanctgacaacgtgaagtatttacgactaacttattactgtacaactagtaattactaattcgtttaccggaccgaagggacctacgtaacttaactaaaacgtttaaacgaacgtgtaggtactacgacctaacctattcgttacgttcctttactacttcccttccgaccctacttcgtataacc

SEQ ID NO: 141735 - DNA, 521 bp, Homo sapiens
  misc_feature: GYAE6OF02F8PH3.46.67.G01.1.454.CMB.1.raw
  modified_base (228)..(228): a, c, t, g, unknown or other
  misc_feature (228)..(228): n is a, c, g, or t
  modified_base (514)..(514): a, c, t, g, unknown or other
  misc_feature (514)..(514): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacnttgacacctatttaatgtatcaacatagaccagggacggcccctaagctcctaatctatgctgcatccagtttgcaaagtgggtccatcgaggttcagtggcagtgatcgtgggacagtattcactctcaccatcagtaatctagacaacgtagaagtattttgactaacgttattactgtacaacagtaattacagttagtttcggactaagggacaacgactaacaaattaacgaactgtgtacttacgacctatctgtacttcacttccttcccgactatctntactacg

SEQ ID NO: 141736 - DNA, 552 bp, Homo sapiens
  misc_feature: GYAE6OF02F80A6.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccggcaagtcgaacattgacacctatttaaatgtatcaacatagacagggacgcccctaagctcctaatctatgctgcatccagtttcgacaaaggtcggggtcccagtcgaggttcagtggcagtggatcgagggacagtattcacttctcaccatcagttaatctagctaacggtgtaagtattttgactaacttattactgtacaacgagtaattactattcgttttacgaccgaagggtacaacgtaacttaactaaaacgttaaacgaacgttagtgactagactacctattctacgttccttactacttcccttacccgacctagttcctagtac

SEQ ID NO: 141737 - DNA, 562 bp, Homo sapiens
  misc_feature: GYAE6OF02GR33C.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgcccctaagctcctaatctatgctgcatccagtttgacaaagtgggtcccagtcgaggttcagtggcagtggatcgtgggacagtattcactctcacctatcagtatctgacgaacgtagaagtatttgactaacttattacttgtacaactagtaacttactaattcggtttacggaccgtaagggtaccaacgtaactaactaaaacgttaaacgaacttagtacggtactcgactaacctattcctagttaccttactacttccttacccgacctacttaccgtataaccg

SEQ ID NO: 141738 - DNA, 523 bp, Homo sapiens
  misc_feature: GYAE6OF02JWSU7.46.67.G01.1.454.CMB.1.raw
  modified_base (330)..(330): a, c, t, g, unknown or other
  misc_feature (330)..(330): n is a, c, g, or t
  modified_base (354)..(354): a, c, t, g, unknown or other
  misc_feature (354)..(354): n is a, c, g, or t
  modified_base (387)..(387): a, c, t, g, unknown or other
  misc_feature (387)..(387): n is a, c, g, or t
  modified_base (424)..(424): a, c, t, g, unknown or other
  misc_feature (424)..(424): n is a, c, g, or t
  modified_base (434)..(434): a, c, t, g, unknown or other
  misc_feature (434)..(434): n is a, c, g, or t
  modified_base (460)..(460): a, c, t, g, unknown or other
  misc_feature (460)..(460): n is a, c, g, or t
  modified_base (469)..(469): a, c, t, g, unknown or other
  misc_feature (469)..(469): n is a, c, g, or t
  modified_base (483)..(483): a, c, t, g, unknown or other
  misc_feature (483)..(483): n is a, c, g, or t
  modified_base (508)..(508): a, c, t, g, unknown or other
  misc_feature (508)..(508): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccgcagctccagggagggctggaatacattggaagtgtctctcatagtggaggttcctattacagtccgtctctcaagagtcgagtcaccatatctctggacacgtccagcaatcagttttcccngaacgtatgattctgtgaccgcgntcgacacgggcttttatacgtgtgcgagagcgntattatgtattttggagttgttatttcgactactagntcggacgggntcgacccgtgggcagggatacgtgcncgtctgtcncacaccgacgtccngtccgtcctcccgtcggcctacccnctacctacgctaccg

SEQ ID NO: 141739 - DNA, 679 bp, Homo sapiens
  misc_feature: GYAE6OF02I1518.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttcggccgggacaaggtccggaactattacgaacctaccgttaatttaaagttggtatacaaacatacgacgagggaccgccctaagcctacctaatctatgctgctatccgtagtttgactaaaggtcggggtaccctagttacggtaggtttcgaaggttcggacgtagttggattcgtagggactaggtactttcgaactctacacctaataccgtaataacgttcgtagtacgtaacggttagtaagttacgtttacgtactaaactttacttacgttagttacctaaagtacgtaaaacttactaagtttcgtttaccggaaccttaagggacctaacggtaactaaacgttaaaactaaacggtaacttagggtacgacgtacgtacctaaccgtacttacgtcgtttaacccttacttaacccttcccggttacccgtacccttacggttaaccgtgttaaccg

SEQ ID NO: 141740 - DNA, 587 bp, Homo sapiens
  misc_feature: GYAE6OF02G6PGW.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacacctatttaaattgtatcaacatagaccagggacgcccctaagctcctaatctatgctgcatccagtttgacaaagtgggtcccatcgagttcagtgcagtggatcgtgggacaggtactttcgacttctcacctatcaagttaatcgtagactaacggtgaaacgttattttagacctaaactttagttaacttacggtacctaaacgtaagtaaactttacaagtttcgttttacggaccgtaaagggacctaacgtaaccttaaactaaaacgtttaaacgaacgttagtacggactacgacctaactacttacgtcttcttacacttccttcccgtactacttctataac

SEQ ID NO: 141741 - DNA, 545 bp, Homo sapiens
  misc_feature: GYAE6OF02HISWR.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccgcagcctcccgagggagggctggaatacattggaagtgtctctcatagtggagttcctattacagttccgtctctcaagagtcgagtcaccatatctctggacacgtccagcaatctacgttttcccagaagatgtagttctgtcgaccgccgtctgacgtacgggtcgtttattctgtgcgagagcgtctattatgttattttggagtttgttattcgactacctagtctcggacgggtctcggcccgtgggccgaagggtactcgtcggtcaccgttctaccgttacgccctaccg

SEQ ID NO: 141742 - DNA, 571 bp, Homo sapiens
  misc_feature: GYAE6OF02G2SS9.46.67.G01.1.454.CMB.1.raw
  modified_base (213)..(213): a, c, t, g, unknown or other
  misc_feature (213)..(213): n is a, c, g, or t
  modified_base (331)..(331): a, c, t, g, unknown or other
  misc_feature (331)..(331): n is a, c, g, or t
  modified_base (380)..(380): a, c, t, g, unknown or other
  misc_feature (380)..(380): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcagggagtcgggcccacgactggtgaggccttcggagaccctgtcccctcacctgcgctgtctctggtncctcatcagtagtggtttctcgtggggctggggtccgcagcctccgaggggaggggctaggaatacattggaagtgtctctcatagtggaggttcctattacagtccgtctctcaagngtcgagtcaccatactctctggacacgtccagcaatctacgttttcccngaagtatagtagttctgtcgaccgccgctgacgacgggtctttatcgtgtcgacgagagcgtattagttagtggttagttttgggagtttggtttactttcgaacctaccgtagagtccgggacgggtctccggtacccggtgggaccgaagggtactagtcgtcgtaccgtctaccttcgccctacccgg

SEQ ID NO: 141743 - DNA, 717 bp, Homo sapiens
  misc_feature: GYAE6OF02IWZLR.46.67.G01.1.454.CMB.1.raw
  modified_base (173)..(173): a, c, t, g, unknown or other
  misc_feature (173)..(173): n is a, c, g, or t
  modified_base (374)..(374): a, c, t, g, unknown or other
  misc_feature (374)..(374): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcaccgtgcgctgtctctggtcncctccatcagtagtggtttctcgtgggctgggtccgcagctccgagggagggctaggaatacagttcggaagtcgtctcgtactagtacggtggacggtttcctaacttacgacgttccgtactactacgaaaggacgtcgagttccaacctatactctacgtaggacctacgtcagcaactcgtacgtttccagaacgtntacgtagtctagcgtaccgcgtacgtggtaacgcggggtttacttaacgttatggtacgtacgaggtaacgacgtacgtttagttaagttcgtttaggtttacgggtaggttacggtttagtttacccgaacgttaacccgtaggtaccgttaacgggggtacggtccgtacccggtaccggtccggggtaccgaaagggttaaccgttacggtacgtacccggttaccgttaccgttaccttaaccgtccccgaaccgttaccggaaccggtccctacggttcccggttacccgttccccgtacgcccttaccccgtacccgaccgtaacggtcctaccccg

SEQ ID NO: 141744 - DNA, 560 bp, Homo sapiens
  misc_feature: GYAE6OF02HFUKT.46.67.G01.1.454.CMB.1.raw
  modified_base (416)..(416): a, c, t, g, unknown or other
  misc_feature (416)..(416): n is a, c, g, or t
  modified_base (539)..(539): a, c, t, g, unknown or other
  misc_feature (539)..(539): n is a, c, g, or t
  modified_base (544)..(544): a, c, t, g, unknown or other
  misc_feature (544)..(544): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagcctcccgaggggaaggggctggaatacagttggaagtgtctctcataggtggaggttcctattacagtccgtctctcaagtagtcgagtccaccatatctctggacacgtccagcaatctagttttccctagaagtatgtacgttctggtcgaccggccgtactcgacgtacggggtcttttattacgtgtgacgagagacgtntattagtgttattttggagtttgttatttcgactacctagatcggacgggctccggaccgtgggccgagatacgtgtcactcgtacctagcctaccgacgacggcctagtccgtccttcccgngcccnccgtcctacagcaccg

SEQ ID NO: 141745 - DNA, 576 bp, Homo sapiens
  misc_feature: GYAE6OF02FQ3AW.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctcctaatctatgctgcatccagtttgctaaaggtggggtcccagtcgaggttcagtggcagtggatctgggacagtatttcactctcacctatcagtaatctgacaacgtgaagtatttgactaacttattactgtacaactagtaattactaagtttcggttttacggaccgtaaaggggtacctaaccggtaacttaaacgtaaaattaaaaccgaacgttaggtacggtacttagacctaacctattcttagttacctttacacttccgttccccgacctacgtacctagtaacc

SEQ ID NO: 141746 - DNA, 860 bp, Homo sapiens
  misc_feature: GYAE6OF02HZ2AG.46.67.G01.1.454.CMB.1.raw
  modified_base (171)..(171): a, c, t, g, unknown or other
  misc_feature (171)..(171): n is a, c, g, or t
  modified_base (220)..(220): a, c, t, g, unknown or other
  misc_feature (220)..(220): n is a, c, g, or t
  modified_base (346)..(346): a, c, t, g, unknown or other
  misc_feature (346)..(346): n is a, c, g, or t
  modified_base (386)..(386): a, c, t, g, unknown or other
  misc_feature (386)..(386): n is a, c, g, or t
tcagactagcagtacacgaccggtgctcgatttagagtatacatatggtttgtcctcctgctggtggcagctcccagatgggtcctgtccctggtgcaactgcaggagtcgggcccacgactggtgaggccttcggagaccctggtccctcaccctgcgctggtctctggngcctccgatcaggtagtcggtttcttcgtcgggggtctcggggtcccgngacggtccttaccccgagggggaacggggccttgggaaactacgtagttacgggaagttcggttcctcgtccgaagttacggtggtaacgggttcctaagttaccaggttcccggtacttccgtanaaaggtcgttcgacgttcaacccgtattactaccgttcgngggtaacctaccggttacccaggtctaaaagttccgtaaaccggttttttcccccgaaggaaacgttacgtagttaacggtttccgttacgggttacggaaccccgggttcccggtactttacgggaacccctaaaccgggggggtttcttttttaaaacgttaaccggtcggttttacggggacccggtaagggtaaccgtaaccggggtacctttaagtaacgttacggttagttttacgggtaaggttcggttttaagttacgtaccgttaaccgttacgtacgttcggggtaacgggtccttacccggtaccccggtcgggtacccggagggtaacgttaccgtggttacccgacgttccgttaccgttacgtccgttcccgaaccggtaaccggaccctagtacccggttaccccgttcccggtacggtaccccacccggttccccctagttaacccggactaccccgg

SEQ ID NO: 141747 - DNA, 600 bp, Homo sapiens
  misc_feature: GYAE6OF02I5GMS.46.67.G01.1.454.CMB.1.raw
  modified_base (336)..(336): a, c, t, g, unknown or other
  misc_feature (336)..(336): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccgcagctccagggagggctggaatacattggaagtgtctctcataggtggaggttcctattacagtccgtctctcagagtcgagtcaccatatctctggacacgtcagacaatctagttttcccagaanatcgagttctagtcgaccgcgtctcgacgacggtacgtttattactggtcgcgagaggtacggctaacgttattagtattttgggagttaggttatttccgtatacccgttagacgtcggtaccggggctccgtacccgtcggggaccaacggggtaactaccgtcggttccgaccgttcgtccttagccctccaaccggtaacggcccacgttccggtaccttccccgtcggtcccacccttcccgtaccaagtcggtacccg

SEQ ID NO: 141748 - DNA, 769 bp, Homo sapiens
  misc_feature: GYAE6OF02JTQ33.46.67.G01.1.454.CMB.1.raw
  modified_base (261)..(261): a, c, t, g, unknown or other
  misc_feature (261)..(261): n is a, c, g, or t
tcagactagcagtacacgaccggtgctcgatttagagtatacatattgggtttgggggacctcctgtgcaagaacatgaagcacctgtggtttgtcctcctgctggtggcagctccagatgggtcctgtccctggtgcaactgcaggagtcgggcccacgacgtgggtgagggccttcgggagaccccgtggtcccctcacccgtgccgactgtctcctggtcgcctcaatcagtagtgtttctcgtgggctgggtccgangcctccgagggaagggctggaatacacgttggtaacggtgtaccttcgtcgactaggtggtacgggttcctagttacagtccggtcttctacgtagacgtcgaggtccacgtactatccttacgtcgtactaccggttaccacggtacaacgttcgtaacgttttttcccgagtaaacgtactttacggtaacgtttcgtacgtcggtaacccgccggtctacggtaccgacgggtacctttacgtttaactcggttgttaccggagtacgggaaccggttcgtaacgtttagtaccggtttagtttttacgggtagtttaggtttacgttttaaccgtaccgtaacccgtttagtaacggttacggtaccggggttccgttaccggtaaccccggttcgggggtacccgttaaacggggtaacggtttaaccggttacggggttaccccggttaccggtttaccccggtttaacccggttacccggttcccgtttaaaccccccggg

SEQ ID NO: 141749 - DNA, 590 bp, Homo sapiens
  misc_feature: GYAE6OF02H08BJ.46.67.G01.1.454.CMB.1.raw
  modified_base (408)..(408): a, c, t, g, unknown or other
  misc_feature (408)..(408): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctgggctgggtccgcagctcccgagggaggggctggaatacagttggaagtgtctctcatagtggaggttcctattacagtccgtctctcaagagtcgagtcaccatatctctggacacgtccagcaatctagttttcccagaactatcgtagttctgtgacccgccgctgaccgacgggtcttttaatacgtgtgcgagagacggtctattatntagttttgtagttggtttatttcgactaccctagacgtcggacggggcctccggaccccgtggggaccgacgggaactacgtcggtccgaccggtccttccgttacgtccctaccaccgaacggccctagtcccgttccttcccccgtcggtccctaccccgtcctacccacgacgtacccg

SEQ ID NO: 141750 - DNA, 566 bp, Homo sapiens
  misc_feature: GYAE6OF02FMF6N.46.67.G01.1.454.CMB.1.raw
  modified_base (237)..(237): a, c, t, g, unknown or other
  misc_feature (237)..(237): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagttggtttcttcgnggggctggggtccgcagctccgagggaaggggctggaatacattggaagtgtctctcatagtggaggttcctattacagtccgtctctcaagagtcgagtcaccatactctctaggacacgtccagcaatctagttttccctagaacgtatgagtttctgtcgaccgccgctcgacacgggtctttatacttgtgcgtagacgacgtctagttatgtagtttttggagtttggtttagtttcgacctaccgtagtacgtcggacggggctacggacccgtagggccgaagggtactacgtcggtcaccgttctccgttacgcctacccg

SEQ ID NO: 141751 - DNA, 566 bp, Homo sapiens
  misc_feature: GYAE6OF02IKRI7.46.67.G01.1.454.CMB.1.raw
  modified_base (246)..(246): a, c, t, g, unknown or other
  misc_feature (246)..(246): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtggagacagtgtcaccatcacttgccgggcaagtcggaacatgacacctattaaatgtatnaacatagaccagggacgacccctaagctctaatctatgctgctatcctagtttgacaaaggtcgggtcccagtcgaggttcagtggcagtgatcgtgggacagtacttcacttctacaccatcaagttactctgactaacgtgtaaagttatttcgactaactttattacttagtacaacgtagtaattaactaattcggtttacgaccgtaaagggtaccaacgtacctaaacgtaaaacttaaacgaaacgttgtacggcttagacctaacactcgttacgttctttacacgttccgttacccgcctagttccagtac

SEQ ID NO: 141752 - DNA, 659 bp, Homo sapiens
  misc_feature: GYAE6OF02JLZD6.46.67.G01.1.454.CMB.1.raw
  modified_base (174)..(174): a, c, t, g, unknown or other
  misc_feature (174)..(174): n is a, c, g, or t
  modified_base (193)..(193): a, c, t, g, unknown or other
  misc_feature (193)..(193): n is a, c, g, or t
  modified_base (204)..(204): a, c, t, g, unknown or other
  misc_feature (204)..(204): n is a, c, g, or t
  modified_base (309)..(309): a, c, t, g, unknown or other
  misc_feature (309)..(309): n is a, c, g, or t
  modified_base (626)..(626): a, c, t, g, unknown or other
  misc_feature (626)..(626): n is a, c, g, or t
tcagactagcagtacacgaccggtgctcgatttagagtatacatattgggtttggggaggtcgtcggtcaggacacagcatggacatgagggtccccgctcagctcctggggctcctgctactctggctccgaggtgccagactgtgacatcgagctgacccagtctccatccnccctgtctgcaccgtgganacagtgcaccntcacttgccgggcaagtcggaacattcgacacctatttaaactggtatcaacatagaccaggaccggccctaagctacctaatctactagctgcactccagtttnacaagtggggtccctaagtcgaggttccagttcggcgaggtcggtaatcgtaggggtacacggtattttaccgaacttcctacgacctaacgtctaacggttaactaccgtttaggcccgtaaacggttcggtaaacgttagtttttacggaccctaaacttttacgttaaccttcggtaccctaaaacgtagtaaactttaacccagtttcgttttaaccggccttaaacggggccttaacggaacttaaacctaaacgtttaaacgaactacgttagggccttagccggtaacctattaacgttgtacccgttanacgttcccttcccggtaccattccgtagtaacc

SEQ ID NO: 141753 - DNA, 720 bp, Homo sapiens
  misc_feature: GYAE6OF02JWTHS.46.67.G01.1.454.CMB.1.raw
  modified_base (212)..(212): a, c, t, g, unknown or other
  misc_feature (212)..(212): n is a, c, g, or t
  modified_base (249)..(249): a, c, t, g, unknown or other
  misc_feature (249)..(249): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggcctttcggagaccctgtccctcacctgcgctgtctctggtncctccatcagtgtggtttctcgtggggctgggtccgnagcctccgagggaagggctggaatacagttggaagtgtctctcatagtggaggttcctattacagtccgtctcgtcaagagtcgagtcaccatatctcgtcggacacgttccagcaaatcctacgttttcccagtaacgtatgtacgtttcgtacgttcgacccgtccgcgttcgaaccgtaccgggggttacttttaacgttacgttcggttaggtacccggtaaggtacggaaccgttcgttaaattttacgttaggtttaagttttttgggtaaggtttcgggttttaacgttttaccggaacccgttaccccgttaagggttaccgttaccggggacgggggttacccttacccgggtaacccccgggttagggggacccggtaaacggggtaaccttaccggttaccgggttccgtaacccggtttcccggtttacccgtttaacccggccccgtttaacccccgg

SEQ ID NO: 141754 - DNA, 655 bp, Homo sapiens
  misc_feature: GYAE6OF02HK8UK.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactgggtgaggccttcggagaccctgtccctcacctgcgctgtctctggtcgcctccatcagttagttggtttcttcgtggggctgggtccgcagcctccgagggaaggggctaggaatacgagttggaagtgtctctcagtagtggtaggttcctagttacagtcctctctcaagtgtcgagtcaacctatatcctgtggactaccgtccagactaattctacgttttcccagaagtagtcgtagttcgtgtcgaccgccgtctacgaccgtacgggttacgttttaacgttacgttgtacggcggaagacggtacgtattagtttagttagtttagttttaggtaggtttggttttaactttaccgaaccgttacccgtaaggtacgttccgggacggggttccgtcccggtacccggtcggggaccgtaacgggtaacgttaccggtcggttaccgtacccgttccgtaccgttaccgtacccgtacccgg

SEQ ID NO: 141755 - DNA, 552 bp, Homo sapiens
  misc_feature: GYAE6OF02GKADF.46.67.G01.1.454.CMB.1.raw
  modified_base (313)..(313): a, c, t, g, unknown or other
  misc_feature (313)..(313): n is a, c, g, or t
  modified_base (335)..(335): a, c, t, g, unknown or other
  misc_feature (335)..(335): n is a, c, g, or t
  modified_base (532)..(532): a, c, t, g, unknown or other
  misc_feature (532)..(532): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccaggggaaggggctggaatacattggaagtgtctctcatagtggaggttcctattacagtccgtctctcaagagtcgagtcaccatatctctggacncgtccagcaatcagttttcccngaagatgagttctgtcgaccgccgctgacacgggtctttatacgtgtgcgagagacggctattatgttagttttggagttggttatttcgactaccctagactcggacggggtctccgacccgtggggccagggatacgtgtcacgtctccgttagcctccaccgaacggcccagtccgtccttccccgtcggcccnccctccctccacgctacccg

SEQ ID NO: 141756 - DNA, 675 bp, Homo sapiens
  misc_feature: GYAE6OF02JDN1J.46.67.G01.1.454.CMB.1.raw
  modified_base (189)..(189): a, c, t, g, unknown or other
  misc_feature (189)..(189): n is a, c, g, or t
  modified_base (198)..(198): a, c, t, g, unknown or other
  misc_feature (198)..(198): n is a, c, g, or t
  modified_base (220)..(220): a, c, t, g, unknown or other
  misc_feature (220)..(220): n is a, c, g, or t
  modified_base (274)..(274): a, c, t, g, unknown or other
  misc_feature (274)..(274): n is a, c, g, or t
tcagactagcagtacacgaccggtgctcgatttagagtatacatattgggtttggggagtctcggtcaggacacagcatggacatgagggtccccgctcagctcctggggctcctgctactctggctcgagtgccagatgtgacatcgagctgacccagtctccatcctcctgtctgcaaccgtgggancagtgcacntcacttgccggcaagtcgaacnttgacactattaagtgtatcaacatagacaggaccgtccctagctctaatctancgactgtacacttaccagtttcacgtaaagggtcgggtacccagtaccggtaggttcgacggtcggacgtaggtgtactcggtacggggactaaggtactttacacgttccgttaccaccgtacttacgtaacgttaacttacgtacggaccgttaaacggttaggtaacgttattttaccgaactttaaactttacttaaccgttacgttaacctaaacgtaaacttaaacgttacgttaaacgttacggttttaccgggaaccgtaacgggtaacctaacggttaaacctaaacttaaacgttaaaccgtaacttacgggacgtactacggtacaccgttaattaccgtgttccttataccgttacccgttaccctaccgtacttaccgtagttaaccg

SEQ ID NO: 141757 - DNA, 673 bp, Homo sapiens
  misc_feature: GYAE6OF02JXMR7.46.67.G01.1.454.CMB.1.raw
  modified_base (213)..(213): a, c, t, g, unknown or other
  misc_feature (213)..(213): n is a, c, g, or t
  modified_base (248)..(248): a, c, t, g, unknown or other
  misc_feature (248)..(248): n is a, c, g, or t
  modified_base (265)..(265): a, c, t, g, unknown or other
  misc_feature (265)..(265): n is a, c, g, or t
  modified_base (273)..(273): a, c, t, g, unknown or other
  misc_feature (273)..(273): n is a, c, g, or t
  modified_base (334)..(334): a, c, t, g, unknown or other
  misc_feature (334)..(334): n is a, c, g, or t
  modified_base (361)..(361): a, c, t, g, unknown or other
  misc_feature (361)..(361): n is a, c, g, or t
tcagactagcagtacacgaccggtgctcgatttagagtatacatattgggtttggggacctcctgtgcaagaacatgaagcacctgtggtttgtcctcctgctggtggcagctcccagatgggtcctgtccctggtgcaactgcaggagtcgggcccacggactggtcgaggccttcggagaccctgtccctcacctgccgctgtctctggtncctccatcagtgtgtttctctgggctgggtccggnacgctccgaggagggcnggaatacngttcggaagtgtcgtcttcgagtagtggaggttcctagttacagtccgttctcctacaagngtaccgagtctaccgatactcttacgnggtaccacggttccaggtccaacgttcctagttttttccccagggtaatacgtgtagtttcgtggttacgaccgcccggtctcggtaaccgccgggttactttacgttaacgttgttcggccgtaaggcggaacgtccgtaatttcgtagttacgtttttagggaagtttggtttaacgtttcgaaccgttacccgttagtacgttaccggtaccgggggcttaccggtaccccggttagggtaccggaacgggttaacttacggtccgttccggaccccgtttggttaccccgtttagccccgtaacccgg

SEQ ID NO: 141758 - DNA, 678 bp, Homo sapiens
  misc_feature: GYAE6OF02JP6L4.46.67.G01.1.454.CMB.1.raw
  modified_base (191)..(191): a, c, t, g, unknown or other
  misc_feature (191)..(191): n is a, c, g, or t
  modified_base (214)..(214): a, c, t, g, unknown or other
  misc_feature (214)..(214): n is a, c, g, or t
  modified_base (226)..(226): a, c, t, g, unknown or other
  misc_feature (226)..(226): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgganacagtgcacatcacttgccgggnaaggtcggaacnttgacacctattaaatggtatcaacatagaccaggacggccctaagctcctaatctatgctgcatcctagtttgacaaaggttcgggtcccagtccggtagttcgagtggctaggtaggatccgtaggggactaggtactttacgaccttccgtaccaccgtattaccgtaaacgttaacttacgtacgtaccgttaaacggtacggttaaaagttacgtttttaggaaccttaaaccgttttaatttaacgttacgttaaccgtaaactaaggttaaactttaaccgaagttttacggttttaccggaaccgtaaacgggtaacctaaccgtaacttaaaccgaaaacgtttaaaccggaacttacggttacggtaccttagaccgtaacctattacgtacgttacctttacgtacttcccgttacccgtaccttacgtaccttaggtaac

SEQ ID NO: 141759 - DNA, 736 bp, Homo sapiens
  misc_feature: GYAE6OF02J222S.46.67.G01.1.454.CMB.1.raw
  modified_base (155)..(155): a, c, t, g, unknown or other
  misc_feature (155)..(155): n is a, c, g, or t
  modified_base (161)..(161): a, c, t, g, unknown or other
  misc_feature (161)..(161): n is a, c, g, or t
  modified_base (255)..(255): a, c, t, g, unknown or other
  misc_feature (255)..(255): n is a, c, g, or t
  modified_base (357)..(357): a, c, t, g, unknown or other
  misc_feature (357)..(357): n is a, c, g, or t
  modified_base (482)..(482): a, c, t, g, unknown or other
  misc_feature (482)..(482): n is a, c, g, or t
  modified_base (497)..(497): a, c, t, g, unknown or other
  misc_feature (497)..(497): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagccngacccngtcctccactccctccctgtctagcctaaccggtggagaccagtcgtaccaccatccgtacgttcggacccgggtactaacggtacggaacctnttacgaacctaaccctttaattttaaaaccgttggtaactccgtaacacgtacggacccggacgggtacccgaccccgtaagcctaccttaatctatcgacncgtactactcgttagttcgacgtaacggtccgggtaccctagtccggtacgttgacggtcggacctggtacggctcggtagggacttacgtctttaccacgtcctacacctagtcctagttaacngttacacgaacgttntaagtttccttagaacttactacgttactactacaacgtaacgtactttaaccgtgttaccggttacggaacccgaacggttaacctaaccggtaaccttaaacgtaaaccgtttaaacggacgttacgtacgtaccttacgtacccggtaaccttacggttactttaaccggtacccctttacgtttacccgtttacccggtaacccctcgttttaaccgacccttaacggttaaccg

SEQ ID NO: 141760 - DNA, 757 bp, Homo sapiens
  misc_feature: GYAE6OF02IDLLM.46.67.G01.1.454.CMB.1.raw
  modified_base (472)..(472): a, c, t, g, unknown or other
  misc_feature (472)..(472): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccggtgggagacagtgtacaccatctacgttcggccgggacaaaggtcgggaaactagtttcgaacctaacctttaattttaaaagttgggttaactaccaaactaataacggaaccgaacggggaccggacccctaaaggccttaccttaatcttagtcgtctcgacctactccgtagtttacgacgtaaacgggttcggggtacccagttaccggtaggtttcgaaggttcggacgtaggtggacgttcgtagggactagtacttcaactctacacatcgagttaacncgtacgacgtacgtagtaagttatttacgacctttaaattacttaacgttagtacctaaagtagttaaactttaacgtaacgttttcgggtttaacccggaacggtaaacgggtaccctaaacgttaaccgttaaaaccgttaaaacgtttaaaaccggtaacgttacgggttaaccggaccttaccggtccttaaaccgtacgtttaccgttaaccgtttaccgtttaacccgttaccttaccccgttttaccccggactttaaccgtttcggtacttaaccgg

SEQ ID NO: 141761 - DNA, 548 bp, Homo sapiens
  misc_feature: GYAE6OF02FL1AX.46.67.G01.1.454.CMB.1.raw
  modified_base (348)..(348): a, c, t, g, unknown or other
  misc_feature (348)..(348): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccaggacgccctaagctctaatcatgctgcatccagtttgacaaaggtcggggtacccatcgtaggttcagtggcagtgatctgggacngtattcactctcaccatcagtatctgacaacgtagaagtatttagactaacttattactgtactaacaagtaacttactaattagtttacgacgtaagggtaacacgtactaacgtaaaacttaaacgaacttagtacgtactgacctactaatcttacgtacttacgtactccgttaccgtaccctacttactagtaac

SEQ ID NO: 141762 - DNA, 654 bp, Homo sapiens
  misc_feature: GYAE6OF02I0RIV.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcgcctccatcagtagtggtttctcgtgggctgggtccgcagctccgagggagggctaggaatacagttggaagtgtctctacagtaggtggaggttcctaattacgagttccgtctctacaaaggtgtcgtagttccacctatatctcgtggacaccgtcagcaatctacgttttccagaagtctgtacgttctgtcgaccgtcgctagacgtacgggttctttaatcgtggtcgcgagtacggtacggtattaacttagttaggttagttttaggacggtttagtttacttcggtaacctaccgtagtacgtacgggtacgggtacctacccggtacccggtaggggacccgtaagggtaacgttccggtacggtacctaccgttccttaccgttacgtccctaccgaccggtaacccggtcctacggtccggttacccttcccggacgtcccgtacccctcgtacccgtaagtccgtacccg

SEQ ID NO: 141763 - DNA, 658 bp, Homo sapiens
  misc_feature: GYAE6OF02GKFYN.46.67.G01.1.454.CMB.1.raw
  modified_base (252)..(252): a, c, t, g, unknown or other
  misc_feature (252)..(252): n is a, c, g, or t
tcagactagcagtacacgaccggtgctcgatttagagtatacatattgggtttgtcctcctgctggtggcagctcccagatgggtcctgtccctggtgcaactgcaggagtcggcccacgactggtgaggccttcggagaccctgtccctcacctgcgctgtctctggtgcctccatcagtagtggtttcttcgtggggctgggtccggcagctccaggggaagggctaggaatacattggaagtgtctctnataggtggaggttcctattacgagtccgtctctacgaagagttccgagtccaaccattatcctctggacctacgtccagctaaattctacgttttcccagaacgtattgtagttctgtcgtacccgcgctagaccgtacggggtacttttagtacttggtcgtacgtagaacggtacggtcttaagttagttggttacgtttttaggtagttgtttacgtttacgaccgtaccgtagtacgtcggtacggggtctaccggtaccgtcgggaccgtaagggaacgttacgtcgtaccgtacgtccgttacctacgtccctccgaacccgtaacgggacctaccggttcccggttacccgttcccccggtcgtcccgtaccccttacccgtacctacgaaccgtcccg

SEQ ID NO: 141764 - DNA, 693 bp, Homo sapiens
  misc_feature: GYAE6OF02GI5PB.46.67.G01.1.454.CMB.1.raw
tcagactagcagtacacgaccggtgctcgatttagagtatacatattgggtttggggagtctcggtcaggacacagcatggacatggagggtccccgctcagctcctggggctcctgctactctggctccgaggtgccagatgtgacatcgagctgacccagtctccatcctccctgtctgccaaccgtgggagacagtgtcaccatcacttggccgggacaaggtccggaacattcgactaccttaatttaaagttggtatcaacatacgaccgagggaccggaccctaagcctacctaatactatcgactcgcactccgtagtttcgacgtaaaggtcgggtaccctaagtcggtagttcgaggtcggactaggtcggtatcggtacggggtaactaggttactttacgactttcccgtacctaaccgtactttaccgtaaagttaaacgttcccgtaggtaaccgtaaacggttaaggtaaacgtttagttttacgaactttaaaccgttactttaaccgttacgtaacctaaacgtaagtaaacttactaagtttcggtttaccgacgtaaggaacctacggtaacttaacgtaaaacgttaacgaacgttagtcggtactacggactaacgtaacttcgtcttaccttactacctttccgttaccctaccgtacgtcctaggttaacc

SEQ ID NO: 141765 - DNA, 611 bp, Homo sapiens
  misc_feature: GYAE6OF02I6NT1.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagttggtttcttcgtgggctgggtccggcagctccgagggaagggctggaatacattggaagtgtctctcatagtggaggttcctattacagtccgtctctcgaagagtcgagtcaccatatctctggacacgtccagcaatctagttttcccagaacgatgtagttctgtcgaccgccgctggacgtacgggtcgtttattacgtgtgcgagacgtacggcttatagttgttagttttaggaggtttggtttactttcgaaccttaccgtagtacgtcggaccggggtcctaccggtaccccggtgggacccgtaaggggtacttacggtggtccctaccgtccttaccgttacgccctacccgacgaaccggccctagtcccgttaccttccccgcggtccaccccgtccgaccaccggtcgacccg

SEQ ID NO: 141766 - DNA, 697 bp, Homo sapiens
  misc_feature: GYAE6OF02GQ1PD.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacactatttaaattggtatcaacatagaccaggacgcccctaagcctactaatctatgctgcactcctagtttcgacgtaaaggtcgggtaccctagtcggtacggttaccgaggtcggacgtaggtggtagttccgtaggggaactaggtactttcaaccttctaccaaccctatacctaagttaactcctaggtacctaaacgtagtaaagttattttaggaccttaaacgtttaattacttagtactaaacaagtaaactttaactaaagtttcgttttaccgggaacccgtaaaggggacctaaaccggtaacttaaaccgtaaaaacgtttaaaaccgtaaaccgttaggtacggtacgttacgtacccgtaaaccgtaactttccgttacggttacccttttacctaaccgttttcccgtttaccccccggtaccgtaactttacccgtacgttaaaccg

SEQ ID NO: 141767 - DNA, 572 bp, Homo sapiens
  misc_feature: GYAE6OF02HPWEL.46.67.G01.1.454.CMB.1.raw
  modified_base (172)..(172): a, c, t, g, unknown or other
  misc_feature (172)..(172): n is a, c, g, or t
tcagactagcagtacacgaccggtgctcgatttagagtatacatattgggtttgtcctcctgctggtggcagctcccagatgggtcctgttccctggtgcaactgcaggagtcgggcccacgactggtgaggccttcggagaccctgtccctcacctgcgctgtctctggtncctccatcagtagtggtttctctgggctgggtccgcagctcccgagggaagggctggaatacagttggaagtgtctctcatagtggaggttcctattacagtccgtctctcaagagtcgagtcaccatatctctggacacgtccagcaatctagttttccctgaacgatgagttctgtcgaccgccgctgacgacgggtcgtttattactgtgcgagacgacggctatatgtattttggagttaggttattcgtactaccctagacgtcgacgggctcgacccgtgggccagggactacgtgtccgtaccgtcttccttaccgccctacccgacccgaacggcccacgtccggttcccttccccgcggtcccgtaccctcccctaccgacgtcgtacccg

SEQ ID NO: 141768 - DNA, 588 bp, Homo sapiens
  misc_feature: GYAE6OF02GVJW3.46.67.G01.1.454.CMB.1.raw
  modified_base (391)..(391): a, c, t, g, unknown or other
  misc_feature (391)..(391): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgcccctaagctcctaatctatgctgcatccagtttgcaaagtgggtcccatcgaggttcaggtgcagtgatcgtgggacagtatttcacttctacaccatcagtaatctgactaacgtgaatntttcgactaactttattactcgtaccaactacgaattactaattcgttttacgggacctaaaggggtaccaaccgtaaccttaactaaaacgtttaaaacgaacgttaggtaggacttacgacgtaaccctagtttaccgttcgtttaccttaccgttacttacccgttaccccgacccgtacttccgtagtaaccg

SEQ ID NO: 141769 - DNA, 650 bp, Homo sapiens
  misc_feature: GYAE6OF02IZFUD.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctcatcagtagtggtttcttcgtgggctgggtccgcagctccgagggacgggctaggaatacgagttggaagtgtctctactagtagtggaggtttcctaattacacgttccgtctctacaagagtcgagtcacatatctctgacacgtccagcatctacgtttccagaagtatgtattcgtgtcgaccgccgtcgtagacgacgggttacttttacgttacgtggtacgtacggtaagtacggtacggtacttacgttagttgtttacgttttggtaggttaggtttacttacgacctaccgtagtacgtcgggtacgggtccgtccggtacccggtcgggaccgtaacgggtaacgtacgttcgtacctaccgttcgttaccgtaccgcctaccgaaccgaaccgggtccctacgtcccgttcccgttcccccgtacggtcccttacccgtcccgtaacccgactacggtaccccg

SEQ ID NO: 141770 - DNA, 639 bp, Homo sapiens
  misc_feature: GYAE6OF02IN02D.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgagggagggctggaatacattggaagtgtctcgtcatagtggaggttcctattacagtccgtctctcaagtagtcgagtccacatatctcgtgacacgtccagtcaatcgtacgtttcccagaagtatgacgttctgtcgaccgtcgctagaccgagggttcttttaattacgtgtcgacgagagacgtacgtattagtgttagttttaggacggtttggttaatttccgaacgtacccgtaagtacgtaccgggtacggggtacctccggtaaccccggtcgggtacccgtaaggggtaacttacggtcggtacccgtaccgttccgttaccgtaccgtcccgtaccgaaccgaaccggtccctacgttcccggttacccttccccgtacggcctaccccgtcctaaccgacgcgtacccg

SEQ ID NO: 141771 - DNA, 625 bp, Homo sapiens
  misc_feature: GYAE6OF02F12SV.46.67.G01.1.454.CMB.1.raw
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatccacttggccgggcaaggtcggaacattgacaccttatttaaatggtatcaacatagaccgagggaccggcccctaaggcctacctaatctatcgctgcatcctagtttgactaaacggtcggggtacccagtcggtaggttcaggtggctagtggatcgtagggacagtattcgactctcacctatcaagtaactcgtagacaacgtagtaagtatttacgacttaacttacttacgtacgtactaactagttaaacttaactaatttcggttttaaccgggaccgtaaaggggtacctaacggtaaccttaaacgtaaaacttaaacgtaaacgttggtacgtactcggacctaacctattacctcgttaccttacgtacgttcccgtttacccgaccttacgttcctagttaaccg

SEQ ID NO: 141772 - DNA, 584 bp, Homo sapiens
  misc_feature: GYAE6OF02FY1Y2.46.67.G01.1.454.CMB.1.raw
  modified_base (337)..(337): a, c, t, g, unknown or other
  misc_feature (337)..(337): n is a, c, g, or t
  modified_base (342)..(342): a, c, t, g, unknown or other
  misc_feature (342)..(342): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgagggaaggggctggaatacattggaagtgtctctcatagtggaggttcctattacagtccgtctctcaagagtcgagtcaccatatctctggacacgtccagcaatctagttttcccngaagntgagttctgtgaccgccgctgacacgggtcttttatactgtgcgagagacggctattatgtattttggagttggttatttcgactacccgttagacttcggacggggtcctccggtaccccgtggggcccgagggaactacgtagggtccaccggttctccttacgccctccgaccgaacgggccctacgtccggttcccttcccccgtggccctacccctcccgtacccgagacgtacccg

SEQ ID NO: 141773 - DNA, 627 bp, Homo sapiens
  misc_feature: GYAE6OF02INB78.46.67.G01.1.454.CMB.1.raw
  modified_base (193)..(193): a, c, t, g, unknown or other
  misc_feature (193)..(193): n is a, c, g, or t
  modified_base (249)..(249): a, c, t, g, unknown or other
  misc_feature (249)..(249): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgtcacatcacttgccggcaagtcggaacattgacactatttaatgatcaanatagaccagggaccgccctagctacctaatctatgctgacatcctagtttagactaaaggtcggggtccaacgtccggaggttcaggtggctagtcggtatcgttaggggaacctaggtactttccgactctacgacctatccgtaagtaactcgttacgactaacggtagtaagttagtttttagaccttaaactttacttacgttacgtactaaactaacgtaaattaactaagtttacggttttaccggacctaaaggggtacctaaacgtaacgttaaacctaaaaacgtttaaacgaacgttagttacggactacggacctaccgattccttagttcctacgtaccttcccttacccgacctattcctagtac

SEQ ID NO: 141774 - DNA, 741 bp, Homo sapiens
  misc_feature: GYAE6OF02HEG2T.46.67.G01.1.454.CMB.1.raw
  modified_base (152)..(152): a, c, t, g, unknown or other
  misc_feature (152)..(152): n is a, c, g, or t
  modified_base (212)..(212): a, c, t, g, unknown or other
  misc_feature (212)..(212): n is a, c, g, or t
tcagactagcagtacacgaccggtgctcgatttagagtatacatattgggtttgtcctcctgctggtggcagctcccagatgggtcctgtccctggtgcaactgcaggagtcggcccacgactggtgaggccttggagtaccctgtcccttnaccctgcgctgtctctggtgcctccattcgagtagtgtttctcgtggggctagggtccgnagcctccgagggacgggctggaatactattaggaagttcgtctctcagtagtggtaggttctattacagtccgtcgtctcgaagaggtcgagtcacatatctctgacacgtccagcaatctacgtttcctagaatatgtagttctgtcgaccgcgtcgtagaaccgtacggggttctttttaattaccgttggttgaccgtaaggacggtaccgggtacttaagtttagttaggtttaagtttttgggtaggttttggtttaacgtttccgtaacccgtacccgttaaggtacggttaccgggtaccgggggtccgttacccgggtaaccccggttcgggggacccgtaacggggtaacttaaccggtcggttacccgtacccggttaccgttacccgttaacgtccccgttacccgaacccggtaacccggggtaccctaacggttccccggttccccgtttacccccggtaccggtacccccttacccccgttaccccgtaacccgtaaccggtaaccgtcccccgg

SEQ ID NO: 141775 - DNA, 615 bp, Homo sapiens
  misc_feature: GYAE6OF02H5GW6.46.67.G01.1.454.CMB.1.raw
  modified_base (347)..(347): a, c, t, g, unknown or other
  misc_feature (347)..(347): n is a, c, g, or t
  modified_base (392)..(392): a, c, t, g, unknown or other
  misc_feature (392)..(392): n is a, c, g, or t
  modified_base (407)..(407): a, c, t, g, unknown or other
  misc_feature (407)..(407): n is a, c, g, or t
tcagactagcagtacacgaccggtgctcgatttagagtatacatattgggtttgtccctcctgctggtggcaggctcccagatgggtcctcgtccctggtgcaactgcaggagtccgggcccacgactggtgaggcctttcggagaccctgtccctcacctgcgctgtctctggtgcctccatcagtagtggtttcttcgtgggctgggtccggcagctcccgagggaaggggctagggaatacagttgggaagtgtctctcatagtggagttcctaattacagtccgtctctcaagagttcgagtcaccatatctctggacacgtccagcaatctagttttccccngaacgatgagttctgtcgaccgcgctgacacgggtcttttatacngttgcgagacgacgntatatgttagttttggagttgttatttcgactacctagactcggacggggctcgacccgtgggcccaaggggtaactacgtcggtccaccggttccttaccgttacgcccttacccgaaccgaacgggtcccctaagttccccggttccctttcccccccgttgggacccctacccccgtttaccctaccgtaaccgaccgtaccccg

SEQ ID NO: 141776 - DNA, 777 bp, Homo sapiens
  misc_feature: GYAE6OF02GZ3WB.46.67.G01.1.454.CMB.1.raw
  modified_base (213)..(213): a, c, t, g, unknown or other
  misc_feature (213)..(213): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtcccctcacctgcgctgtctctggtcncctcatcagttgttcgtttctcgtcgggtcgtcgggtccgcacgtccgtaccggaaggggacgggcgtaggaactacgtagttaggacgtgtctctactagtaggtggtacgttaccttagttacgtacgtccgtctcctacgaacgtagtcgtacgtacaacctatacttctcgtacgacctacgtacctagactaacttccgttaaccgttttcccgtagaacgtagtacggttacgttcgttacggtaccgtacccggccgtacgtacgaccgggttacgggttacgtttaacgttacgtggttacgtacggtacggacggtacgtactttaagttacgttagttttacggttttagggttacggtttacggtttttaacgttaccggttaacccgttaccgttaacggtacggtacccggggtaaccgggggttcccgtaaccccgggtaccccggggtacggggtaacccgggtaacgggtaaccggtttacggttaccgggttacccgttaccccggtttaccccgtttaccgttacccggtaccccttaaccccggg

SEQ ID NO: 141777 - DNA, 602 bp, Homo sapiens
  misc_feature: GYAE6OF02IA87A.46.67.G01.1.454.CMB.1.raw
  modified_base (251)..(251): a, c, t, g, unknown or other
  misc_feature (251)..(251): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggcctttcggagacccctgtcccctcacctgcgctgtctctggtgcctccatcagtagtgtttcttctggggctgggtccgnagctccgagggaaggggctggaatactattggaagtgtctctcattagtggtacggttccttattacgacgttccgtctctacaagtgtcgagtcacatatctctgaccacgtccagacaattcgtacgttttacccagaacgtatcgtagtttcgtgttcggacccgccgtctgaccgtacgggtaccgttttaagttacgtgtgacggtagacgacgtctattattgttagttttgagttgtttacttacgaccaccgtagagtcggacggggtcctccggcccggtagggaccgtagggtaacttacgttggtacccgtaccgttcttacccgttaccgcctaccccg

SEQ ID NO: 141778 - DNA, 641 bp, Homo sapiens
  misc_feature: GYAE6OF02F7TSA.46.67.G01.1.454.CMB.1.raw
  modified_base (213)..(213): a, c, t, g, unknown or other
  misc_feature (213)..(213): n is a, c, g, or t
  modified_base (379)..(379): a, c, t, g, unknown or other
  misc_feature (379)..(379): n is a, c, g, or t
  modified_base (386)..(386): a, c, t, g, unknown or other
  misc_feature (386)..(386): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggcccttcggagaccctgtcccctcacctgcgctgtctctggtncctccatcagtagtggtttctctggggctgggtccgcagcctcccgagggaagggctggaatacatttggaagtgtctctcatagtggaggtttcctattacagtccgtctctcaagagtcgagtcacctatatctctggacacgtccagcaatctagttttcccngtaaagntagtacgtttcgtaggtcgacccgccgtacgtagaccgacgggttacgttttaatccgttggttggacgaaggtacggtaccggtcttaagtttataggttaagttttttagggagtttaggttttacgtttacggaaccttaccctaagggtactaccggggaccgggtccgttacccggaccccggtggggtacccgagggtaacgttacggtacggtcctaccggttcccgtccgtttacgccctaaccccg

SEQ ID NO: 141779 - DNA, 585 bp, Homo sapiens
  misc_feature: GYAE6OF02FSV3I.46.67.G01.1.454.CMB.1.raw
  modified_base (288)..(288): a, c, t, g, unknown or other
  misc_feature (288)..(288): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgagggaagggctggaatacattggaagtgtctctcatgtggaggttcctattacagtccgtctctcaagngtcgagtcaccattatctctggactacgtccagcaatctagttttccctagaagatgagttctgtgaccgccgctgacacgggtcgtttattaccgtgtgacgagaggacggctattatgttagttttggagttggttatttcgactaccctagtagtcggacggggtctccggacccgtggggccgagggtagtaccgtggtccaccgtctaccgtacgtccctccgaccgacgggcccagtcccgtaccctttccccgtaccggccctaccccgtccctccgacgacgtaccccg

SEQ ID NO: 141780 - DNA, 640 bp, Homo sapiens
  misc_feature: GYAE6OF02I9TIR.46.67.G01.1.454.CMB.1.raw
  modified_base (192)..(192): a, c, t, g, unknown or other
  misc_feature (192)..(192): n is a, c, g, or t
  modified_base (387)..(387): a, c, t, g, unknown or other
  misc_feature (387)..(387): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgaccacctatttaaatggtatcaacatagaccagggacgcccctaagctctaatctatgctgcatccagtttgacgaaaggtcgggtcccatcggtaggttcaggtggcgagtggatcgtgggacagtattcactctaccaccatcagtaatcgtanacgtaacgtgtaagttattttacgacctaaacgtttacttaacgttacgtactaaacgtaagttaaacttaactaagtttacggtttacggaacccgtaaagggaacctaacgtaacttaaaaccgtaaaacgttaaaacggtaacgttaggttacggtacttacggaaccctaaccgttaagttccgttaccgttacctttaccgtacctttaccccgtttccccgtacccttacgttaccgtacgtaaccg

SEQ ID NO: 141781 - DNA, 512 bp, Homo sapiens
  misc_feature: GYAE6OF02GGC6K.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgcccctaagctcctaatctatgctgcatccagtttgcaaagtgggtcccatcgaggttcagtggcagtggatcgtgggacagatttcactctcaccatcagtaatctgcaacgtgaagtattttgactaacttattacttgtacaacagaattacaattgtttcgacaagggtacacgacttaacaaattaaacgaactgtaggctgacacatctgtcttcactccttcccgctactctgtaac

SEQ ID NO: 141782 - DNA, 771 bp, Homo sapiens
  misc_feature: GYAE6OF02HACBN.46.67.G01.1.454.CMB.1.raw
  modified_base (208)..(208): a, c, t, g, unknown or other
  misc_feature (208)..(208): n is a, c, g, or t
  modified_base (366)..(366): a, c, t, g, unknown or other
  misc_feature (366)..(366): n is a, c, g, or t
  modified_base (397)..(397): a, c, t, g, unknown or other
  misc_feature (397)..(397): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgcctgtctctggtgcctccatcagtagtggtttctctgggctgggtccgnacgctccgagggtagggctggaatacgagttggaagtgtctctacagtagtggacgttcctagttacaggttccgtcttacgtcgaagtaggtccgaagtccacctatactctcgtaggacctacgtcaacgctaatcgtaacgttttccaggaactntgtacgttctacggtacgtacccggcccgtnttacggaaccggacggggtttacctttaagttaccgtagtcggtaaccggagtacggtaacggtccttaagttaagttaggttaagttttgggttaaggttaggtttaacgtttaccggtaacgttaaccccgttaaggtaccgttacgggtaccggggtaccggttacccggtaccccgggttaccggggtacccgggtaacgggtaacgttacccgggttacggttacccgtaaccggttacccgttaccgttacccgtacccgtaccccgtaaccgtaaaccgggtcccgtaaccggttcccggttacccgttcccccgtacggttaccccctacccgttaccccgtaccgtaaccgtaccgtaaccccgg

SEQ ID NO: 141783 - DNA, 604 bp, Homo sapiens
  misc_feature: GYAE6OF02GAGAG.46.67.G01.1.454.CMB.1.raw
  modified_base (236)..(236): a, c, t, g, unknown or other
  misc_feature (236)..(236): n is a, c, g, or t
  modified_base (339)..(339): a, c, t, g, unknown or other
  misc_feature (339)..(339): n is a, c, g, or t
  modified_base (393)..(393): a, c, t, g, unknown or other
  misc_feature (393)..(393): n is a, c, g, or t
  modified_base (398)..(398): a, c, t, g, unknown or other
  misc_feature (398)..(398): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgnggggctgggtccggcagcctccgagggaagggctaggaatacattggaagtgtctctcataggtggtacggttcctattacagttccgtacgtctacgaacgngtacgagtcaaccagtatcgtactggacacgtccagactaatctagttttcccngtaantagtagttctgtcgaccgcgtcgtcgacgtacgggtcgtttagtactggtgacgtagacgacggtcttattagtgttagtttttggagttggtttacgtttacgactacccttagacgtcggacggggtactccggtacccgtcgggtaccaagggtaacttacgtacggtccgtaccgttccgttcccgtacgtccctaacccgg

SEQ ID NO: 141784 - DNA, 689 bp, Homo sapiens
  misc_feature: GYAE6OF02F5PO3.46.67.G01.1.454.CMB.1.raw
tcagactagcagtacacgaccggtgctcgatttagagtatacatattgggtttggggagtctcggttaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaatggtatcaacatagaccaggacgcccctaagctcctaatctatgctgcatccagtttgctaaaggtcggggtacccagtcgaggttcagtggcagtgatcgtagggacaggtactttcgaacctctaccgaaccagttcaaggttaattccgtagtaccgtaaacgtaggtaaacggttattttacgaacttaaacgtttaacttaaccttagttaccgtaaacttaagtaaactttaaacgtaacgtttcggtttttaaccgggaaccggtaacgggtaacctaaaccgtaaaccgttaaaccgtaaaacgttaaaaccgtaaacgttacggttacggtaccttacggacctaacccgtaaactttccgttaccggtttacctttaccttaaccgtttcccgtttacccccgtcccttaacttccgttacggtaacttaacccgg

SEQ ID NO: 141785 - DNA, 697 bp, Homo sapiens
  misc_feature: GYAE6OF02HRCMT.46.67.G01.1.454.CMB.1.raw
  modified_base (192)..(192): a, c, t, g, unknown or other
  misc_feature (192)..(192): n is a, c, g, or t
  modified_base (310)..(310): a, c, t, g, unknown or other
  misc_feature (310)..(310): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttcgcccgggacaaggtcggaacattacgaccaccttaatttaaattggtatacaacaatacgaccgaagggaccgacccctaagctacctaatctatgctncatccgtagtttagacgtaagtcgggtaccagtcggaggtttcgagtgcgtagtggtatcgtgggactaaggtactttacacgttacctacctacctaattaccgtaagttaaacttccgtacgaacgttaacggtagtaaagtttacttttacggaacttaaacgttttaacttaaccgttagttaacaaacgtaaattaaactttaactaacgtttttcggttttaccggaaaccggaaacgggtaaacgtaaccggtaaacttaaaccgtaaaaagttaaaccggtaaaccgttagtacggtacgtacgtacctaaccgtaattccgttagttacccttacgtacctttcccgttacccgtaccttaagttcccgtagttaacg

SEQ ID NO: 141786 - DNA, 556 bp, Homo sapiens
  misc_feature: GYAE6OF02GZ1T9.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccgtgggagacagtgtcacatcacttgccggcaagtcggaacattgacacctatttaaatggtatcaacatagaccagggacgcccctaagctcctaatctatgctgcatccagtttgacgaaagtcggggtcccagtcggtaggttcaggtggcaggtggatcgtgggacagtatttcactctcacatcagtatctgacaagtgaagttatttgactaacttattacttgtactaaactagtaatactaattggtttacgaccgaacggtacgacgtactaactaaactaaactaacgtacgtaggtctacgcaacctacttacgtcttacgttacctacttccttcccgtacctacctcgtacgttaacg

SEQ ID NO: 141787 - DNA, 575 bp, Homo sapiens
  misc_feature: GYAE6OF02HCM1R.46.67.G01.1.454.CMB.1.raw
  modified_base (212)..(212): a, c, t, g, unknown or other
  misc_feature (212)..(212): n is a, c, g, or t
  modified_base (250)..(250): a, c, t, g, unknown or other
  misc_feature (250)..(250): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtcncctccatcagtagttggtttctcgtgggctgggtccgnagcctccgagggaaggggctaggaatacgtagtggaagtgtctctcagtagtggaggttcctattacgagttccgtctctcaagtagtcgagtcacctatatacctctaggacacgtccagcaatctacgttttccctagaagtatgtagttctgtcgaccgccgtctgacgtacgggtcgtttacttatcgtgcgagagacgtctattatgttagttttggtagttggtttatttacgactacctagacgtcgacggggtctcggtccccgtgggcgaacgggtaataccgtcggtacacccgttctccgttacgccctacccg

SEQ ID NO: 141788 - DNA, 639 bp, Homo sapiens
  misc_feature: GYAE6OF02H6UUW.46.67.G01.1.454.CMB.1.raw
  modified_base (191)..(191): a, c, t, g, unknown or other
  misc_feature (191)..(191): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatccctcctgtctgcaacgtgganacagtgtcacatcacttggccgggctaaggtcggaactattcgactaccttatttaattggtatacaacatagaccgagggaccgacccctaagctcctaatctatcgctgactactccgtagtttcgacgtaaaggtcgggtacccagtcggtaggttcgaggtggctaggtggatcgtagggactagtatttccgacttctaccgtacctatacgtaacgttaactcgtacgacgtaacggtataaggttacttttagacttaaactttattacttcgttaactaacgtaattaaacttaacgtaagtttacggtttaccggaaccgtaggacctaacgtaactaacttaaaagtaacggtaactggtaacgtctaacgactacgtacgttcttacgtttacctacgtacctttcccttacccgtaccgttattccgtattaaccg

SEQ ID NO: 141789 - DNA, 640 bp, Homo sapiens
  misc_feature: GYAE6OF02HZSCJ.46.67.G01.1.454.CMB.1.raw
  modified_base (191)..(191): a, c, t, g, unknown or other
  misc_feature (191)..(191): n is a, c, g, or t
  modified_base (385)..(385): a, c, t, g, unknown or other
  misc_feature (385)..(385): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccagactggtgaggccttcggagaccctgtccctnacctgcgctgtctctggtgcctccatccagtagttggtttctcgtggggctgggtccggcagccgtccgagggaacggggctaggaatactagttcggaagtgtctctcatagtggagttcctattacagtccgtctctcaagagtcgagtcactatatctcgtggacacgtccagcaatcgtacgttttcccngtaagtagtgtagttcgtgtcgacccgccgtctacgtacgacgggtcgttttacttacgtgttcgcgtagacggtacggtattattagttgttaagtttttggaggtttaggtttacgtttacgtaaccgtaccgttaagtacgttaccgggacgggggtcctacccgggtacccggtcggggaccgtaaggggtaaccttacggttcggttaccgtacccggttccgttacccgttacggtcccttaaccccgg

SEQ ID NO: 141790 - DNA, 611 bp, Homo sapiens
  misc_feature: GYAE6OF02GP3PW.46.67.G01.1.454.CMB.1.raw
  modified_base (376)..(376): a, c, t, g, unknown or other
  misc_feature (376)..(376): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggcctttcggagaccctgtccctcacctgcgctgtctctggtcgcctccatcagtagtggtttctctggggctgggtccgcagctccgagggaggggctggaatacagttggaagtgtctctcatagtggaggttcctattacagttccgtctctcaagagtcgagtcaccatatctctggacacgtccagcaatctagttttcccngaagtgtgtacgtttctagtcgacccgccgctcgaaccgtacgggtcgttttattacgtggttcggacgaggacgacggtcttattagttgttagtttttggagtttggtttatttccgaacctaccgtaagtagtacgggacgggggtcctccgggacccccggttgggggacccgaagggttaactacggttcggtaccgtacccgttcgttcccttacgcccctaaccccgg

SEQ ID NO: 141791 - DNA, 719 bp, Homo sapiens
  misc_feature: GYAE6OF02J2ZGX.46.67.G01.1.454.CMB.1.raw
  modified_base (193)..(193): a, c, t, g, unknown or other
  misc_feature (193)..(193): n is a, c, g, or t
  modified_base (205)..(205): a, c, t, g, unknown or other
  misc_feature (205)..(205): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgtcaccntcacttgccggcaagtcgacatgacactattaatgtatcaacatagaccaggaccgcccctaagctcctaatctactgctgcacttccagtttacgacgtaaaggtcgggtcccaagtccggtaaggttcaggttcggacgaggtcggtactacgttcgggaactaggtactttccgacctctaccaccaatactaacgtattccgtgaacgtaaacgttacggtaaagttacgttttacgtacctaaacgtttacgttaccttacggtaacctaaagttactaaacgttacgtaacgttttacggttacccggtaaccgaaacggtaacctaaacgtaccgttaaaaccgttaaaacgtttaaaacccgaacgttttacggaccggttaccgtaacgttaccctaaacccggttaacttacccggtttacggtttaccctttaacccgttaaccggttttacccccgttaacccccgttacggttaaccctttcccgtttaaggttaaccccg

SEQ ID NO: 141792 - DNA, 737 bp, Homo sapiens
  misc_feature: GYAE6OF02HKYXY.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgaactactatttaaatgtatcaacatagacaggacgccctaagctacctaatctatcgctgcatcctagtttacgacgtaaaggttcgggtacccaagttcggtaacggtttcgaaggtcggaccgtaggttcggaagttcgtaggggtaactaggtacttttccgaccttccttaccacctatccgtaagttaacttccgtacggtaaccgtaaaccggttagtaaacgttacgtttttacgaaccgttaaacgttttacttaacgttacgttaacaaacgtaagttaaactttaactaaacgtttcggtttttaaccgggaaccgtaaagggtaaccctaaacgtaacccgtttaaactaaaaccgtttaaaacgtaaccgttaggttaccggtacgtaccggtaccgtaaaccgtactttaccggttacggttacccctttaacgttaacccgtttaccccggtttaccctaccccgttaacgtttacccggtagttaaacccg

SEQ ID NO: 141793 - DNA, 640 bp, Homo sapiens
  misc_feature: GYAE6OF02GJE8M.46.67.G01.1.454.CMB.1.raw
  modified_base (227)..(227): a, c, t, g, unknown or other
  misc_feature (227)..(227): n is a, c, g, or t
tcagactagcagtacacgaccggtgctcgatttagagtatacatattggggtttggggagtctcggtcaggacacagcatggacatgacgggtccccgctcagctccgtggggctcctgctactctggctccgaggtgccagatgtgacatcgagctgacccagtctccatccctccctgtctgacaaccggtgggagacagtcgtcaccatcacttggcccggganaaggtccggaactatttcgaaccaccttaattttaaacgttggttaatcaaacataacgaccgacgggaccggacccctaagctacctaatctaatgctgcatcctagtttgacgtaaaggtcggggtacccagtacggtaggttacaggtggctaggtggtatcggtagggactagtactttcgactctacaccgattcaacgtatctagacgtaacggtagaagttattttagaccgttaattacttagttacgtactaaactaagtaaacttactaaagttcgtttacggacgtaacgggtacaacgtaactaaactaaacgtaaacgtaacgtagtacgacgtacaccgtaacgtactcgttacgttacgtactacgttcccttacccgtcctacgttcctagttaccg

SEQ ID NO: 141794 - DNA, 589 bp, Homo sapiens
  misc_feature: GYAE6OF02J0OQY.46.67.G01.1.454.CMB.1.raw
  modified_base (546)..(546): a, c, t, g, unknown or other
  misc_feature (546)..(546): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtgggctgggtccggcagctccgagggagggctggatcattggaagtgtctctcatagtggaggttcctattacagtccgtctctcaagagtcgagtcaccgatatctctggaccacgtccagcaatcgagtttttccccagaacgatgtacgttctggtcgaccgccgtctagaccgtacgggtcgttttactacgtgtcgcgaggacgtacggcttagttatgtacgtttttggagttggtttattcgaacctaccgtagtactcgggacgggtctccggacccgtggggacccgtagggaacttcgtggtccaccgtcttacctacgtccctacgaccgaacgggcccngtccggttcctccccgtcgcctaccctccaccgtagcctaccg

SEQ ID NO: 141795 - DNA, 631 bp, Homo sapiens
  misc_feature: GYAE6OF02F1P10.46.67.G01.1.454.CMB.1.raw
  modified_base (284)..(284): a, c, t, g, unknown or other
  misc_feature (284)..(284): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtgggctgggtccgcagctccagggagggctggaatacattggaagtgtctctcatagtggaggttcctattacagtccgtctctcaagngtcgagtcaccatatctctggacacgtccagcaatctacgttttcccagaacgatgtagttctgtcgaccgccgcgtgaccgtacgggtctttagttactgtgcgagagcggtctattatgttagttttggagttgttatttcgaactacccgtagacgtcggaccggggtctccggtaccccggtggggacccgagggtaactacgtcggtaccctaccggttccttacccgttacgccccttacccgaacccgggtaaccgggcccctaaccggttcccgggttcccctttaccccccggtcggtacccctacccccgttccctacccgaacggaccgtaccccg

SEQ ID NO: 141796 - DNA, 548 bp, Homo sapiens
  misc_feature: GYAE6OF02FG86X.46.67.G01.1.454.CMB.1.raw
  modified_base (420)..(420): a, c, t, g, unknown or other
  misc_feature (420)..(420): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctcctaatctatgctgcatccagtttgcaaagtggggtcccatcgaggttcagtggcagtggatctgggacagattcactctcaccatcagtaatctgcaacgtgaaagtattttgacaaacgttattacttagtactaacanaattacaatttgttttacggaccgtaagggaactaacgaacttaaactaaaacttaaaacgaacgttagtaggctagcctaaccctatctacgtcttacacttccttcccggcctactcgtagtaacg

SEQ ID NO: 141797 - DNA, 679 bp, Homo sapiens
  misc_feature: GYAE6OF02G385P.46.67.G01.1.454.CMB.1.raw
tcagactagcagtacacgaccggtgctcgatttagagtatacatattgggtttgggggagtcgtcggtcaggacacagcagtggaccatgagggtccccgctcagctcctggggctcctgactactctggctccgaggtgccagtagtgtgacatcgtagtctgacccagttactccatcctcctgtctgcaaccgtggagacagtggtcacagtcacgttcgggccgggtcaagtcggaacattgacaccgttatttaaacttggtatctaacatacgtaccagggccggacccctaagctactaatctagtgcctgctacgtccgtaggtttcgacgaaggttcgggtcctagtccgtagttcagtcgcagtggatcgtaggactagtacttcacgtctacaccgactacgtaactacttccgagactaacggtagtaagttacgtttagaccttaaacttacgttacgtacgtaacgaaaccgtagtaactttaccgtaattcgggtttaaccgaaccggtaaacgggactaaccggtaaacctaaaacgtaaaagttaaaccggtaacgtacgttaacggtcctttaggacccgttaacctattaccgtaacgtttaccttaccgttaccgttaacccggtttacccttacctttacggttccgttattaaccgg

SEQ ID NO: 141798 - DNA, 625 bp, Homo sapiens
  misc_feature: GYAE6OF02HEK3R.46.67.G01.1.454.CMB.1.raw
  modified_base (211)..(211): a, c, t, g, unknown or other
  misc_feature (211)..(211): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttctcgtggggctgggtccggcagcctcccgagggaggggctggaatacagttggaagtgtctctcatagtggaggttcctattacagtccgtctctcaagacgtcgagtcaccatatctctggacacgtccagcaatctacgttttcccagaatactagtagtttctggtacgacccgtcgctacggaccgtacggggttacgttttataccgtggttcgacggtagacggacgtacttagtttagtagttagtttttgggagtttggtttaacttttcggtaacctaccgttagacgtccgggtacgggggtcctccggtaaccccgtcgggggaccgtaacgggaacttccggtaggtccgtacccgttcttacccgttacgtccctaacccgg

SEQ ID NO: 141799 - DNA, 764 bp, Homo sapiens
  misc_feature: GYAE6OF02GWAPG.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcacatcacttcggccgggacaagtcggaacattgacacttatttaaatgtatcaacatagacagggacggccctaagctcctaatctatgactgacactcctagttttcgacaaaaggttcggggtaccctaagttcggtacggttacgaaggtcggtacgagggttcggtaacgtccggttaaggggaacgtaagttaacgtttaccgtaaaccgtttctaccgtaacctaacgttaccgtaaacggtttaaaccttcgttacggaaccgttaaacgggttaacggttaaagttaacgttttttacgaaccttaaacttttaacgtttaacgttacggtttaacctaaaacggtaagttaaaacgtttaaacgtaacgttttaccggttttaaccgggaccctaaaaggtaacgtaaaccgtaaccggttaaaccttaaacgttaaaaacgttaaaaccgtaaacgttcggtacgtacgtaccgtactaaaccctagttaccttacggtttacctttaccgtaccgttttaccccgttacccgtaccttacttacgttaaccgg

SEQ ID NO: 141800 - DNA, 591 bp, Homo sapiens
  misc_feature: GYAE6OF02IDZYO.46.67.G01.1.454.CMB.1.raw
  modified_base (288)..(288): a, c, t, g, unknown or other
  misc_feature (288)..(288): n is a, c, g, or t
  modified_base (558)..(558): a, c, t, g, unknown or other
  misc_feature (558)..(558): n is a, c, g, or t
  modified_base (583)..(583): a, c, t, g, unknown or other
  misc_feature (583)..(583): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggcctttcgggagacccctgtcccctcacctgcgctgtctctggtgcctccatcagtagtggtttctcgtgggctgggtccgcagctccgagggagggctggaatacagttggaagtgtctctcatgtggaggttcctattacagtccgtctctcaagngtcgagtcacccatatctctggacacgtccagcaatctagttttcccagaagatgagttctgtcgacccgccgtctgacgaccgggttcgttttattactgtgcgaggagacggtctaattatgttagttttgagttgtttattcgtacaccctagactcgggacggggtcctccgaccccggtggggcctaagggaattacgtcggtccacccgtcttaccttcgccctaccaccgacgggcccaagttccccggtacctttcccccgngtccctacccctcccgtacccacgntaccccgg

SEQ ID NO: 141801 - DNA, 536 bp, Homo sapiens
  misc_feature: GYAE6OF02IRR5P.46.67.G01.1.454.CMB.1.raw
  modified_base (180)..(180): a, c, t, g, unknown or other
  misc_feature (180)..(180): n is a, c, g, or t
  modified_base (515)..(515): a, c, t, g, unknown or other
  misc_feature (515)..(515): n is a, c, g, or t
  modified_base (533)..(533): a, c, t, g, unknown or other
  misc_feature (533)..(533): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctncaaccgtggagacagtgtcaccatcacttgccgggcaagtcggaacatgacacctatttaaattggtatcaacatagaccaggacgccccaagctcctaatctatgctgcactcctagtttgacaaagtcgggtccccatcgagttcagtgcgagtggatcgtgggacagtactttcactctacacctatcaagtatctagacaacgtgaagtatttgactaacttattactgtactaactaataattactaattcgtttacgaccgtaagggaccaacgtaacctaacgtaaaacttaaacgtaactagtaggtactgacactatctagtcttntacttctccgctactctntac

SEQ ID NO: 141802 - DNA, 536 bp, Homo sapiens
  misc_feature: GYAE6OF02I7S9N.46.67.G01.1.454.CMB.1.raw
  modified_base (192)..(192): a, c, t, g, unknown or other
  misc_feature (192)..(192): n is a, c, g, or t
  modified_base (425)..(425): a, c, t, g, unknown or other
  misc_feature (425)..(425): n is a, c, g, or t
  modified_base (488)..(488): a, c, t, g, unknown or other
  misc_feature (488)..(488): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattcgacaccttatttaaagtggtatcaacatagaccagggacgcccctaagctcctaatctatcgctgcatcctagtttgacgtaaggtcgggtcccagtcgtaggttcagtggctaggtggtatcgtagggacagtactttcactctcactatcagtatctagctaacgtgtaagtatttgactaacttattactntacaacataatactattgtttacgactaggacacgtaactaactaaataaacgtatgtgtacncgtacactactctacgttcttactactccttcccgctacttctagtac

SEQ ID NO: 141803 - DNA, 652 bp, Homo sapiens
  misc_feature: GYAE6OF02IKJK4.46.67.G01.1.454.CMB.1.raw
  modified_base (381)..(381): a, c, t, g, unknown or other
  misc_feature (381)..(381): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaatggtatcaacatagaccagggacgcccctaagctctaatctatgctgcatccagtttgcaaagtgggtacccagttcgaggttcagtggcagtgatcgtgggacaggtactttcacgtctacaccatccaagtaactntacgctaacgtagaagtatttacgacgtacttattacttacgtacaacgtacgtaacttaactaagttacgtttacggtaccgtaacgggtaaccgtaaccgtaaccgttaaaccgtaaaacgtttaaaaccgtaaacgttaacgttacggtaccttacgggggtaccctaacccgtaaccgtttaccgttacggtttacccgtttaaccgttacccgtttacccgtttacccccgttacccgttacccgttaccgttaccgttaaacccg

SEQ ID NO: 141804 - DNA, 594 bp, Homo sapiens
  misc_feature: GYAE6OF02JF2DY.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaattggtatcaacatagaccagggacgcccctaagctcctaatctatgctgcatccagtttgacaaagtgggtcccatcgaggttcagtggcagtggatcgtgggacagatttcactctcacatcagtatctgacaacgtgaatatttgactaacttattacgtgtacctaacgtagtaaactttaacaagtttcgtttaccggacctaaacggggacctaacggtaaacctaactaaaacgtttaaaacgaacgttaggtaggtaccttaggacctaacccttacttacgttacgttacctttaacctaccttacccgtttacccccggtactacgttacctaggttaaacc

SEQ ID NO: 141805 - DNA, 684 bp, Homo sapiens
  misc_feature: GYAE6OF02HVBS2.46.67.G01.1.454.CMB.1.raw
  modified_base (288)..(288): a, c, t, g, unknown or other
  misc_feature (288)..(288): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtgggctgggtccgcagctccgagggagggctggaatacagttggaagtgtctctcagtagtggtacggttcctattacgagtcgtctctcaagngtcgagtcacctatatctctgactacgtcacgcaatctacgtttccagaacgtatgtacgttcgtgtcgaccgtccgtactcgaccgtacgggttcttttagttacgtggttcgacgaggtacggtacggtcttaatttagtgtttaagttttagggaggtttaggtttacgtttaccgtaaccgtacccgttaagtaccggttacgggacggggtcccgttaccgggacccccggttggggacccgtaaggggtaaacgttaccgttcgggttcccgtaaccgttccgttacccgttacgtccccgtaccgtaacccggtaaccggcccgtacgttcccggttaccccttccccggtcggacccctcccgttacccgtacgaccgtacgtccccg

SEQ ID NO: 141806 - DNA, 573 bp, Homo sapiens
  misc_feature: GYAE6OF02HMDHH.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtgggctgggtccggcagcctccgagggagggctggatacagttggaagtgtctctcatagtggaggttcctattacagtccgtctctacaagagtcgagtcaccatatctctggacacgtccagcaatcagttttccctagaacgatgagttctagtgaccgcgctgacacgggtctttatacgtgtgcgagagacgcttatatgtattttggagttgttattcgactacctagacgtcgacggggcctcgacccgtggggaccgagggtaactacgtgtcaccgtctaccttacgcctaccgacccgaacggtcccctacgtccggttcccttaccccgtcggtccctaccccttcccgtaccgtaacgacgtacccg

SEQ ID NO: 141807 - DNA, 600 bp, Homo sapiens
  misc_feature: GYAE6OF02HZG3F.46.67.G01.1.454.CMB.1.raw
  modified_base (253)..(253): a, c, t, g, unknown or other
  misc_feature (253)..(253): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtccacatcacttgccgggcaagtcggaacattgacactaatttaaatgtatcaanatagaccaggacgcccctaagctcctaatctatgctgctatccagtttgacaaaggttcgggtcccagtcgaggttcagtggcagtgatcgtgggacagtattcactctcacctatacaagtatcgtagctaaacgtgtaaagtattttcgacttaacgttattactgttaacaaacgaagttaaattactaaattcgtttaccggtacgaaagggtaacctaacgtaacttaaaccgaaaattaaacgaacgtacgtacggtacttacggtaccaaccgtacttcttacgttaccttaccgtaactttcccgttaccccgtacccttaacttcccgttagtaaccg

SEQ ID NO: 141808 - DNA, 672 bp, Homo sapiens
  misc_feature: GYAE6OF02HRNCN.46.67.G01.1.454.CMB.1.raw
  modified_base (396)..(396): a, c, t, g, unknown or other
  misc_feature (396)..(396): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtcgcctccatcagttagttggtttcttcgtggggctgggtccggcagcctccgaggggaaggggctaggaatacgagttggaagtgtctctcatagtggtacggttcctaattacgacgttccgtctctcaagagtcgagtcaccatactctcgtacgacacgtccagcaatctacgttttccaganatgtattcgtgtcgaccgtcgctcgacgtacgggttctttattacgtggtcgacggagacgtacggtcttaagtttagtacggtttagtttttgggagtttacggtttacgtttaccgaaccgttaacccgttaaggtacgttacccggggtaccgggggtccttaccccgggtaaccccggttcggggggtaacccgtaacggggttaaccgttacggttccgggttacccgtacccggtttccgtttacccgttaccggtccccttaaccccgg

SEQ ID NO: 141809 - DNA, 608 bp, Homo sapiens
  misc_feature: GYAE6OF02GGSW2.46.67.G01.1.454.CMB.1.raw
  modified_base (373)..(373): a, c, t, g, unknown or other
  misc_feature (373)..(373): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgccaaccggtgggagacagtgtcaccatcacttggccgggcaaggtcggaacattgacaccttatttaaatggtatcaacatagaccagggacgcccctaagctctaatctatgctgcatcctagtttgctaaaggtggggtacccatcggaggttcagtggcagttggatcgtagggacagtacttcacttcnctaccagtacagttatctgactaacggtgaagttatttgacctaactttacgttactgtaacctaagataattactaattcggttttacgaccgtaaacggggtactaaccgtaacctaacgttaaaaccgttaaacgtaaccgttagttaaccggttctacggaccctaacctatttccgtacgtttaccttcgtaaccttcccgttaccccgactaccgttcgtattaacccg

SEQ ID NO: 141810 - DNA, 688 bp, Homo sapiens
  misc_feature: GYAE6OF02JOBME.46.67.G01.1.454.CMB.1.raw
  modified_base (264)..(264): a, c, t, g, unknown or other
  misc_feature (264)..(264): n is a, c, g, or t
  modified_base (445)..(445): a, c, t, g, unknown or other
  misc_feature (445)..(445): n is a, c, g, or t
tcagactagcagtacacgaccggtgctcgatttagagtatacatattggtttgggggaccgtcctgtgcaagaacatgaagcacctgtggtttgtcctcctgctggtggcagctcccagatggtcctgtccctggtgcaactgcaggagtcgggcccacgactgggtgaggcctttgggagacccctggtcccctcacctgccgctgtctctggtcgccctccatctagtagttggtttcttcgtggggaccttgggtcccggnagtcctcccgagggaggggctgggaatacgattggaacgtgtctcgtcagtgtggagttccgtattacgagttccgtcttccgagtaacgagttcgacgttcgaaccctagttacttactccgttaggaacctacgtacctacgcctaaacttccgtaacgttttttcccaggtaaacgtnttagtacgtttcgtagtcggtaccgtccgcgtcgaacgtaccgggtcgtttacttacgtcggttacgtcggacgtacggacgtacgtatttaaggtcgtttagtttttcgggtaggtttacgtttagttttacggtaacctaccttaggtacgttaccggacgggggttcacccggttaccggtcgggtaccggtacggtaccgttacgtcggtctaccgttaccgcctttacgccgtacccg

SEQ ID NO: 141811 - DNA, 680 bp, Homo sapiens
  misc_feature: GYAE6OF02JMXO6.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacaccttatttaaattggtaatcaacatagaccagggacggacccctaagctacctaatcctatgctgcaactcctagtttcactaaaggtcgggtcccaagtcggaggttcgtaaggtcggtcgaaggttcggattcgtaggggaacctaggtactttcgaaccttctaccgtaacctactcgtaacgttaacttccgtaggtacctaaacgggtagtaaacggtatttttacggacctaaacgtttaacttacttcgtactaaactaacgttaattaactaaagtttcgttttaccgggaacctaacggggtaactaaccggtaacgttaaacttaaaacgttaaaacgacgttagttcggtacttaggaccctaacctaattccgttacgtttacgtttccgaaagttcccttaccccggtacctaactaccggttaccttaacgg

SEQ ID NO: 141812 - DNA, 772 bp, Homo sapiens
  misc_feature: GYAE6OF02J1J4J.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagttggtttcttcgtggggctgggtccggcagcctcccgagggagggctggaatacgagttcggaagtgtctctcatagtggaggttacctattacacgttccgtcttcgtacaacgtcggtacgtacggtacctaaccctattactccttaccgtcgggtaaccctacgttacccgacgtaccgtaacttcgttaccgttttttacccctaggttaaagacgtttacggttaaacgtttccgtttggtaccggtaaccccggtcccggtaacgtcgtaaccggtaccgggttacgtttttacttaccggttggtcggttacggacggtacggtacggtacttactttaaggttccgttttaggtttttacgggttagggtttacgggttttacgtttaaccgtaccgttaccgtaacgggttacgtacccggggtacggggtacccgttcccggtaccccgggtaccgggtaccggtaacgggttaccgttacggtcgtttacccggaccggtttacccttcccggtttaccggccccgttaaccccgg

SEQ ID NO: 141813 - DNA, 657 bp, Homo sapiens
  misc_feature: GYAE6OF02JE30L.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtcgcctccatcagtagttggtttcttcgtggggtctgggtccggcagcctcccgagggaggggctggaatacagttggaagtgtctctcatagtggtaggttcctattacagtccgtctctcaagagtcgagtcacatactctgtacgacacgtccagcaagtctagttttcccagaacgtatgtagttcgtgtcgaccgcccggtacgtcgaaccggtacgggttacgttttaacttacgttggttacggcggtaaggacggaccggtacttaagttttagtagtttaggtttttagggtaggtttacggtttattttaccgtactacccgttaaggacgttccggggtacggggccgtacccggaccccggttcggggacccggtagggaacttacggtaccggttaccgtacccggttcctaccgttacggtcccctaaccccgg

SEQ ID NO: 141814 - DNA, 591 bp, Homo sapiens
  misc_feature: GYAE6OF02HFZP2.46.67.G01.1.454.CMB.1.raw
  modified_base (192)..(192): a, c, t, g, unknown or other
  misc_feature (192)..(192): n is a, c, g, or t
  modified_base (547)..(547): a, c, t, g, unknown or other
  misc_feature (547)..(547): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccggcaagtcggaacattgacaccttaatttaaagttgtatacaacatagaccgagggacgcccctaagctacctaatctatgctgcatcctagtttgactaaaggtcgggtccagtcgaggttcagtgcagtggatgtgggacagtacttcactctacactatactagttaactctgacgtaacgtagaaagttatttgaactaactttattacgtagttacagtactaagttaaattaactaagtttcggtttaccggaccgtaaagggtacctaacgtaacttaaacgtaaaacgttaaaacgtacttagggtcgtactacggaccaaccgtntactcgttccttacgtctacccgttccgaccttagtccgtaacg

SEQ ID NO: 141815 - DNA, 752 bp, Homo sapiens
  misc_feature: GYAE6OF02GCU6S.46.67.G01.1.454.CMB.1.raw
  modified_base (364)..(364): a, c, t, g, unknown or other
  misc_feature (364)..(364): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagcctcccgaggggaaggggtctagggaatacagttaggaagtgtctctcatagtggaggttcctattacagtccgtctctcaagagtcgagtcaaccatatctctggaccacgtccagcaaatctacgttttccccagaacgatgtagttcngttcgaccgcctcgtgaaccgtacggggtcttttaattaccgtgttcgacggtaggacggaccggtcttaacgttagtggttacgttttttagggaacggtttaggttttaacgttttccggaaccttaccccgttaaggtaacgttaccggggtaaccggggggtacccttcccgggacccccgggtttcggggggacccgtaaacgggggtaaacttaccggttacgggttacccgtaacccggttccgttacccgttaaccgtccccttacccgaaccccggtaaacggggtcccccttaacggtccccgggtttacccctttcccccggtcgggtccccttaccccccgtaccccgttacccggtaaccgcccggttaaccccg

SEQ ID NO: 141816 - DNA, 608 bp, Homo sapiens
  misc_feature: GYAE6OF02I8CNS.46.67.G01.1.454.CMB.1.raw
  modified_base (210)..(210): a, c, t, g, unknown or other
  misc_feature (210)..(210): n is a, c, g, or t
  modified_base (288)..(288): a, c, t, g, unknown or other
  misc_feature (288)..(288): n is a, c, g, or t
  modified_base (333)..(333): a, c, t, g, unknown or other
  misc_feature (333)..(333): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggnagctcccgagggagggctaggaatacagttggaagtgtctctcatagtggagttcctattacagtccgtctctcaagngtcgagtcaccgatatctctggacacgtccagcaatcattttccngaagatcgtagttctgtcgaccgcgtctggaccacgggtctttagtactgtcgcgagagtacggctattagtgttagttttggagttggttactttcgactaccctagactcggacggggtcctcgtacccgtggggccctagggtaactacgtcggtactacccggttcttaccgttagtcccttccgtaaccgtaacgggtccctaggttacccggttcccttcccccgttcggtacccctaccccgttccccgtaccgtaacgccgtacccg

SEQ ID NO: 141817 - DNA, 663 bp, Homo sapiens
  misc_feature: GYAE6OF02F7X1H.46.67.G01.1.454.CMB.1.raw
  modified_base (260)..(260): a, c, t, g, unknown or other
  misc_feature (260)..(260): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagttggtttcttcgtggggctgggtccgacagcctcccgaggggaagggctagggaatacagttggaagtgtcctctnagtgtggaggttcctattacagtcccgtctctcaagagtcgagtcaccatatctctggacacgtcagcaatctacgttttcccagaagtatgtagttctggtcgacccgccgctagaccgtacgggtcttttattactggtcgcgagagacggtctattatgttagttttggagttggttatttcgacctaccgttagtacgtcgggaccggggcttccggaccccggtggggaccgaaggggtacttacggtcggttaccgtacccgttccgttacccgttacgtaccccttacccgaacccggtaaccgggccccgtaacgtttcccggttcccccgtttccccccgtacgggtcccccttacccccgtaccccgttacccgaacggtcccgtaaccccgg

SEQ ID NO: 141818 - DNA, 810 bp, Homo sapiens
  misc_feature: GYAE6OF02JMV7F.46.67.G01.1.454.CMB.1.raw
  modified_base (194)..(194): a, c, t, g, unknown or other
  misc_feature (194)..(194): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgccaaccggtggganacagtgtcacatcacgttcggccgggacaaggtccggaactagtttacggaacctaacctttaattttaaaagttggttaacttaccaaacctaattaacggaaccgaagggggaaccccggtacccccgttaaaggtcccttaccttaaaacttcccgttaaagtcgtccttacggacctaacgttacccttaggttttacgaacgtaaaacggggttccgggggtacccctaaggttccggtaacgggtttacacggggttacggtccgtaaggtacgggtacgttaccggttacggggacctaaggttacgttttaccgaaccttccctaccgtacctaatacgtaacgttactacgtacgaccgtaacgtaggtaacgttacgtttcggtaaaccttaacgtttacgttacgttacgttaaaccgtaactaagttaaacctttaactaacggttttacggttttaccgggaaacccgttaaacgggtaacctaaccggttaaacttaaacgttaaaacgttaaaccggaaacttcggtacgtacgtacgtacgtaccgtaacttcgttaacttccgttactaccttaccgtcccgtactacttcgtactacg

SEQ ID NO: 141819 - DNA, 625 bp, Homo sapiens
  misc_feature: GYAE6OF02GAA7H.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctggtccctcacctgcgctgtctctggtgcctccatcagtagtggtttcttcgtggggctgggtccggcagctcccgaggggagggctggaatacattggaagtgtctctcatagtggaggttcctattacagtccgtctctcaagagtcgagtcaccatatctcgtggacacgtccagcaattcacgttttcccagaacgtattgtagttctgtcgaccggtccgctcgaccgtacgggtacttttacgtactgtgtcgacgaggacggtcttaattacgttagttagtttttagggtagtttggtttattaccggttactacccgtagtacgtacggcggggtcctcccgtacccgtggggaccgagggtacttacggtcgtcctaccgtccttccgttacgtcctaccgaaccggaacggtaccctacgtcccgttccttccccgtcggtcccaccccgtcctaccgtacgcgtacccg

SEQ ID NO: 141820 - DNA, 622 bp, Homo sapiens
  misc_feature: GYAE6OF02G7GGU.46.67.G01.1.454.CMB.1.raw
  modified_base (210)..(210): a, c, t, g, unknown or other
  misc_feature (210)..(210): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggnagctcccgagggaaggggctggaatacagttggaagttgtctctcagtagtggaggttcctattacagtccgtctctcaagagtcgagtcaccatactctctggacacgtccagcaatctacgttttcccagaagtatgagttctgtcgaccgcgctgacacggggtctttatacgtgtagcgacgagacggtctattagtgttagttttggtagttaggttagtttcgacgtaccctagtacgtcggtacggggtcctccggtaccccggtcgggaccgaacgggtaacgtaccgtcggtaccgtaccgttccgtaccgttacgtaccctccgacccgtaaccgggtacccacgttaccggtcccttccccgtcggtaccctccccgtacccgtaccctacgacgtacccg

SEQ ID NO: 141821 - DNA, 596 bp, Homo sapiens
  misc_feature: GYAE6OF02IB5YW.46.67.G01.1.454.CMB.1.raw
tcagactagcagtacacgaccggtgctcgatttagagtatacatattgggtttggggagtctcggtcaggacacagaatggacatgagggtccccgctcagctcctggggctcctgctactctggctccgaggtgccagatgtgacatcgagctgacccagtctccatcctccctgtctgcaacgtgggagacagtgtcaccatcacttcgccgggcaagtcggaacattgacacctatttaaatggtatcaacatagacagggacggccctaagctactaatctatgctgctatccagtttgacgaaggtcggggtacccagtcggtaggttcagtggcaggtggatcgtgggacaagtatttcgactctacaccatcaagttaactctagacaacgtgtaagttatttacgactaactttacttaacgtcgtaacaacgtaagttaaattaacgtaagtttcggtttacggaccgtaaagggtacctaacgaacttaaacgtaaactttaaacgaacgttaggtacgtactacgaccaccgtacttcttcgtaccttactacttccgttcccgactacgtcttacgtattaccg

SEQ ID NO: 141822 - DNA, 634 bp, Homo sapiens
  misc_feature: GYAE6OF02HEXB1.46.67.G01.1.454.CMB.1.raw
tcagactagcagtacacgaccggtgctcgatttagagtatacatagtttgggggtttggggagtctcggtcaggacacagcgatggacatgagggtccccgcgtcagctcctggggctcctgctactctggctcgaggtgccgagatgtgacatcgagctgacccagtctccatcctccctgtctgcgaaccgtgggagacagtgtcaccatcacgttggccggcaaggtcggaatattgactacttatttaagtggtatcgaacatagacaggacgccctaagctacctaatctaatgctgcatccagtttagacgaaacggtcgggtacccagttacgaaggttcgagtcggctagtcggatcgtaggacagtacttccactcacaactatcgtaagtactctgacgtaacgtagaagtacgtttagtactaaactttattacgtacgtactaaacgtagtaaattaacgtaacttggttttaccggaaccgtaaggtacctaacgtaacgtaacgttaaaacgtaaacgtaaacgttacggtacggtacgttacgaccgtaaccgtacttacgttacggtaccgttacgtaccgttcccgttaccccgtacctaacgttctacgttaaccg

SEQ ID NO: 141823 - DNA, 581 bp, Homo sapiens
  misc_feature: GYAE6OF02F34AO.46.67.G01.1.454.CMB.1.raw
  modified_base (304)..(304): a, c, t, g, unknown or other
  misc_feature (304)..(304): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacggcccctaagctcctaatctatgctgcatccagtttncaaagtggggtcccagtcgaggttcagtggcagtgatctgggacagtatttcactctctacatcagtaatctgcacgtgaagtatttgactaacttattactagtacaactataaacttaactaattacgttttacggaccgtaacgggtaacgaacgtaaccttaacgtaaaactttaaaacgaaacgttagtacgtacgtacgaccgtaacctagttccgttacgttctttaccactttaccgtttccccgtaccctaacgttccttagtaaccg

SEQ ID NO: 141824 - DNA, 552 bp, Homo sapiens
  misc_feature: GYAE6OF02GK50N.46.67.G01.1.454.CMB.1.raw
  modified_base (420)..(420): a, c, t, g, unknown or other
  misc_feature (420)..(420): n is a, c, g, or t
  modified_base (547)..(547): a, c, t, g, unknown or other
  misc_feature (547)..(547): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtcggggtcccatcgaggttcagtggcagtggatcgtgggacagatttcactctcaccatcagtaactctgacaacgtgaagtatttagactaacttattactgtacaanagtaattactaattcgtttacggacctaagggacctacgaacttaactaaacgttaaacgtaactagttaggactagaccgtaaccacttccgtacgttctttcacttccttcccgcctacttcgtntaacc

SEQ ID NO: 141825 - DNA, 580 bp, Homo sapiens
  misc_feature: GYAE6OF02IXXF4.46.67.G01.1.454.CMB.1.raw
  modified_base (171)..(171): a, c, t, g, unknown or other
  misc_feature (171)..(171): n is a, c, g, or t
  modified_base (332)..(332): a, c, t, g, unknown or other
  misc_feature (332)..(332): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtncctccatcagtgtgtttcttcgtgggctgggtccggcagctcccgagggagggctggaatacagttggaagtcgtctctcatagtggagttcctattacagtccgtctctcaagagtcgagtcaccatatctctggacacgtccagcatctagttttcccngaagatgagttctgtcgaccgcgtctgacgtacgggtcttttaatacgtgtgcgagagacgcttatattgtattttggagttgttactttcgaccgtacctacgtatcgggacgggctccggacccgtacgggccgagggtactacgtcgtccgtaccgtcctccgttacgtccctacgacccgtacggaccctcgtcccgtccgtttcccccgcggtccctaccccgtcctaccgacgacgtacccg

SEQ ID NO: 141826 - DNA, 728 bp, Homo sapiens
  misc_feature: GYAE6OF02G70BP.46.67.G01.1.454.CMB.1.raw
  modified_base (229)..(229): a, c, t, g, unknown or other
  misc_feature (229)..(229): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgtacccagtctccatcctccctgtctgcaaccgtgggagacagtgtcaccatcgacttggccggcaagtcggaacntgacacctattaatgtatcaacatagacagggacgccctaagctctatctatgctgcatccgtagtttcgacgaaaggttcgggtacccaagtcggtaaggttcgaggtggactaggtggtactcgtagggacaaggtacttcacttctcccaacctactacgaacgttactaccgttacgaacgtaaacggttagtaaacggttacgttttacgtaacctttaaaccgttttaactttaacttacggttaacctaaaccgttaaaggttaaaactttaacgttaaacgtttacggttttacccgggtaaaccgtaaacggggttaaccgtaaaccgttaacgttaaaacgttaaaaccgtttaaaacggtaaaccgttagggttaacgggtccgttaaccggtacccgtaacccgtaacggtttaaccgttccgttaccgtttaccgtaaccttccccgtttaccccggtaccctacggtttaccgtacgttaacccg

SEQ ID NO: 141827 - DNA, 584 bp, Homo sapiens
  misc_feature: GYAE6OF02G8CK1.46.67.G01.1.454.CMB.1.raw
  modified_base (326)..(326): a, c, t, g, unknown or other
  misc_feature (326)..(326): n is a, c, g, or t
  modified_base (383)..(383): a, c, t, g, unknown or other
  misc_feature (383)..(383): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtgtttctcgtggggctgggtccgcagctccgagggaggggctggaatacagttggaagtgtctctcatagtggaggttcctattacagtccgtctctcaagngtcgagtcacctatatctctggacaccgtccagactaatctacgttttcccagtaanatagtagttcgtgtcgacccgccgtctacgacgacgggtctttactacgtgtcgcgtagagacgtctagttacgtagttagtttttaggagtttaggtttacgttcgtacaccctagacgtcggacgggtctccggacccggtcgggaccgagggtaactacggtcgtaccgtacccgttctacccgttacgccctacccg

SEQ ID NO: 141828 - DNA, 706 bp, Homo sapiens
  misc_feature: GYAE6OF02IFY75.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctcctgtctgcaacgtgggagacagtgtacacatcacttcggcccgggacaaaggtacggaaactattcggaacctaccttaattttaaagttggtatacaaacataacgaccgagggccgacccctaagcctacctaatctatgctgctatcctagtttgacgtaaaggtcgggtaccagtacggtaggttcgaggtggactaggtggagtcggtggaactagttactttccgaacttcgtacctaacctattacgtaagttaactcgtacgacgtaaacggtgtaagttatttacgaacttaacttttagttaacctacgttacaaaattaacgttaattaacgtaacgttttcggttttaaccggaaccggtaaacgggtacctaaacgtaaaccgttaaaactaaaaacgtttaaaaccgacgtttacgggtacgtaccgttaacgacccgtaactaacgttaccggttactttaccttaccgttaccttcccccggtttaacccgacccttaacgttccgtaagttaaccg

SEQ ID NO: 141829 - DNA, 616 bp, Homo sapiens
  misc_feature: GYAE6OF02JOJ3W.46.67.G01.1.454.CMB.1.raw
  modified_base (211)..(211): a, c, t, g, unknown or other
  misc_feature (211)..(211): n is a, c, g, or t
  modified_base (248)..(248): a, c, t, g, unknown or other
  misc_feature (248)..(248): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccagactggtgaggccttcggagaccctgtcccctcacctgcgctgtctctggtncatccatcagtagtggtttctcgtgggctgggtccgnagcctccgagggagggctggaatacagttggagtgtctctacgataggtggagttcctagttcacgtccgtctctacgaagtgtcgagtccacctatctcgtcgtaggacctacgtcagactaatctacgtttccagaagtatgtagttctagtcgtaccgcgtctagacgtacgggttactttatcgtgtcgtcggacggtagtacgtacgttacgttagtacgtttagttttaggaggtttagtttacttcgtaaccgtaccgtagtacggtcggtacgggtcgtacccggtaccggtcggggacgtaacggtaacgttacgttacggtaccgtaacccggttccttacccgttaccgtaccccgg

SEQ ID NO: 141830 - DNA, 644 bp, Homo sapiens
  misc_feature: GYAE6OF02I2AZW.46.67.G01.1.454.CMB.1.raw
  modified_base (193)..(193): a, c, t, g, unknown or other
  misc_feature (193)..(193): n is a, c, g, or t
  modified_base (304)..(304): a, c, t, g, unknown or other
  misc_feature (304)..(304): n is a, c, g, or t
  modified_base (354)..(354): a, c, t, g, unknown or other
  misc_feature (354)..(354): n is a, c, g, or t
  modified_base (357)..(357): a, c, t, g, unknown or other
  misc_feature (357)..(357): n is a, c, g, or t
  modified_base (365)..(365): a, c, t, g, unknown or other
  misc_feature (365)..(365): n is a, c, g, or t
  modified_base (388)..(388): a, c, t, g, unknown or other
  misc_feature (388)..(388): n is a, c, g, or t
  modified_base (393)..(393): a, c, t, g, unknown or other
  misc_feature (393)..(393): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgtcacctatccacttggccgggcaagtcggaacattcgacacctatttaaatggtatacaacatagaccgagggaccggacccctaagcttacctaatctatgctncatccagtttcgacaaggtcgggtccagtcgaggttcaggtggcagtggntgnggacagtnttccaatctacacatacagtaancgtanacgtaacgtgtaagttagtttcacttaacttactttaactgttaacctaatagtaaacttactagtttacggtttaccgaacgttaaggacctaacgtaaccttaaacgttaaaacgttaaaaccgtaacggttacgtaggttacccgttacgaaccgttaacgtaccgttttacgtccgtttaccgttttaccggtaaccctttccccgttaacccggttaccctttaacgtttccgttaagttaacccg

SEQ ID NO: 141831 - DNA, 537 bp, Homo sapiens
  misc_feature: GYAE6OF02FSXMO.46.67.G01.1.454.CMB.1.raw
  modified_base (192)..(192): a, c, t, g, unknown or other
  misc_feature (192)..(192): n is a, c, g, or t
  modified_base (392)..(392): a, c, t, g, unknown or other
  misc_feature (392)..(392): n is a, c, g, or t
  modified_base (417)..(417): a, c, t, g, unknown or other
  misc_feature (417)..(417): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcgaacattgactacctatttaatggtatcaacatagaccagggacggcccctaagctcctaatctatgctgcatcctagtttgactaaaggtcggggtccatcgtaggttcagtggcagtggatcgtgggacagtatttcactctcacatcagtactctgcaagtgaagtntttagactaactattactgtacaanagtaatacgtaattgtttacgacgtaaggacacgtactaactaaattaaacgaatgtaggactagctactacttctagttaccttacgacttacccgttcccgcctatccgttagtaacg

SEQ ID NO: 141832 - DNA, 660 bp, Homo sapiens
  misc_feature: GYAE6OF02I6OMD.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtgggagacagtgtcaccatcacttgccgggacaaggtcggaacattcgacctaccttaatttaaattggtactcaacagtagaccgagggaccgcccctaagcctacctaatctatgctgcactcctagtttcgacgtaaaggtcggggtacccagtcggtaggttcgaggtggctaggtggtatcgtagggacagttatttcacttcctacgacctatacgaagttatcgtagactaacggtagtaagttacttttacgacttaaactttatttaacttacgtaactaaacgtaagtaactttaactaacgttttacggtttaccggtaaccgtaagggtaacctaacgtaacttaaaaccgtaaaagtttaaaaccgtaacgttcgggttacgacgttacgaccctaactaacttcgttccttcgtttacctaccgtttacccgttcccctacttcgttacgttccgttaacg

SEQ ID NO: 141833 - DNA, 618 bp, Homo sapiens
  misc_feature: GYAE6OF02FPPUS.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgagggccttcgggagaccctgtccctcacctgcgctgtctctggtgcctccatcagtagtggtttcttctggggctgggtccgcagctcccgaggggaagggctggaatacattggaagtgtctctcatagtggaggttcctattacagtccgtctctcaagagtcgagtcaccatatctctggacacgtccagcaatctagttttcccagaagtatgagttctgtcgaccgccgctagaccgacgggtcgtttattactggtgcgagacggacggacttagttatgttagttttgggagttaggtttagtttaccgactacccgttagtacgtaccgggacgggggtctccggtaccccgtggggacccaggggtaactacgtaggtccgtaccgtcttaccgttacgccctccgaccgaacgggccctacgtcccggttcccttacccccgtcggaccctaccccttcccgtacctaacggcgtacccg

SEQ ID NO: 141834 - DNA, 719 bp, Homo sapiens
  misc_feature: GYAE6OF02IENGI.46.67.G01.1.454.CMB.1.raw
  modified_base (248)..(248): a, c, t, g, unknown or other
  misc_feature (248)..(248): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccagactggtgaggccttcggagaccctgtccctcacctgcgctgtctctggtgcctccatcagtagttggtttctcgtgggctgggtccgnagctccgagggaagggctaggaatacagttgggaagttgtcctctctagttaggtggtacggtttcctattacgacgttccgtctctacaagtgtcgagtccactatatcctctaggacctacggtccagactaatccgtacgttttcccaggtaacgtagtcgtagtttacgtggtacgtacccgccgtactcggaaccgtacggggttacttttattacgttgggttcgacggtagacggtaccgtacttaatttacggttaggtttacgttttttacggggagttttacgggtttaacgttttacccgaacccgtaacccgttaggtaaccggttcccggggtaccgggggtcccgttacccgggtaacccccgggttagggggaaccccgtaaaggggtaaccgttaccggttcgggtaccctaccccggttacctttacccggtttaccgacccccgttaacccgg

SEQ ID NO: 141835 - DNA, 621 bp, Homo sapiens
  misc_feature: GYAE6OF02HR7TV.46.67.G01.1.454.CMB.1.raw
  modified_base (259)..(259): a, c, t, g, unknown or other
  misc_feature (259)..(259): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttggccgggcaaggtcggaacattgacacctaatttaaattggtatacaanatagaccagggaccgcccctaagcctacctaatctatgctgcactcctagttttgacgtaaaggtcgggtcccagtcggtaggttcgagtcggctaggtggatcgtgggacaggtacttcacttctaccacctatactaagtactctacgacgtaacgtagaagttattttagacttaactttatacgttacgtaccaaacgttaagtaaacttaacttaagtttcggtttaaccggaacgtaaacgggtaacctaaccggtaactaaaccgtaaaactttaaaccggaagttagggcgtactacgtaccaacgtacttcgtcgttaccttactacttcctacccgtctaacttcgagtaac

SEQ ID NO: 141836 - DNA, 608 bp, Homo sapiens
  misc_feature: GYAE6OF02GXA4W.46.67.G01.1.454.CMB.1.raw
  modified_base (381)..(381): a, c, t, g, unknown or other
  misc_feature (381)..(381): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtccctcacctgcgctgtctctggtgcctccatcagtagtggtttcttcgtggggctgggtccggcagcctcccgaggggaaggggctggaatacagttggaagtgtctctcatagtggaggttcctattacagtccgtctctcaagagtcgagtcaccatatctctggacacgtccagcaatctacgttttcccagaagatgtagttctggtcgaccgccgctgacgacgggtntttattacgtgtgcgagagacggtcttattagtgttagttttggagttggttacttcgacctaccgtagacgtcgggacgggcctaccgtcccgtcggggaccgaggtaacgtacgtcgtccgtaccgtcttccgtacgcccgtccgaaccggacgggtccctacgtcccggttcccgttcccccgtcggtaccctccccgttaccctaccgaacgtccgtacccgg

SEQ ID NO: 141837 - DNA, 635 bp, Homo sapiens
  misc_feature: GYAE6OF02GYI30.46.67.G01.1.454.CMB.1.raw
  modified_base (309)..(309): a, c, t, g, unknown or other
  misc_feature (309)..(309): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccgcagctccgaggggaaggggctggaatacattggaagtgtctctcatagtggaggttcctattacagtccgtctctcaagagtcgagtccaccatatctcnggacacgtccagacaactctacgttttcccagaagtatggtagttcgtgtcggaccgccgtctcgaacgacgggtacttttacttacgtgtcgcggagacggacggtcttaacttagtcgttagttttcggagtttggtttacgtttccgacctacccgtagtacgtccgggacggggtcctaccggaccccggtggggacccgaagggtaactacgtgttccgaccgttccgtcctacgcccttaccgacccgtaacgggcccctacgtccggttcccttacccccgtggtacccctaccccgtccctaccgacgaccgtacccg

SEQ ID NO: 141838 - DNA, 556 bp, Homo sapiens
  misc_feature: GYAE6OF02I0YUM.46.67.G01.1.454.CMB.1.raw
  modified_base (258)..(258): a, c, t, g, unknown or other
  misc_feature (258)..(258): n is a, c, g, or t
  modified_base (419)..(419): a, c, t, g, unknown or other
  misc_feature (419)..(419): n is a, c, g, or t
  modified_base (518)..(518): a, c, t, g, unknown or other
  misc_feature (518)..(518): n is a, c, g, or t
  modified_base (524)..(524): a, c, t, g, unknown or other
  misc_feature (524)..(524): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttgccgggacaaggtcggaacattgacacctaatttaaatggtatcaanatagaccgagggaccgcccctaagcctacctaatctatgctgcatccgtagtttgacgtaaaggtcggggtcccagtcggtaggttcaggtggactaggtggacttcgtagggactagtacttcactctcacctatcagtaactctagacaagtgtaattntttacgactaacttattactatacaactagtaattaatagttgtttaccgacgtaaggactacgaataactaaattaaacgagtagtagctgactactntacgtnttacttactacttcctcccatacttcgtatac

SEQ ID NO: 141839 - DNA, 643 bp, Homo sapiens
  misc_feature: GYAE6OF02FP3HA.46.67.G01.1.454.CMB.1.raw
  modified_base (193)..(193): a, c, t, g, unknown or other
  misc_feature (193)..(193): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatcctccctgtctgcaaccgtggganacagtgtcaccatcacttgccgggtcaagtcggaacattgactacctatttaaatggtatcaacatagaccagggacgcccctaagctcctaatcatgactgcatccagtttgcaaaggtgggtcccagtcgaggttcaggtgcagtggtatcgtgggactagtactttcacgttctacgaccatcagtaatctaggacctaacggtagaaagttcttttacggacttaaaccgttatttacgttactactaaaccgtagtaacttgaccttaaagttcggttttacccggacgtaacggggtaaccaacgtaaccttaaaccgaaagtttaaaaccgtaaccttaggttacgtcctacggtccctaacccgtagttacccgttaggttaccctttaccgttaccgttttaccccgttaccccggtaccctacgtttaccgttaacccgg

SEQ ID NO: 141840 - DNA, 756 bp, Homo sapiens
  misc_feature: GYAE6OF02IVS33.46.67.G01.1.454.CMB.1.raw
  modified_base (171)..(171): a, c, t, g, unknown or other
  misc_feature (171)..(171): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttctcgtgggctgggtccgcagcctcccgagggagggctggaatacagttggaagtgtctctacagtagtggtagttcctattacacgttccgtctctacgaagtagtcgacgtaccaacctaagtactccgttcgtacggacctaccgtccgaagtacctaaacgttccgttaacgtttttcccctaggaaaagtagtaggttacgttctaggttccggacccgtccgtcgtacggaaccggtacggggtttcttttaactacgtggttacgacggtagacggtacgtaccttaagtttagttagtttacgttttagggtaggtttgtttaaccgtttaccgaaccttacccgtaaggtacgtaccggggtacccggggtcgtaccccggtaccgggtaccggggacgtaaacgggtaccgttaccggtacgggttaccctaccgttacccgttaccttaccggtaccctaacccggtaaccggtacccgggtaccctaccggttccccgttccccgtttcccgaccgtccccctaaccctccctaacccggacgtacccgtacccg

SEQ ID NO: 141841 - DNA, 633 bp, Homo sapiens
  misc_feature: GYAE6OF02FVTA6.46.67.G01.1.454.CMB.1.raw
tcagactagcagtacacgaccggtgctcgatttagagtatacatattgggtttggggagtctcggtcaggacgcagcatggacatgagggtccccgctcagctcctggggctcctgctactctggctccgaggtgccagatgtgacatcgagctgaccccagtctccatcctccctgtctgcaaccgtgggagacagtgtcaccatcacttgccgggcaagtcggaacattgacacctatttaaattggtatcaacatagaccagggacgcccctaagctcctaatctatgctgcatccagtttcgcaaaggtgggtccatcgaggttcagtggcagtggatcgtgggacagtattcactctcacatcagtaatctagcaacgtgaagtattttcgactaacttattactgtactaactaagtaattaactaatttcgtttaccggaccgtaaggggtaacctaacggtaaccttaaaccgtaaaaacgtttaaaaccgtaaacgttacgggttacggtaccgttacggaccgttaaaccctaacgtttaccgttacgtttacccgttttaccgtaaccgtttacccgttttaccccccggtaccctaacgtttaccgttacggttaaacccg

SEQ ID NO: 141842 - DNA, 603 bp, Homo sapiens
  misc_feature: GYAE6OF02HC0G5.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatacaacatagaccagggacgcccctaagcctctaatctatgctgcatccagtttgctaaagtcgggtcccagtcggagttcagtggcagtggatcgtagggacagtactttcacttctacaccatcagtaactctgacaacgtagaagtatttgactaactttattacttagtacaactaagtaattaactaagttcgttttaccgggacctaagggacctaacgtaacttaaacgtaaaacgtttaaaaccgaacgttagtacgggtacttacggacctaaccgtacttaccgttcgttaccctttacctacgtttcccctttaccccgacccgttaacttccttacggtaac

SEQ ID NO: 141843 - DNA, 676 bp, Homo sapiens
  misc_feature: GYAE6OF02H3N4X.46.67.G01.1.454.CMB.1.raw
  modified_base (250)..(250): a, c, t, g, unknown or other
  misc_feature (250)..(250): n is a, c, g, or t
  modified_base (334)..(334): a, c, t, g, unknown or other
  misc_feature (334)..(334): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactgggtgaggcctttcggagacccctgtccctcacctgcgctgtctctggtgcctccatcagtagtggtttctctggggctgggtccggcagctcccagggagggctggaatacattggaagtgtctntcatagtggagttcctattacagtccgtctctcaagagtcgagtccactatatctctggacacgtccagcaatctagtttcccngaagatgagtttctgtcgaccgcgtcgtagaccgtacgggtacgttttactacgtgttacggaccgtagaaggtaccgggtccttaagtttaagttacggtaatttttcgggaaggtttaggtttaagtttaccggtaacctacccgtaagtacgtacggtacgggggtccttccggaccccgtacgggggtaccaacggggaataccgttacgggtccgtaaccgtccgttacccgttacgtacccttcccgaacccgtaacgggacccctacggtcccggttaccctttcccccggtacggccctaccccgttccccgtacctaaccggtagtacccccg

SEQ ID NO: 141844 - DNA, 529 bp, Homo sapiens
  misc_feature: GYAE6OF02IYDI7.46.67.G01.1.454.CMB.1.raw
  modified_base (217)..(217): a, c, t, g, unknown or other
  misc_feature (217)..(217): n is a, c, g, or t
  modified_base (228)..(228): a, c, t, g, unknown or other
  misc_feature (228)..(228): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacntgacacctattaatggtatcaacatagaccagggacggcccctaagctcctaatctatgctgcatccagtttgacaaagtcgggtcccagtcgaggttcagtggcagtgatcgtgggacagattcactctcacatcagtatctgacaacgtgaagtattttgactaacttattactgtacaacagtaattacaattggtttcgaccgtaaggacaacgaactaactaaaattaaacgaacgtgtagctagaccgtaactacttctgtcctttactacttccttcccgctacttcgtagtac

SEQ ID NO: 141845 - DNA, 675 bp, Homo sapiens
  misc_feature: GYAE6OF02GMLHC.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgagggaagggctggaatacagttggaagttgtctctcatagtggaggttcctattacagtccgtctctcaagagtcgagtcacatactctcgtggacacgtcagacaatcgtagtttcccagtaacgatgtagttctgtcgacccgccgctagaccgaggggttcttttaattactggtcgacggtagaggacggtacttagttacgtgttagttttgggtagtttggttttagtttaccgtaaccgtacccgttaaggtacgttaccgggtcggggtacctacccggtaccccggtcggggaccgtaagggtaacttacgtcggttaccgaccgttacgttacccgttaccgtcccgtacccgaacccggtaccgggaccctaccggttcccggttaccccttcccccggttcggacccctaccccgttccccgtaccgtaaccggtcgtaccccgg

SEQ ID NO: 141846 - DNA, 642 bp, Homo sapiens
  misc_feature: GYAE6OF02JLP0L.46.67.G01.1.454.CMB.1.raw
  modified_base (192)..(192): a, c, t, g, unknown or other
  misc_feature (192)..(192): n is a, c, g, or t
  modified_base (306)..(306): a, c, t, g, unknown or other
  misc_feature (306)..(306): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtccaccatccacttggcccgggacaacggtcgggaaactattcgacctaaccgttaattttaaagttggtaatcaacatacgacagggacgcccctaagcctcctaanctatgctgcatccagtttgcaaggtcgggtccatcgtagttcagtggcagtgatctagggacagtacttcgaacttctacaccatcaagtatctcgacaaccgttagaagttatttacgactaaacgtttacttaacttcgtaacctaaacgtacgtaaactttaaccgaagtttacgttttccggaacccgtaaaggtaaccaaccgtaacttaaaccgtaaaacttaaacgtaaccgttggttaccgtacttacggacctaacggtaacttccgttacgttaccctttactacgtttaccccttaccccgtaactacggttacctaggttaacc

SEQ ID NO: 141847 - DNA, 699 bp, Homo sapiens
  misc_feature: GYAE6OF02JV6U5.46.67.G01.1.454.CMB.1.raw
  modified_base (231)..(231): a, c, t, g, unknown or other
  misc_feature (231)..(231): n is a, c, g, or t
  modified_base (252)..(252): a, c, t, g, unknown or other
  misc_feature (252)..(252): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccggtgggagacagtgtccaccatcacttgccgggcaagtcggaacntgactacctatttaatggtancaacagtacgaccgagggaccgacccctaagctacctaatctatacgctgactactaccgtagtttagaacgtaaaggtcggggtacccctaagtaccggtaggttacaggtacggaccgtaggtaggacttcgttacggggaaccaagtacttttaccgacttaccgactaaccgtactacgtaagtaacttccgtagtacaaacggtagaaacgttcgtttacgaacttaaccgtttaattaacgttccgtaacgtaacgtaaggttaaactttaaacgtaacggttttacgtttaaccggaaccgtaaacgggtacctaaccgaactttaaaccgaaaagtttaaaccgtaacgttaggtacgtaccgtacgtacccgtaacttacttcgttacgttacgttaccactttacccgttacccgaccgtttactacgtacgtaacg

SEQ ID NO: 141848 - DNA, 598 bp, Homo sapiens
  misc_feature: GYAE6OF02IUPZG.46.67.G01.1.454.CMB.1.raw
  modified_base (253)..(253): a, c, t, g, unknown or other
  misc_feature (253)..(253): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatgtatcaanatagaccagggacgcccctaagctacctaatctatgctgctatcctagtttgacgtaaaggtcggggtaccccagtcggtaggttcaggtggacgtaggtggtatcgtgggactagtatttcactctcaccatcagtaatctagacaacgtgaagttatttgactaactttatacttgtacaacagtaacttactaagttcgtttaccggaccgtaacgggtacctaaccgtaacttaaactaaaagttaaacgaacgttacgttaggactaggaccaacctacttacgttcgttacctttacctacctttacccgttacccgtacctactttaccgtagtaacg

SEQ ID NO: 141849 - DNA, 576 bp, Homo sapiens
  misc_feature: GYAE6OF02F2NSP.46.67.G01.1.454.CMB.1.raw
  modified_base (346)..(346): a, c, t, g, unknown or other
  misc_feature (346)..(346): n is a, c, g, or t
  modified_base (351)..(351): a, c, t, g, unknown or other
  misc_feature (351)..(351): n is a, c, g, or t
  modified_base (374)..(374): a, c, t, g, unknown or other
  misc_feature (374)..(374): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtgtttctctggggctgggtccgcagcctccgagggaagggctggaatacattggaagtgtctctcataggtggaggttcctattacagttccgtctctcaagtagtcgagtcaccatatctntgacncgtccagcaatctagttttcccngaagtatgacgttctgtcgaccgccgtcgtgacgtacgggtcgtttacttacgtgttgcgaggacgacgcttattatagttagttttggtagttggtttagtttccgactacccttagtactcgggacggggtctcggtaacgtcccggtaggggtaccgaggtaacgtacgtcggtcctaccggtccttccgtacgtcccg

SEQ ID NO: 141850 - DNA, 578 bp, Homo sapiens
  misc_feature: GYAE6OF02ILZGP.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccggcaagtcggaacattgacactattaatggtatcaacatagaccaggacgcccctaagctcctaatctatgctgcatcctaggtttcgactaaaggtcggggtaccccagtcggaggttcaggtggcgaggtggtatcgtagggacagtattcactctcacatcagtatctcgacaacgtagaagttatttcgacttaacttattaccgtgtacaacgtagtaaacttactaatttcggtttaccggaccgtaagggaccaacgtaacttaaactaaaattaaacgtaacttggtacggactaggacctacctaattcttacgttcttacctacttcccttacccgacctacttccgtagtaacc

SEQ ID NO: 141851 - DNA, 640 bp, Homo sapiens
  misc_feature: GYAE6OF02HYDKA.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagcctcccgagggaagggctggaatacattggaagtgtctctcatagtggaggttcctattacagtccgtctctacaagagtcgagtcaccatatctctggacacgtccagcaatctagttttccctgaacatgagttctgtacgaccgccgctacgacgacgggtcgtttattacgtggtgacgtagagtacggacttattagttgttagtttttcgggtagttgggtttatttcgaccgtacccgtaggtacgtcgggacggggtcctaccggtaccccgtggggacccgtaagggtaacgtaccgttgggtccgaccggtccttaccgttacgtccctacccgaaccggtaacgggtcccctaggtcccggttacccttcccccgtcggaccctacccccgtacccgtacccgtacgcctacccgg

SEQ ID NO: 141852 - DNA, 630 bp, Homo sapiens
  misc_feature: GYAE6OF02H9480.46.67.G01.1.454.CMB.1.raw
  modified_base (246)..(246): a, c, t, g, unknown or other
  misc_feature (246)..(246): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctcatcagtgtggtttctctggggctgggtccgnagcctccgagggagggctggaatacattggaagtgtctctcatagtggtaggttcctattacagtccgtctctcaagagtcgagtcacctatatctcgtggtacacgtccagcaattctacgttttcccagaagtatgtagtttcgtcgtacgaccgtccgtcgtcgaaccgtacggggttaccttttaattaccgttggttggcggtagaacggacgggtactttaattaagtcggtttaattttagggtagtttagggttttacttccgtacctaaccttaagtacgtacgggacggggtcctaccggaccccggtggggaccgtaagggtaacgttacgtcggtaccgtaccgttccctaccgtttaccgccgttaacccg

SEQ ID NO: 141853 - DNA, 596 bp, Homo sapiens
  misc_feature: GYAE6OF02H7GQ3.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtcccctcacctgcgctgtctctggtgcctccatcagtagtggtttcttctggggctgggtccgcagctcccgagggagggctggaatacattggaagtgtctctcatagtggagttcctattacagtccgtctctcaagatcgagtcaccatatctctggacacgtccagcaatctagtttcccagaagtatgtagttctgtgacccgccgtctagaccgacgggtcttttacttacgtggtgtcgagacggacggtcttattatgttagttttggtagttggtttattcgactaccctagtactcggacggggtcctcgacccgtggggccgaagggatacgtcgtcctacgtcctaccgttacgccctacccgtaaccgaacgggtaccctacgtccggttacccttccccgtcggccctaccccgtccctaccaaccgtcgtacccg

SEQ ID NO: 141854 - DNA, 535 bp, Homo sapiens
  misc_feature: GYAE6OF02HIE9J.46.67.G01.1.454.CMB.1.raw
  modified_base (233)..(233): a, c, t, g, unknown or other
  misc_feature (233)..(233): n is a, c, g, or t
  modified_base (406)..(406): a, c, t, g, unknown or other
  misc_feature (406)..(406): n is a, c, g, or t
tcagactagcagtacacgaccggtgctcgatttagagtatacatattggggtttcgggagtctcggttcaggacacagacatggacatgagggtccccgctcagctcctggggctcctggctacgtctggctccgaggtgcctagatgtgacatcggagctagacccaggtctccatcctccctgtctggtcgaaccggtgggagacagtagtcaccatcgacttgcccgggnaagtcggaaccagttgactacctatttaaactcggtatcaacatagacagggacggccccgtaagcgtcctaatctatgactgcatccagtttgcaaagtgggtccatcgagttcagtggcagtgatcgtgggacagatttcatctcacatcagtaatctagcaacgtgaagnttttgactaacttattactgttacaacagtaattacaatgtttacgaccaagggacacgaactacaaactaaacgactagtagactgccaacatcgtcgtacttcatccgttcccacgtatcctagtac

SEQ ID NO: 141855 - DNA, 645 bp, Homo sapiens
  misc_feature: GYAE6OF02GQBT7.46.67.G01.1.454.CMB.1.raw
  modified_base (216)..(216): a, c, t, g, unknown or other
  misc_feature (216)..(216): n is a, c, g, or t
  modified_base (352)..(352): a, c, t, g, unknown or other
  misc_feature (352)..(352): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccggnaagtcggaacattgacacctatttaaattggtatcaacatagaccgagggaccgcccctaagcctacctaatctatgctgcatccagtttgactaaaggtcgggtcccagtcgtaggttcagtggcagtggatcgnggacagtatttcactctacacctatacaagttaactcgtagacgtaacgtgtaaagttagttttagacttaaactttattacttagtacctaaatacgtaaatttaactaagtttcggtttaccggaaccgtaacggggtaacctaaccggtaacctaaacgttaaaacttaaaaccggtaacttacgggtacggtaccgtacggtaccgtaacccgtaactttaccgtaccgtttacctttaccgtaacttttcccgttaccccgtaccttacgttaccgttacgttaaccg

SEQ ID NO: 141856 - DNA, 652 bp, Homo sapiens
  misc_feature: GYAE6OF02JMKM9.46.67.G01.1.454.CMB.1.raw
  modified_base (245)..(245): a, c, t, g, unknown or other
  misc_feature (245)..(245): n is a, c, g, or t
  modified_base (250)..(250): a, c, t, g, unknown or other
  misc_feature (250)..(250): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggagacagtgtcaccatcacttgccgggacagtcggacattgacactattaatgtatnacatnacaggacgcctagctacctatctatgctgcatccagtttacgactaaaggtcggggtccctagtcggtaacggttcaggtcggcaaggtggatcgttggggacgaagtattttaccgatccttaccaaccgtatacctaaggtaactcgtcgaacgtaaccggtagtaacgttaagttttcgtaacctaaacgtttaacttacttagttacctaaactacggaaatttaacgaacttaggttttacggaaccgtaacggaccgtaacgtaaccgttaaataaacgttaaaacgtacgttagtaccgtacgttacgtacctaaccgttaattaccgttagttacccgttaacttaccgtttccgttacccccgttacctaacgtttaccccgtagttaaaccc

SEQ ID NO: 141857 - DNA, 769 bp, Homo sapiens
  misc_feature: GYAE6OF02ICAQF.46.67.G01.1.454.CMB.1.raw
  modified_base (258)..(258): a, c, t, g, unknown or other
  misc_feature (258)..(258): n is a, c, g, or t
tcagactagcagtacacgaccggtgctcgatttagagtatacatattgggttttgggggagtctcggtcaggacacagcgatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgactacctatttaattgtatacaanatagacagggacgcccctaagctcctaatcctatgctgcaatcctagtttcgacgtaaaggttcggggtacccaagtccggtacgggtttaccgaaggttcggggaccctagggttcgggtaacgttaccgttgggggaactaaggtaacgtttttccgaactttccgtacctaaccctatttaccaaggtttaaacttccgttacgacctaaacggttagaaaggtttaacttttacgtaaccgtaaactttttaacgtttaacctttagggtttaaacctaaacgttaaagggttaaacttttaaaccgttaaagttttacggtttttttaacccggggaaacccgttaaacgggaaaccgtaaaccggtaacctttaaaacgttaaaaacgtttaaaaaccgtaaaccgttaggtacggtacttaaccggacctaaccgtacttacgttaccgtttacttacgttaacctttaccgttacccgtaccctacgttaccgttagttaacc

SEQ ID NO: 141858 - DNA, 681 bp, Homo sapiens
  misc_feature: GYAE6OF02F7QDR.46.67.G01.1.454.CMB.1.raw
  modified_base (193)..(193): a, c, t, g, unknown or other
  misc_feature (193)..(193): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtctccatcctccctgtctgcaaccgtggganacagtgtcaccatcacttgccgggcaagtcggaactattgacacctaatttaaattggtatcaacatagacagggacgcccctaagctacctaatctatgctgcatcctagtttgacgaaaacggtcggggtacccaagttcggaaggtttccaaggttggcaggtggatcgtaggggactaggtatttcacttcgtaccacctatacagttaactcgtagactaaacggtgtaaagttagttttacgaacctaaacgtttattaacgttagaactaaacaaagttaaactttaactaaagtttcggtttaccggaaccgtaaacgggtaactaacggtaaactaaacgttaaaaacgttaaaccggtaaacttcgggtaacggtaccttacggaaccgtaaaccgttaacttaccggttacgtttaacctttaccgttaccgtttaccccgttaccccggttaccctactttaccgtaacggttaac

SEQ ID NO: 141859 - DNA, 553 bp, Homo sapiens
  misc_feature: GYAE6OF02G9SKA.46.67.G01.1.454.CMB.1.raw
  modified_base (192)..(192): a, c, t, g, unknown or other
  misc_feature (192)..(192): n is a, c, g, or t
  modified_base (227)..(227): a, c, t, g, unknown or other
  misc_feature (227)..(227): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcgaacnttgactacctattaatgtatcaacatagacaggacgccctaagctctaatctatgctgcatccagtttgactaaaggtcgggtccagtcggagttcagtggcagtggatcgtaggacagtattcactctacacctatctagtaactctgactaacgtagtaagtatttacgactaacttattactgtacaacataattactattgtttaccgacgtaaggactaacgacttaaactaaacgttaaacgaacttgagtactagaccctactacgttctacgttaccttacacgtttccttaccccggtactacgttccgttataacg

SEQ ID NO: 141860 - DNA, 574 bp, Homo sapiens
  misc_feature: GYAE6OF02IFDIP.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccgcagctccagggagggctggatacattggaagtgtctctcatagtggaggttcctattacagtccgtctctcaagagtcgagtcaccatatctctggacacgtcagcaatctagttttcccagaagatgtagttctgtcgaccgcgctgacgtacggtcgttttattactgtgcgagagacgctattatgttatttggagttggtttattcgactacccgtagtactcggacggggctcgaccccgtggggccagggtaactacgttcggtcctaccgtcttaccgtacgccctaccgaaccgaacgggccctagtcccggttccttcccccgtcggccctacccctccctaccgacgcgtacccg

SEQ ID NO: 141861 - DNA, 794 bp, Homo sapiens
  misc_feature: GYAE6OF02H7LBC.46.67.G01.1.454.CMB.1.raw
  modified_base (206)..(206): a, c, t, g, unknown or other
  misc_feature (206)..(206): n is a, c, g, or t
tcagactagcagtacacgaccggtgctcgatttagagtatacatattgggtttgtcctcctgctggtggcagctcccagatgggtcctgtccccggtgcaactgcaggagtcgggcccagactggtgaggcttcggagaccctgtccctcacctgcgctgtctctggtgcctccatcagtagtggtttctctggggctgggtccgnagccgtaccgaggggagggctaggaactacgtaggttaggaagttcgtctctacagttaggtggtacggttccttaagttaacgcggttcccgttatacctacgaaggtagtcgtaacgtaccaacctattacttcgttaccgtagggacctacggtaccacgactaaacttccgtttaaccgtttttcccgaaggaaacgtagttagggtaactttcggtagtaccggtacccgtcgacgttacggacggtacggggtttactttaagtcgttgtcggacggaagacggtacggtactttaagttagttagtttaggttttagggtagtttaggtttacgttaccggtaaccttaaccgttagtaacgttccggggtacggggtccctacccggtacccgggttcggggaaccggtaacgggaactttcgggtacggttacccgtaccgttcccgtttaaccgttaccgtcccttacccgaaccggtaacccggcccgttaaccggttccccggttaccccttccccggtacggtaccccttaccccgttaccctaaccgtaacggtacccgtacccgtaacccggg

SEQ ID NO: 141862 - DNA, 687 bp, Homo sapiens
  misc_feature: GYAE6OF02HWUK1.46.67.G01.1.454.CMB.1.raw
  modified_base (193)..(193): a, c, t, g, unknown or other
  misc_feature (193)..(193): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctcctgtctgcaaccggtggganacagtgtacaccatcacttggccgggcaaggtcggaacattgaacctaccttaagtttaaattggtatacgaacataagaccgagggaccggacccctaagcctacctaatctatgctgcatccgtagtttgactaaaggttcggtaccagtcgtacggttacaggtcggacgtagtacggacgtgtaggactagtacttactactctacgacctatacgtaacgttaatcgtacgaactaaacggttaggtaaatttacgttttaacgacttaaaccttttattaaccgttagttaaccaaacgttaacgttaaacttaaccgtaagttttacgggtttaccggaaccggtaaacgggtaactaaccggtaaacttaaacgttaaaacgttaaacgtaacgttacgtacgtactacggtactaaccttaacttcgtacgtttacctacgtttacgttacccttaccccgtacctagtttacccgtattaaccg

SEQ ID NO: 141863 - DNA, 636 bp, Homo sapiens
  misc_feature: GYAE6OF02HVMFR.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgagggaagggctaggaatacgattggaagtgtctctcatagtggaggttcctattacagtccgtctctctaagagtcgagtccaacctatatctctggacacgtccagacaatctattttccctagaagatgagttctgtgaccgcgctgacgacggtcgtttaattactgtgcgagagacggctattatgtagttttggagttgttattcgtaactacccgtagtacgtcggacggggtaccgtaccggaccccggtcggggaccgaagggaacgtacgttcggtaccgtaccgttaccttcccgttacgtacccgtacccgtaaccggaaacgggtacccgtacggttcccggttcccgtttcccccgtcgggtaccctacccccgttacccttacccgaaccgtacggtaaccccg

SEQ ID NO: 141864 - DNA, 663 bp, Homo sapiens
  misc_feature: GYAE6OF02F834S.46.67.G01.1.454.CMB.1.raw
  modified_base (193)..(193): a, c, t, g, unknown or other
  misc_feature (193)..(193): n is a, c, g, or t
  modified_base (232)..(232): a, c, t, g, unknown or other
  misc_feature (232)..(232): n is a, c, g, or t
tcagactagcagtacacgaccggtgctcgatttagagtatacatattgggtttggggtagtctcggtcgaggacacagcatggacatgaggtcccgctcagctcctgggctcctgctactctgctccgagtgccagatgtgacatcgagctgacccagtcctccatcctccctagtctgaccaaccgtggganacagtgtcaccatccacttgcccgggcaagtccggaacnttgaaccaccgttatttaaacttggtatacaactatagaccaggacgcccctaagctccgtaactctatacgctagtcactaccgtagtttacgctaaacggtagggtccacgtccgaagtttcaagtcgacgagtacgactcgtaggacgagtagttccaacgttcgttacaccgtaatctaagtaactactgtaccgtacgtagtaaggtactttacgacttaacgttagttacttacgttaacgtacctaaagtacttaacgtaattcgttttaacggaccgttaaacgaacggttaccaacgttaactaaattaaaaccgttaacgtaacgttagtacgtacgaccgttaaccgtaacttacgttaccgttaactttccgtaacgttcccgtttaaccccgactttaacctcgttaacgtaacccgg

SEQ ID NO: 141865 - DNA, 736 bp, Homo sapiens
  misc_feature: GYAE6OF02HCBP1.46.67.G01.1.454.CMB.1.raw
  modified_base (208)..(208): a, c, t, g, unknown or other
  misc_feature (208)..(208): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctgggctgggtccgnagctccgagggagggctaggaatacagttggaagttgtctctcatagtggaggttcctattacagttccgtctctacaagagtcgagtccaccatatctcgtggacacgtccagcaatctacgttttcccagaagtagtgtagttctggttcgaccgtccgctaggaaccgtacgggttcgttttattacgttgtcgtacgtaggacggacggtcttaagtttacgttagttacgtttttagggaggttttacggtttacgtttccgtaaccgtacccgttaggtaccgttaccggggaccgggggtccttacccgggacccccggttaggggggacccgtaacggggtaacgttacccggttacgggtacccttaacccggtccctttacccggttaaccgccccgtttaacccgaacccggtaacccggggtacccctacgggttccccggttaccccctttccccccggtacggtccccctaccccccgtttacccgttaacccggtacgtaacccgtaccccgg

SEQ ID NO: 141866 - DNA, 560 bp, Homo sapiens
  misc_feature: GYAE6OF02HQT5O.46.67.G01.1.454.CMB.1.raw
  modified_base (335)..(335): a, c, t, g, unknown or other
  misc_feature (335)..(335): n is a, c, g, or t
  modified_base (449)..(449): a, c, t, g, unknown or other
  misc_feature (449)..(449): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagttagttggtttcttcgtggggcttgggtcccggcagcctcccgagggaaggggctggaatacattggaagtgtctctcatagtggaggttcctattacagtccgtctctcaagngtcgagtcaccatatctctggacacgtccagacaatctacgttttcccagaacgatgagttctgtgacccgcgctcgacacgggtctttatacgtgtgcgagagacgtctattntgttattttggagttgttatttcgactacagtactcgggacggggtctaccggcccggtgggccgaggtaactacgtcggtaccaccgttcccgtcgtacgtccctaaccg

SEQ ID NO: 141867 - DNA, 566 bp, Homo sapiens
  misc_feature: GYAE6OF02IWXAJ.46.67.G01.1.454.CMB.1.raw
  modified_base (216)..(216): a, c, t, g, unknown or other
  misc_feature (216)..(216): n is a, c, g, or t
  modified_base (248)..(248): a, c, t, g, unknown or other
  misc_feature (248)..(248): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccggnaagtcggaacattgacacctatttaaatggtntaacacatagaccagggacggcccctaagctcctaatctatgctgctatcctagtttgacgtaaaggtcggggtaccccagtcggtaggtttcagtggacaggtggactcgtgggacagtactttcactctacaccatcagtaatctagactaacgtgtaagtattttgacttaacttattactgtacaatagtaattactattgtttacgacgtaacggactacgaactaacgtaaattaacgactgtacgtctacgactacctattccgtagttaccttactacttcccgttacccacgtacttacgtagtaaccg

SEQ ID NO: 141868 - DNA, 736 bp, Homo sapiens
  misc_feature: GYAE6OF02IKS50.46.67.G01.1.454.CMB.1.raw
tcagactagcagtacacgaccggtgctcgatttagagtatacatattggggtttggggagtctcggtcaggacacagcatggacatgagggtccccgctcagctcctgggggctcctgctactctggctccgaggtgccagatgtgacatcgagctgacccagtctccatcctccctgtctgcaaccggtgggacgacagtgccaccatcacttcgccgggacaaggtcggaacattgacctacttaatttaattggtatacaacatacgaccgagggaccgcccctaagcctactaatctagtgctgcatcctagtttgacgtaaacggttcgggtaccctagtacggtaggttcgaggtggacgtaggtggagttcggtgggaactaggtactttccaacgttctaccactataccgtaagttacttcgtacgtaaccgtaaggttagtaaggtttaatttcgaaacttaaacgttttaactttaacgttacgttaacctaaaacgttaagttaaactttaaacgttaagttttcggtttaacccgggaacgttaaaccggggtacctaaaccggtaaaccttaaaacgttaaaaaccgtttaaccggtaaacgtttagggtacgtaccgttacggtaaccctaaccggttaacgttccgttaacgtttacccgtttaaccgtaccgtttaccccgttcccgtacccgtttacgtttcccgtaggttaaccccg

SEQ ID NO: 141869 - DNA, 648 bp, Homo sapiens
  misc_feature: GYAE6OF02GK3B2.46.67.G01.1.454.CMB.1.raw
  modified_base (300)..(300): a, c, t, g, unknown or other
  misc_feature (300)..(300): n is a, c, g, or t
  modified_base (354)..(354): a, c, t, g, unknown or other
  misc_feature (354)..(354): n is a, c, g, or t
  modified_base (364)..(364): a, c, t, g, unknown or other
  misc_feature (364)..(364): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagaccctgtccctcacctgcgctgtctctggtcgcctccatcgagtagttggtttcttcgtggggctgggtccggcagcctccgaggggacgggctaggaatacagttggaagtgtcctctcagtagtggtaggttcctattacagtccgtctctacaagngtcgagtcaccatactctcgtggacacgtacagcaatcgtacgtttccagaagntagtacgttntgtcgaccgccgactacgacgtacgggttctttaccgttctggtcgcgagagtacggattattattagttagttttagggagttggtttacttacgactacccgttagtacgtcgggaccggggtcctccgtacccggtggggacccgtaacggggtacttaccggtcggtccgtacccgttcgtcccgtttacgccctaccctaacccgggaacggtccctacggttcccggtaccccgttccccggtacggccctacccggtccctacgacgtacctcccgg

SEQ ID NO: 141870 - DNA, 723 bp, Homo sapiens
  misc_feature: GYAE6OF02IQN5M.46.67.G01.1.454.CMB.1.raw
  modified_base (246)..(246): a, c, t, g, unknown or other
  misc_feature (246)..(246): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgagggccttcggagaccctgtccctcacctgcgctgtctctggtgcctccatcagtagtggttcttcgtgggctgggtccgcagctcccgagggagggctggaatcattggagtgtctncatagtggaggttcctattacagtccgtctctcaagtacgtcgagtcaccatatctctgacacgtcagactaatctacgttttcccagaacgtatgtacgttctcgttagaccggccgtctacggacgtacgggtcttttaacgttctaggtcggacgtaggacggtaacgggcttaacgttagttacgttagtttttacgggtaggtttacggtttacgttttcggaaccttacccgttaaaggtaccggttaccggggtaaccgggggttcccttaccgggtaacccccgggttcgggggaacccgtaggggtaaaccttccggttaccgggtaccgtaccgttccgttacccgttaacgtaccccgttaccgaacccggtaaaccgggtccccgtacggttaccccggttcccgtttaccccccggtcgtacccgtcccccttacccgttaccccgaggtacccgttaccccgg

SEQ ID NO: 141871 - DNA, 560 bp, Homo sapiens
  misc_feature: GYAE6OF02HEVLK.46.67.G01.1.454.CMB.1.raw
  modified_base (331)..(331): a, c, t, g, unknown or other
  misc_feature (331)..(331): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctgggctgggtccggcagctccagggaagggctggaatacattggaagtgtctctcatagtggaggttcctattacagtccgtctctcaagagtcgagtcaccatatctctggacacgtcagcaatctagttttcccngaagatgtagttctgtcgaccgcgctgacacgggtacttttattactgtgcgagagacggctatatgtattttggagttgttattcgactacctagagtcgacggggtctccgacccgtgggccgaagggtatacgtcgtccaccgtctccttagccctaccgaccgaacggcccagtccggttcccttccccgtacggtccctaccccttcccgtaccagactacccg

SEQ ID NO: 141872 - DNA, 620 bp, Homo sapiens
  misc_feature: GYAE6OF02GCWTD.46.67.G01.1.454.CMB.1.raw
  modified_base (196)..(196): a, c, t, g, unknown or other
  misc_feature (196)..(196): n is a, c, g, or t
  modified_base (221)..(221): a, c, t, g, unknown or other
  misc_feature (221)..(221): n is a, c, g, or t
  modified_base (233)..(233): a, c, t, g, unknown or other
  misc_feature (233)..(233): n is a, c, g, or t
tcagactagcagtacacgaccggtgctcgatttagagtatacatattgggtttgggggagtctcggtcaggacacagcatggacatgagggtccccgctcagctcctgggggctcctgctactctggctccgaggtgccagatgtgacatcgagctgacccagtctccatcctccctgtctagcaaccggtggganacagtgtcaccatcacttgccgggnaaggtcggaacnttgactaccttaatttaatggtatcaacatagacagggacggcccctaagctcctaatctatgactgcatcccagtttcgagtaaaacggtcggggttacccagttccggtagggtttcgaggttgggcctagggtggtaatcggtagggacaagtatttcacttctcgaacctatacaagtaactctagccgtaaagtagtaagtattttggaccttaacttattactagtacaactataaacttactaattaggtttaccggaccgtaacgggacaaccgtaactaaactaaagttaaaccgaacttagtacggactacgacctaaccgtataccgttcgttacttcctaacgttcccttacccgaccttactacgttgttaacg

SEQ ID NO: 141873 - DNA, 660 bp, Homo sapiens
  misc_feature: GYAE6OF02I8XB9.46.67.G01.1.454.CMB.1.raw
  modified_base (290)..(290): a, c, t, g, unknown or other
  misc_feature (290)..(290): n is a, c, g, or t
  modified_base (367)..(367): a, c, t, g, unknown or other
  misc_feature (367)..(367): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgagggccttcggagaccctgtccctcacctgcgctgtctctggtgcctccatcagtagtggtttcttcgtggggctgggtccgcagctccgagggagggctggaatacattggaagtgtctctcagtaggtggaggttcctattacagtccgtactctcaagngtcgagtccaccatatctctggacacgtccagcaatctacgttttcccagaacgatgtagttctggcgacccgccgntcggaacgtacgggttcttttattacgtgtcgacggtaagacggtacggtcttaagttattgttaagttttggaggtttggtttacgtttacgacctaccgttagtacgtacggtacgggtcctaccggaccccggtggggacccgtaaggggtaacttaccggttcggtaccgtaaccgttccgttaccgttaccgtcccgttaccgacccggtaaccgggtccctaacggttcccggttacccgttccccgtacggtcccctacccgtccctaccgaacgaccgtacccgg

SEQ ID NO: 141874 - DNA, 726 bp, Homo sapiens
  misc_feature: GYAE6OF02GVLK8.46.67.G01.1.454.CMB.1.raw
  modified_base (195)..(195): a, c, t, g, unknown or other
  misc_feature (195)..(195): n is a, c, g, or t
  modified_base (220)..(220): a, c, t, g, unknown or other
  misc_feature (220)..(220): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtcctccatcctccctgtctgcaaccggtggganacagtgtcaccatcacttggccggnaagtcggaacattcgaactaccttaattttaaattggtaatcaacatagaccgagggaccgcccctaagcctcctaatctaatcgctgctactcctagtttagacgtaaaggtcgggtacccagtcggtaggttcaggtcggacgagtggtagttcgtagggtactagtactttcgaccttcgtaccaccctattacgaagttaaacttccgttagaaccgttaacggttacggtaaagtttagttttcgaaccttaaacttttactttaacgtacgtaactaaacgtaacgttaaatttaaccgtaaagttttcggttttaaccgggaacccgaaagggtaaccgtaaacccgtaaacctttaaaacgtaaaaccgtttaaaaaccggtaaccgttaggtaccggtacgttaccggacccttaaccgttacttaccgtttacggttaccctttacgttaacccttccccgtttaccccgaccttacgttttaccgagttaaaccc

SEQ ID NO: 141875 - DNA, 651 bp, Homo sapiens
  misc_feature: GYAE6OF02JIIOZ.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggacaacgtcggaacattgactacctatttaaacttggtatcaacatagaccaggacggcccctaagcctctaatctatgctgcatctagttgacgaaagtcggggtcccagtcgaggttcagtggcagtgatcgtaggacagtactttacacgttcctccaacgtactacgagttaatcgtacgacgtaacggtaggtaacgttattttacgacttaaccttaagttaccgttcgtaacgtaacaaaggttaacttaacgtaacggttttcgtttacggaaccggtaagggtaaccgtacgtaaaccttaaacgtaaaacctttaaaccggaaacgttcggtacgtaccgttacgaccgtaacccttaagttacccgttagttccctttaacgtacctttacccgttccccctaacgtcgttaccgttagtaaccg

SEQ ID NO: 141876 - DNA, 766 bp, Homo sapiens
  misc_feature: GYAE6OF02G22HT.46.67.G01.1.454.CMB.1.raw
  modified_base (320)..(320): a, c, t, g, unknown or other
  misc_feature (320)..(320): n is a, c, g, or t
  modified_base (344)..(344): a, c, t, g, unknown or other
  misc_feature (344)..(344): n is a, c, g, or t
  modified_base (350)..(350): a, c, t, g, unknown or other
  misc_feature (350)..(350): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctcatcagtagtggtttcttctggggctggggtccgcagcctcccgaggggaagggctggaatacagttggaagtgtctctcagttagtggaggttcctattacagtccgtctctacaagagtcgagtcacctatactctctggaccncgtccagcaactctacgttttccngaacgntgtacgttctagtcgaccgccgtgtacgacgtacgggtcttttaacgttacgtgttcggacgtaggacggtacggtacgttaatttagttacggttaagtttttgggtacggtttagggtttacgttttacggaacccgttacccgttaaggtaacgttccgggaaccgggggtccgtacccgggtaaccccggttcggggaacccggtaaggggtaacttaccggttacgggttacccgtacccggtttccgttacccgttaccgggtaccccttacccggtaaaccccggtaaccggggttaacccctaaccggttaccccgggtttaccccccgtttaccccccgggtttacggaccccccttaacccccgttacccccggttaacccgtaaacccggtaccggtaacccccg

SEQ ID NO: 141877 - DNA, 618 bp, Homo sapiens
  misc_feature: GYAE6OF02FK5FP.46.67.G01.1.454.CMB.1.raw
  modified_base (173)..(173): a, c, t, g, unknown or other
  misc_feature (173)..(173): n is a, c, g, or t
  modified_base (289)..(289): a, c, t, g, unknown or other
  misc_feature (289)..(289): n is a, c, g, or t
  modified_base (294)..(294): a, c, t, g, unknown or other
  misc_feature (294)..(294): n is a, c, g, or t
  modified_base (322)..(322): a, c, t, g, unknown or other
  misc_feature (322)..(322): n is a, c, g, or t
tcagactagcagtacacgaccggtgctcgatttagagtatacatagttgggtttgtcctcctgctggtggcagctcccagatgggtcctgtccctggtcgcaactgcaggagtcggcccacgactggtgaggccttcggagaccctgtccctcacctgcgctgtctctggtcncctccatcagtagtggtttcttcgtggggctgggtccggcagcctcccgaggggaaggggctaggaatacagttggaagtgtctctcatagtggaggttcctattacagtccgttntctanaagagtcgagtcaccatatctctggacncgtcagcaatctacgttttcccagaagtatgtagttctggtcgaccggcgctgacgacggggtacttttatactgtcgcgagacgacggtctattagtgtagtttttggagttggttatttcgaactacccgttagacgtcggacggggtctccggacccgtggggaccaagggtaactacgttcggtaccaccgttcctaccgttacgccctaccgaaccggtaacggaccctaacgttccggttcccttccccgtcggtccctaccccgttccctacccgtacgaccgtacccg

SEQ ID NO: 141878 - DNA, 596 bp, Homo sapiens
  misc_feature: GYAE6OF02F80CG.46.67.G01.1.454.CMB.1.raw
  modified_base (208)..(208): a, c, t, g, unknown or other
  misc_feature (208)..(208): n is a, c, g, or t
  modified_base (285)..(285): a, c, t, g, unknown or other
  misc_feature (285)..(285): n is a, c, g, or t
  modified_base (342)..(342): a, c, t, g, unknown or other
  misc_feature (342)..(342): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctgggctgggtccgnagctcccagggagggctggaatacattggaagtgtctctcatagtggaggttcctattacagtccgtactctcaagngtcgagtcaccatatctctggacacgtcagcaatctagtttcccagacgatgattcngtcgaccgccgctcgacgacgggtcttttattactgtcgcgagacgacggtctaatttagtgttattttgggagttaggtttactttcgtaactacccgttaagacgtcggacggggtcctacggaccccgttggggcccgaagggtaactaccgtacggtacctacccggtcttccgtacgtccctaccgacgaacggccctagtcccggttcttccccgtggccctacccgtcctacccgtaagccgtcccg

SEQ ID NO: 141879 - DNA, 788 bp, Homo sapiens
  misc_feature: GYAE6OF02J2G13.46.67.G01.1.454.CMB.1.raw
  modified_base (148)..(148): a, c, t, g, unknown or other
  misc_feature (148)..(148): n is a, c, g, or t
  modified_base (166)..(166): a, c, t, g, unknown or other
  misc_feature (166)..(166): n is a, c, g, or t
  modified_base (506)..(506): a, c, t, g, unknown or other
  misc_feature (506)..(506): n is a, c, g, or t
tcagactagcagtacacgaccggtgctcgatttagagtatacatattgggtttgggggacctcctgtgcaagaacatgaagcacctgtggtttgtcctcctgctggtggcagctccagatgggtcctgtccctggtgcaactgcaggngtccggcccagactggtnacggtccttcgggacgtaccctgtccctcacctggcgctgtctcgtggtcgcctcattcgagttagttcggttttctcggtcgggggccttgggggtcccgaatcgcccttacccggaagggggaaggggtcctgggaaactacgacgtttgggaaagttcggttacgtcccttacgaagttacggtaggggtaacggttttacccttaagttaaccgtaggttcccgggttaccttcgtaacgtaaacgtcggtaccgtacggttaccaccctaagttaacctccgtcgttagggacctaccggttaccgacgtctaaacttccgtacgtttttacccnggtaagtactgtacgtttgtcggtacgtaccggcccgtacgtggtaaccgtacggggttacttttaatccggtaggtcgacgggttaagccggtacggactttattaacgtcgttagtttttagggacgttaggttttacgttaccgaaccttacgttagccggtacggggtaccggggtcctttacccgggaccccgggttacggggataaccggggtactttacccgggtgtttaccccggaaccgttttcccgtaaccttacccggcccttaaccccgg

SEQ ID NO: 141880 - DNA, 687 bp, Homo sapiens
  misc_feature: GYAE6OF02ISJM2.46.67.G01.1.454.CMB.1.raw
tcagactagcagtacacgaccggtgctcgatttagagtatacatattggggtttgggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattgtatcaacatagaccagggacgcccctaagctctaatctatgctgactatcctagtttgacgtaaaggtcgggtaccctaagtcggtaaggttcaggtggctaaggtcggtagtcgtagggtacgagtatttcgaacttctaccaccgtatctaagttaactcgtacgtacgaaacgttagtaagttattttacggacttaaactttaacttaacgttacgttaacctaaacgtaataaacgtttaactaacgtttacggttttaccggaacgtaaacgggtaacctaaccgtaacctttaaaactaaaacgtttaaaaccgaaacgtttacgggtacgtacgttacggacccgtaaccttaacgttccgttaactttaccgtttaaccgtacttttaccccgtaccccggttacctaactttacccgtagttaacccg

SEQ ID NO: 141881 - DNA, 872 bp, Homo sapiens
  misc_feature: GYAE6OF02JBIGA.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtccctcacctgcgctgtctctggtgcctccatcagtagttggtttcttcgtggggctgggtccgcagctccgagggagggctggaatacagttggaagtgtctctcatagtggaggttcctattacgagtcccgtctctacaagtacgtcgacgtcaaccactattcctcgtggaactacgtccgaagacctaacttacttaccgttttccccgagtaaacgtattggtaactttacgtcggtcggaaccccggcgtccgtcgtaaccggtaccggggttcgttttaaacttaccggttggtcgggtacggtacgaacgggtaccggtaccttaagtttaagttacggtttaggttttttagggtacggttttacgggttttaacttttaccggtaaaccccgttaacccgttaacgggtaacgtttcccgggggaaccggggggtcccgtttaaacccgggacccccgggtttaacgggggacccgggtaaaaggggttaaacgtttaacccggttacggggtttacccgttaccccggttacccgtttacccgtttaaccggtacccccgttacccggtaaaccccgggtaaccggggtaaccccccgttaaccgggtttcccccggtttacccccgtttccccccgggttaccgggtaccccccggttaaccccccgtttaccccggttaaccccgtaaccggtaccccgtaaccccccggg

SEQ ID NO: 141882 - DNA, 642 bp, Homo sapiens
  misc_feature: GYAE6OF02I86Q9.46.67.G01.1.454.CMB.1.raw
  modified_base (193)..(193): a, c, t, g, unknown or other
  misc_feature (193)..(193): n is a, c, g, or t
  modified_base (425)..(425): a, c, t, g, unknown or other
  misc_feature (425)..(425): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctcctgtctgcaaccggtggganacagtcgtacaccatctacttcggccgggacaagtcggaacattcgactaccttaatttaatgtatacaacatacgaccgagggaccgaccctaagctacctaatctatgctgcactccgtagtttcacgaaggtcggtccagtcgtaggtcagtggctaggtgatgtaggatagtacttcactcgtacaccgtatacgattaactcgtacgtaacgaacgttgtaaagttnttttacgaacttaacttttacgttaacgtcggtaacctaaaacgttaacgtaaacttttacgaacgttttacgggttacccggaaccgtaaacgggtaactaaccgtaaacgttaaacttaaacgttaaacggtacgttagtaccggtactacgaccgtaacctaggttcctacggttacttacgtacccttcccgttccattacttacgtataccg

SEQ ID NO: 141883 - DNA, 699 bp, Homo sapiens
  misc_feature: GYAE6OF02HV4XT.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggcctttcggagaccctgtccctcacctgcgctgtctctggtgcctccatcagtagtggtttcttcgtggggctgggtccgcagcctccgagggaagggctggaatacagttggaagtgtctctcagtagtggtacggttcctattacagtccgtctctcaagtgtcgagtacaccatatctcgtgacacgtccaagctaatctacgttttcccagaagtatgtacgttcgtgtcggacccgccgcgtagacgtacgggttcgttttattacgtgtcgacgaagcggacgtcttattagttgttagttttggagtttggtttaactttcgaaccttaccgtagtacgtcgggtaccggggtcctaccggtaccccgggtcggggtacccgaaggggttaacctaccggttcgggttacccgtacccggttaccgttacccgttacgtaccccttacccggaaccccgaaccggggtcccctaacggttccccggttaccccctttcccccggtaccggtacccctaacccccgtttccccgtaacccgtaaccggtacccgtaacccccg

SEQ ID NO: 141884 - DNA, 725 bp, Homo sapiens
  misc_feature: GYAE6OF02JGKT5.46.67.G01.1.454.CMB.1.raw
tcagactagcagtacacgaccggtgctcgatttagagtatacatattggtttgtcctcctgctggtggcagctcccagatgggtcctgtccctggtgcaactgcaggagtcgggcccacgactggtgagggccttcggagaccctgtccctcacctgcgctgtctctggtgcctccatcagtagtggtttcttcgtgggtctgggtccgcagcctccagggagggctggaatacagttggaagtgtctctcatagtggagttcctattacgagtccgtctctcaagtacgtcgagtcaccgatactctacgtgaccacgtccagaccgaattcgacgttttcccagtaagactacgtagttctgtcgaccgtcgctggtaccgacgggttctttaactacgtggtacgcgaagtacggacggtacttattagtagttacgttttaggaggttaggtttacttacgttaacctacccgttaggtagttaccgggtacggggtccttaccggtacccggtcggggtaaccgtaacggggtaacttaccgggttacggtacccgtaccggttacccgtttccggttaaccggtcccccgttacccggaacccggttaaacccggggccccttaaccggttccccggggttaccctttacccccccgttacgggttaacccccaccccccgttttacccggtaacccgtaccggtaaccggtcccccgg

SEQ ID NO: 141885 - DNA, 612 bp, Homo sapiens
  misc_feature: GYAE6OF02GAF28.46.67.G01.1.454.CMB.1.raw
  modified_base (211)..(211): a, c, t, g, unknown or other
  misc_feature (211)..(211): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctccatcagtagttggtttcttcgtggggtctggggtccggcagcctcccgaggggaagggctggaatacattggaagtgtctctcataggtggtaggttcctagttacacggtccgtcttctcaagagtcgagtcactatactctcgtggacacgtccagacgtaatcgtacgttttccctagaacgtataggtagtttccgtggttcgacccggccggtccgtagaccgtacgggttacgtttattcgttgttgacgacggtaagcgtatattactgttagttttggagtttgtttacttcgactaccgtagcgtcggacgggcctaccggaccggtcgggaccgtacgggtaactcggtcggtaccgtaccgttcctccgttacgtccctaacccgg

SEQ ID NO: 141886 - DNA, 570 bp, Homo sapiens
  misc_feature: GYAE6OF02F2Y77.46.67.G01.1.454.CMB.1.raw
  modified_base (192)..(192): a, c, t, g, unknown or other
  misc_feature (192)..(192): n is a, c, g, or t
  modified_base (256)..(256): a, c, t, g, unknown or other
  misc_feature (256)..(256): n is a, c, g, or t
  modified_base (386)..(386): a, c, t, g, unknown or other
  misc_feature (386)..(386): n is a, c, g, or t
  modified_base (390)..(390): a, c, t, g, unknown or other
  misc_feature (390)..(390): n is a, c, g, or t
  modified_base (432)..(432): a, c, t, g, unknown or other
  misc_feature (432)..(432): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcgaacattgacactatttaaattgtatcaacatanacaggacggcccctaagctcctatctatgctgcatccagttttcgacaaaagttggggtaccccagttcgaggttcaagtggctagtggatcgtaggggacagtatttcacttctccactatcagtaatntganaacgtgaagtattttcgacttaaacttattactagtaccaanagtaaattacaattgttttacggacgtaaagggacctaacgaactaaactaaaatttaaaaccgaacgttagtacggtactagacctaaccattacctgttaccttactacttccctttacccgctacttctagtaac

SEQ ID NO: 141887 - DNA, 718 bp, Homo sapiens
  misc_feature: GYAE6OF02JTQJH.46.67.G01.1.454.CMB.1.raw
  modified_base (171)..(171): a, c, t, g, unknown or other
  misc_feature (171)..(171): n is a, c, g, or t
  modified_base (277)..(277): a, c, t, g, unknown or other
  misc_feature (277)..(277): n is a, c, g, or t
tcagactagcagtacacgaccggtgctcgatttagagtatacatattgggtttgtcctcctgtctggtggcagctcccagatgggtcctgtccctggtgcaactgcaggagtcgggccacgactggtgaggccttcggagaccctgtccctcacctgcgctgtctctggtncctcatcagtagtggttctcgtgggctgggtccgcagcctccgagggacgggctaggaatacagtggaagtgtctctcatagtggagttactattacagttccgtntctacaagtagtcgacgtcaccgatatctactggacacgtccagcaactctacgtttcccagtaactatgtacgttctgttacggaccgtcccgtcgtacgacgtacgggtactttaacttacgtagtgacggtagaacggtaacgtacgttaagtttacgtaggtttacgttttaggtaagttacggttttacgttaccggtaaccgttaacccgttacggtaacgttaccggggtacggggtcccgtaccgggtaccccggtggggaacccgtaacggggtaaccgtacggttaccgttaccgtacccgtttaccgttacccgttaccgtccgttaacccgtaaccggtaccgggtacccgtaacgttccccgggtttaccctaccccggttaccggtccctaaccccgttcccctacggaaccgtacccgtaccccgg

SEQ ID NO: 141888 - DNA, 645 bp, Homo sapiens
  misc_feature: GYAE6OF02HA5GW.46.67.G01.1.454.CMB.1.raw
  modified_base (191)..(191): a, c, t, g, unknown or other
  misc_feature (191)..(191): n is a, c, g, or t
  modified_base (434)..(434): a, c, t, g, unknown or other
  misc_feature (434)..(434): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctcatcctccctgtctgcaaccgtggganacagtgtcaccatcacttggccgggacaagtcggaacattgacaccttaatttaaatggtatcaacatacgaccagggaccggaccctaagctcctaatctatgctgcatccagtttcgactaaaggtcgggtcccagtacggtacggttcgaggtggcaggtggactcgtaggactagtactttacgaccttactaccgacctatacgtaacgtaactctacgactaaacggtgtaaagttntttacggacttaactttaattacgttagttaccaaacgtaagtaacttactaagttcgttttaccggaccgtaacgggaccgtaacgtaacccttaaagaaaacctttaaacggaaacgttacggtacggtacgtacggtacctaacgtacttacgttcgtacctttaccgtaactttcccggttaccctaccgtacgttctaggttaacc

SEQ ID NO: 141889 - DNA, 566 bp, Homo sapiens
  misc_feature: GYAE6OF02G9N7C.46.67.G01.1.454.CMB.1.raw
  modified_base (521)..(521): a, c, t, g, unknown or other
  misc_feature (521)..(521): n is a, c, g, or t
  modified_base (555)..(555): a, c, t, g, unknown or other
  misc_feature (555)..(555): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactatttaaattggtatcaacatagaccagggaccggcccctaagctcctaatctatgctgcactcctagtttgacaaggtcgggtcccatcggaggttcaggtggcgtagtcggtatccgtagggactagtactttacgactctccacctatacagtactctgactaacgtagaagtattttacgactaactttacttacgttgtactaaactagtaaattactaagtttcggtttacgaaccgttaagggaactacgtaactaactaaattaaaccgatagtaggntacgacactcttatcgttctctacttccgtcccnctactctgtac

SEQ ID NO: 141890 - DNA, 786 bp, Homo sapiens
  misc_feature: GYAE6OF02JK4NX.46.67.G01.1.454.CMB.1.raw
  modified_base (698)..(698): a, c, t, g, unknown or other
  misc_feature (698)..(698): n is a, c, g, or t
tcagactagcagtacacgaccggtgctcgatttagagtatacatattgggtttggggagtctcggtcaggacacagcatggacatgagggtccccgctcagctcctggggctcctgctactctggctccgagtgccagatgtgacatcgagctgacccagtctccatcctcctgtctcgacaccggtggacacgagtcgtacacctatctacttcggccgggtacaaggtccggaactgttacgaactaccttaatttaaagttggtatcaaacagtacgaccgaagggtaccgaccccttaagcctacctaagtacttagtgtcctgactacgtcgtagtttacgacgtaacgggttccgggtccctaggtccggtagttaccgagggttcgacgtaaggtcgggtaacttcggtaacgggtactacggttactttccaaccgttccgttaccgtaacctagtttaccgtaacgtttaactcgttaaccgaccgttaaagggttacgtaagtttacgtttagtaacccgtaattttaacgttaccttacggaaacccttaaataaacggttattaaaaccgtttcgtttagggtttaccccggaaacgtaacggggtaactaaaccgttaaaccgtaaaaccttaaaacggttaaaacccgacgggttacggttaacgtcctaaccggttaaccgtntacgttttacccggttgtttacccccgtttaatttacccggttttccccgttaaccgaacctttaccgttaaccgttggttaaaaccg

SEQ ID NO: 141891 - DNA, 590 bp, Homo sapiens
  misc_feature: GYAE6OF02H9JDX.46.67.G01.1.454.CMB.1.raw
  modified_base (250)..(250): a, c, t, g, unknown or other
  misc_feature (250)..(250): n is a, c, g, or t
  modified_base (399)..(399): a, c, t, g, unknown or other
  misc_feature (399)..(399): n is a, c, g, or t
tcagactagcagtacacgaccggtgctcgatttagagtatacatattgggtttgggggacctcctgtgcaagacatgaagcacctgtggtttgtcctcctgctggtggcagctcccagatgggtcctgtccctggtgcaactgcaggagtcgggcccacgactggtgaggccttcggagaccctgtccctcacctgcgctgtctcgtggtgcctccatccagtgtggtttctcgtggggctgggtccgcngcctcccgagggagggctggaatacagttggaagttgtctctcataggttggacggttcctattaccgacgtccgtctctcgaagtacgtcgagtcacctatatcctcgtaggactacgtccagtcaatcgtacgttttcccaggaatntgtacgttctgtcgaccgccgactcgacgtcgggtctttatacgtgtgacgagacgacgtgtattatgtagttttcggagttgttacgttccgactaccgtagtagtccgggcggggtcctacccgcccggtggggacctaagggtactacgtcggtaccgccgttccgtaccgttacgtcccgtaacccg

SEQ ID NO: 141892 - DNA, 641 bp, Homo sapiens
  misc_feature: GYAE6OF02FQH9S.46.67.G01.1.454.CMB.1.raw
  modified_base (253)..(253): a, c, t, g, unknown or other
  misc_feature (253)..(253): n is a, c, g, or t
  modified_base (339)..(339): a, c, t, g, unknown or other
  misc_feature (339)..(339): n is a, c, g, or t
  modified_base (361)..(361): a, c, t, g, unknown or other
  misc_feature (361)..(361): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgaggggagggctggaatacagttggaagtgtctctnatagtggaggttcctattacagtccgtctctcagagtcgagtcaccatatctctggacacgtccagcaatctagttttcccagaanatgtagttctgtcgaccgccgntcggacgtcgggtcttttacgttacgtcggttgacggtagaacggacggtcttaacgttagttgttaagttttttggggtacgttggtttacgtttaccgtaacctaacccgtaggtacgttcgggaccggggtcctccggaccccggtcgggggacccgaaggggtaactacgtcggtacctacccggttccgtaccgttacgccctaccgaccgaacgggcccctagtcccggttcccttccccgcggtaccctccccgtacctccgaagcgtacccg

SEQ ID NO: 141893 - DNA, 847 bp, Homo sapiens
  misc_feature: GYAE6OF02H17LN.46.67.G01.1.454.CMB.1.raw
  modified_base (190)..(190): a, c, t, g, unknown or other
  misc_feature (190)..(190): n is a, c, g, or t
  modified_base (809)..(809): a, c, t, g, unknown or other
  misc_feature (809)..(809): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctccatcctcctgtctgcaaccgtggganacagtgtccactatcacttcggccgggactaaggtccggaactagttacgacctaaccgtttaaattttaaaacgttgggttaacttaccgaaactaagttaacggacccgtaaacgggggtaccccgggtaccccctaaaggtcccttaaccctttaaacttacccgttaagtcggtaccttacggtacctaacgttcccgttacgggttttaagaccggtaaaacgggtccggggttaccccagttaccggtaggttaccgagggttcggaactagggtagtacgttacggtacggggtaacctaggttactttaccgtaaccgtttaccctaaccgtaaacctacgtttaaccgtaaacgttttaaacgtcccggtttaacgtaaaccgttaaaacgggtttaacggttaaacgttttaaccgtttaaccggtaaaacctttaaaccgtttttaaacgttaaccgtttaaccgggttaaaccaaaaccggttaaagttaactttaaaacggtaccgttttacgggttaaccgaacgggtaaacggtaacctaaacgtaacttaaacgtaaacgtaacgtaacggtgtacgtactacggtactaacttcgtacgttnttaccctacgttacttccgtaccctagtatctataacg

SEQ ID NO: 141894 - DNA, 734 bp, Homo sapiens
  misc_feature: GYAE6OF02HT9YU.46.67.G01.1.454.CMB.1.raw
  modified_base (279)..(279): a, c, t, g, unknown or other
  misc_feature (279)..(279): n is a, c, g, or t
  modified_base (282)..(282): a, c, t, g, unknown or other
  misc_feature (282)..(282): n is a, c, g, or t
  modified_base (286)..(286): a, c, t, g, unknown or other
  misc_feature (286)..(286): n is a, c, g, or t
  modified_base (305)..(305): a, c, t, g, unknown or other
  misc_feature (305)..(305): n is a, c, g, or t
  modified_base (350)..(350): a, c, t, g, unknown or other
  misc_feature (350)..(350): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccgcagctccgagggaagggctaggaatacagttggaagtgtctctcatgtggacgttctattacagtccgtnctnaagngtcgagtcactatactctntggacacgtcagcaatctaacgtttccagaactgtagtacgtttntcgtaggacccgcgtctacggaccgtaacggggttacttttacgtaagttgggtacggacggaggaacggtacgggtactttaagttagttagtttaggtttttagggtaacgggttttggttttaacgtttccgaaaccgttaccccgtttaaggaccggttccgggggaaccggggtcccgttaacccggtaccccgggtacgggggacccgtaaacggggtaacttaccggttcgggtacccgtaccggtcctttaaccgtaccggtaccctacccgaaccggtaaaccgggtcccctaggttacccggtttcccccttaccccggtcggtaccccccgttacccgttacccccgtaaccgtaccggtacccgtaaccccg

SEQ ID NO: 141895 - DNA, 601 bp, Homo sapiens
  misc_feature: GYAE6OF02HG48P.46.67.G01.1.454.CMB.1.raw
  modified_base (194)..(194): a, c, t, g, unknown or other
  misc_feature (194)..(194): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccggtggganacagtgtcaccatcacttgccgggacaaggtcggaacattcgactaccttaatttaaattggtatacaactatagaccgagggaccggcccctaagctactaatctatgctgctactcctagtttgacgtaaaggtcgggtacccagtcgtggttcaggtggacaggtggatcgtagggacagtacttcactctacactatcaagtactctgacaagtagaattagtttagtaactttactactagttaacaataataattaactaattcggtttacgacggaacggtaccaacgtaactaaacgtaaagttaaacgaacgttagtcgacgtcgaacctacctaagttccgttagttaccttactaccgttcccgttacccgacctacgttcgttagtacttaacgg

SEQ ID NO: 141896 - DNA, 701 bp, Homo sapiens
  misc_feature: GYAE6OF02JCZRZ.46.67.G01.1.454.CMB.1.raw
  modified_base (194)..(194): a, c, t, g, unknown or other
  misc_feature (194)..(194): n is a, c, g, or t
  modified_base (234)..(234): a, c, t, g, unknown or other
  misc_feature (234)..(234): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccggtggganacagtgtcaccatcacttcggccgggacaaggtcggaacnttcgactaccttatttaatggtatacaacatagaccgagggaccgcccctaagcctacctaatctatgctgctatccgtagttacgacgtaaggtccggggtaccctagtcggtacggttcgaggtggacgtaggtggtacttcggtacgggactaaggttctttacgacttccgtacctaacctacgttacgtaagttaacttcggtacgtaccgtaaacggttaggtaaagtttacgttttacggaacttaactttaacgttacgttacgtaacgtaaacgtagttaaactttaacgtaacggtttcggtttaaccggaaccgtaaacggggtacctaaacgtaaccgttaaacgtaaaaacgttaaaccgtaacgttacgggtaccgtacgtacggaccttaactacgttacgttacttaccttacgtacctttacccgtacccgtactacttaccgagttacg

SEQ ID NO: 141897 - DNA, 554 bp, Homo sapiens
  misc_feature: GYAE6OF02HKUM8.46.67.G01.1.454.CMB.1.raw
  modified_base (334)..(334): a, c, t, g, unknown or other
  misc_feature (334)..(334): n is a, c, g, or t
tcagactagcagtacacgaccggtgctcgatttagagtatacatattgggtttgtactcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctccagggaaggggctggaatacattggaagtgtctctcatagtggaggttcctattacagtccgtctctcaagagtcgagtcacatatctctggacacgtccagcaatctacgttttcccngaagatgagttctgtcgaccgcgctgacgacgggtctttattactgtgcgagagacggctattatgtagtttttggagttggttatttcgactaccgtagactcggacggggctccgacccgtggggccagggaactacgtgtccaccgtctccgtagcctccacccgacggcccagtccgtcccttccccgtcggcctccccgtcctaccagtcgaccg

SEQ ID NO: 141898 - DNA, 581 bp, Homo sapiens
  misc_feature: GYAE6OF02F0SFH.46.67.G01.1.454.CMB.1.raw
  modified_base (193)..(193): a, c, t, g, unknown or other
  misc_feature (193)..(193): n is a, c, g, or t
  modified_base (388)..(388): a, c, t, g, unknown or other
  misc_feature (388)..(388): n is a, c, g, or t
  modified_base (567)..(567): a, c, t, g, unknown or other
  misc_feature (567)..(567): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccggtgganacagtgtcaccatcacttgccgggacaagtcggaacattcgacaccttaatttaaattggtatcaacatagacagggacgcccctaagctcctaatctatcgctgctactcctagtttacgacgaaaggtcggggtacccagttcggtaaggttccaggtggctaggtcggatcgtgggacagtatttcacttcncaaccatcaagtatcgtgacacgtagaagttatttgactaagttattactgtacaacgtaataaattaactaagttacgtttacggaaccgtaaggaccacgtaacttaaataaacttaaacgtactagtacgcgtacgtacacctaagttcttcgtctttaccacttcccgttacccnctacgttcctatac

SEQ ID NO: 141899 - DNA, 641 bp, Homo sapiens
  misc_feature: GYAE6OF02JILRN.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtcgtacaccatacacgttggccgggacaagtaccggaactattgactaccttaattttaaattggtatcaacataacgaccgagggaccgacccctaagcctacctaatcttatcgctgctactcctagtttgacgaaggttcgggaccctaagtcggtaggttcaggtcggacgagtggtatcgagggactagtacttcactactccacactacaagtaactcgacgacgtaacgtagtagttatttcgacttaacttattactacgtactaaagagttaaacttactacgtttcgttaccggaaccgtaaagggtaccaaacggtttaacctaaaacgtttaaaaacgttaaacgtacgttacggtacggttacctaggtacctaaccgtattcgttactaccttactaccgtttcctacccgtactacttacgtacgtacg

SEQ ID NO: 141900 - DNA, 840 bp, Homo sapiens
  misc_feature: GYAE6OF02GJQYN.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatcctccctgtctgcaaccggtggagacagtgtcaccatctacgttcggcccgggactaacggtcggaaactagtttacgaacctaaccctttaattttaaaagttggttaactaccaaactaagttaacggaaccggaacggggaacccggacccccttaaaggccttaccctaaatctacgtgacctcgacctacgttcctaggtttcgaaccgtaaaacggggttcggggttaccccaaggttaccggtacgggttcgtaagggttcgggaccgtaggtacggtagttacggtagggtacgtaagttacgtttaccacttacctacctaccgtaacgttacgtaacgttaacttacgtacgtaacgtaaacggttaacggtaaagtttacgtttacgtaccttaaactttacgtttaccgttacgtaactaaacgtaagttaaactttaaacgttaacgtttacggttttaccggaaccggttaaacgggacccgtaaccgttaaaccgttaaacgttaaaaccgtttaaaaccggtaacgttacggtacgttaccggtaccgtacccgtaaaccttaacgttacccgttaccgtttaccgttttacccgttaccctttacccgtttacccccgaacccgtttaccgtttaccgttaccgtttaaacccg

SEQ ID NO: 141901 - DNA, 504 bp, Homo sapiens
  misc_feature: GYAE6OF02I750M.46.67.G01.1.454.CMB.1.raw
  modified_base (494)..(494): a, c, t, g, unknown or other
  misc_feature (494)..(494): n is a, c, g, or t
  modified_base (501)..(501): a, c, t, g, unknown or other
  misc_feature (501)..(501): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaattgtatcaacatagaccagggacgcccctaagctcctaatctatgctgcatccagtttgcaaagtgggtcccatcgaggttcagtggcagtggatcgtgggacagattcactctcaccatcataatctgacaacgtgaagtatttgactaacttattactgtacaacagtaattacaattgttttacgacgaaggacaacgactaacaaattaaacgaatgtagctagacacatctgtcttcactcctccnctatctntac

SEQ ID NO: 141902 - DNA, 757 bp, Homo sapiens
  misc_feature: GYAE6OF02HDG6Y.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctggggtccggcagcctcccgagggggaacggggctagggaatacagttgggaagtgtctctcatagtggaggttcctattacagtccgtctctacaagagtcgagtcaccatactctctgacacgtccagcatctacgtttccagaagatgtacgttctgtcgaccgcgctacggacgtacgggtcgttttaatacgtgtcggacgtagacggacggtacttaagtttattaggttagtttttagggtaggtttagggtttacgtttaccggtaacctaacccgttaaggtaacgttccggggtaaccggggggtcccgttacccggtaacccccgggttacgggggaacccggtaaaggggtaaacgtttaaccggtacgggttacccggtaaccccgttccgttacccgtttaaccggtcccccttaacccgaaccccgggtaaaccggggtaccccctaacggttaccccgggtttaccccgtttcccccccggtaccgggtaccccctaccccccgtttaccccgtaccccgtaacggtacccgtaccccgg

SEQ ID NO: 141903 - DNA, 656 bp, Homo sapiens
  misc_feature: GYAE6OF02HN7UG.46.67.G01.1.454.CMB.1.raw
  modified_base (194)..(194): a, c, t, g, unknown or other
  misc_feature (194)..(194): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccggtggganacagtgtcaccatcacttcggccgggcaaggtcggaactagttcgactaccttaattttaaagttggtatacaacatagaccgagggaccgcccctaagcctcctaatctatgctgctactcctagtttcgacgtaaaggtcgggtaccagtcgaggttcaggtggactaggtgatcgtaggacagttagtttcactctacacctagtcaagtatcgtagacgtaagtagtaaagttatttacgacttaaactttattaacgttcgtaactaaactaagttaaattaactaagtttacggttttaccggaaccgtaacgggtaacctaacgtaacttaaacgttaaaaacgttaaacgaaacgttacggtacggtaccgtacgtaccaaccgttaactaccgttacgttaccttaccgttacttccccgttacccgtacccgttacgttcctaggttaaccg

SEQ ID NO: 141904 - DNA, 582 bp, Homo sapiens
  misc_feature: GYAE6OF02G65GN.46.67.G01.1.454.CMB.1.raw
  modified_base (211)..(211): a, c, t, g, unknown or other
  misc_feature (211)..(211): n is a, c, g, or t
  modified_base (329)..(329): a, c, t, g, unknown or other
  misc_feature (329)..(329): n is a, c, g, or t
  modified_base (381)..(381): a, c, t, g, unknown or other
  misc_feature (381)..(381): n is a, c, g, or t
  modified_base (438)..(438): a, c, t, g, unknown or other
  misc_feature (438)..(438): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttctcgtggggctgggtccggcagcctccgagggaggggctggaatacagttggaagtgtctctcatagtggaggttcctattacagtccgtctctcaagngtcgagtcaccatatctctgacacgtcagcaatctacgttttcccagaagtnttgtagtttctgtcgaccgccgtctgcgtacggtctttatactgtcgcgagagcgtntattgtgttagttttggagtttggtttatttccgactacccgtagtacgtcggtacggggtcctacccggcccggtggggacccgtaagggaacttaccgtcggtacctacccggttcctacccgtttacgccccttaaccccg

SEQ ID NO: 141905 - DNA, 676 bp, Homo sapiens
  misc_feature: GYAE6OF02FMI4U.46.67.G01.1.454.CMB.1.raw
  modified_base (404)..(404): a, c, t, g, unknown or other
  misc_feature (404)..(404): n is a, c, g, or t
tcagactagcagtacacgaccggtgctcgatttagagtatacatagttaggggtttggggaagtctcggtcaggtacgaccagcgaactggacgaatcgagggtccccgctcagctcctggggctcctgctactcgtggcctccgaggtcgccagatagtgacatcgagctgacccagtctccactcctcctgtctgcaacggtgggagacagtgtcaccagtccgacgttcgccgggactaaggtcggaactagttcgaacctaccttatttaaagtcggtaactcaacagtaacgaccgaacgggaccggcccctaagctcctaactctatgtctgcactccagtttcggacctaaaggtcggggtcccagtccgtaggttcaggtggctaggtggactcgngggacagtattcactctcacctatcaacgtaactcgtcgacaacggtgtaacgtagtttacgacttaacgttactttacgttacgtactaactagtaattactaagttcgtttacgacgtaacggtactaacggtaacttaacgtaaacgttaaaccgaacggttacggtacgtacgtacgtaaccggtaaaccctaacgttaccgttacggttaccgttaccgtacgttccccgtttaacccggcccttaacgtttccgtacgttaacccg

SEQ ID NO: 141906 - DNA, 716 bp, Homo sapiens
  misc_feature: GYAE6OF02I5SE8.46.67.G01.1.454.CMB.1.raw
  modified_base (280)..(280): a, c, t, g, unknown or other
  misc_feature (280)..(280): n is a, c, g, or t
  modified_base (670)..(670): a, c, t, g, unknown or other
  misc_feature (670)..(670): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtgggctgggtccgcagctccgagggagggctggaatacattggaagtgtctctcagttagtggaggttcctattacgagtccgtntctacaagcgtcgagtcacctatatctctggacacgtccagtacaattctagttttcccagaagtatcggtaagttccgtggtcgaacccggccgtacgttacggaacgtaccgggggttactttttaacttacgtcggtacggtacgtaaggaaggtaccggtacttaagttacgttgttaacgtttttgggaagtttgggtttaacttcggtaacctacccgttaaggacgttcgggaccgggggtccttacccggtaccccggtaggggtacccgaaggggtaacttacgttcgggtacctaaccccggttcgttaccgtttaccgccccgttaccgtaaccggtaaaccgggtccctaacggtcccgttaccccgtttacccccgnggtcccccttaaccccgttcccgtaacccgaacggtaccgtccccg

SEQ ID NO: 141907 - DNA, 656 bp, Homo sapiens
  misc_feature: GYAE6OF02JN418.46.67.G01.1.454.CMB.1.raw
  modified_base (249)..(249): a, c, t, g, unknown or other
  misc_feature (249)..(249): n is a, c, g, or t
  modified_base (321)..(321): a, c, t, g, unknown or other
  misc_feature (321)..(321): n is a, c, g, or t
  modified_base (349)..(349): a, c, t, g, unknown or other
  misc_feature (349)..(349): n is a, c, g, or t
  modified_base (358)..(358): a, c, t, g, unknown or other
  misc_feature (358)..(358): n is a, c, g, or t
  modified_base (363)..(363): a, c, t, g, unknown or other
  misc_feature (363)..(363): n is a, c, g, or t
tcagactagcagtacacgaccggtgctcgatttagagtatacatattgggtttggggtaccgtcctgtgcagaacatgaagcacctgtggtttgtcctcctgctggtggcagctcccagatgggtcctgtccctggtgcaactgcaggagtcgggcccagactggtgaggccttcggagaccctgtccctcacctgccgctgctctggtgcctccatcagtcgtggtttctcgtgggctgggtccggtnacgctcccgagggacgggcgtcggaactactagttcggaagtcgtctcgtcagtagtggaggttctagtacngtccgtctctcaagtgtcgagttcaccntactctcgngtacncgtcagcaagtctagtttcccagaagctgtacgtctacgttcgaccgtcccgtactgaccgtacgggtacgtttactacggtagtcggtacgacgtagcgtacttagtacgtgttacgttttggacgttggtttacttccgtaacgtcccttaaggtacgtcccggtacggggtacttcccgggaaccccggtttcgggttaccgggaaccgttaaagggttccccgttaacggggttcccttaaccccgggggttcctttaacccggttcccggttaccccgtaaccccggg

SEQ ID NO: 141908 - DNA, 703 bp, Homo sapiens
  misc_feature: GYAE6OF02H9MXI.46.67.G01.1.454.CMB.1.raw
  modified_base (138)..(138): a, c, t, g, unknown or other
  misc_feature (138)..(138): n is a, c, g, or t
  modified_base (194)..(194): a, c, t, g, unknown or other
  misc_feature (194)..(194): n is a, c, g, or t
tcagactagcagtacacgaccggtgctcgatttagagtatacatattggtttggggtagtctcggtcaggacacagcatggacatgagggtccccgctcagctcctggggctcctgctactctggctccgaggtgccngatgtgacatcgagctgacccagtctccatcctccctgtcctgacaaccgtggganacaggtgtcaccatcacgttcgccgggataaggtccgggaacagttcgaacctaaccttagttttaaaattggttaatacaacaattagaaccgtagggaaccggaccctaaacggtcctacctaagttcctaagtacgcttcgccgtatccctagtttacgacgaaaacggttcggggtacccagtaccggtaggttccaggttacggtaccgtagggttcggagttacggtcgggtaaccgtggtaacttttccgaacttccgttacgacctaagtctaggttaactctacgtacgtaactacgtaagttatttacggacttaacgttaattacgtacgtacaactaacgtaattacaagtttacgttttacggaactacggtaactaacggacttaaacgtaaacgttaaaacacgttagtacgtacgttcgtaacctaaccgttactcgttacgttaacctttccgtacttacccttcccggtaacttaccgtcgttacgttacg

SEQ ID NO: 141909 - DNA, 571 bp, Homo sapiens
  misc_feature: GYAE6OF02GLWVQ.46.67.G01.1.454.CMB.1.raw
  modified_base (337)..(337): a, c, t, g, unknown or other
  misc_feature (337)..(337): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagcctcccaggggaagggctggaatacagttggaagtgtctctcatagtggaggttcctattacagtccgttctctcaagagtcgagtcaccatatctctggacacgtccagcaatcagttttcccngaagatgagttctgtgaccgcgctgacgacgggtctttattactgtgcgagagacggcttattagtgtagtttttggagttggttagtttcgactaccctagactcggacggggctccgacccgtgggccaagggtatacgtcgtcaccgtctccgttacgcctccaccgaacgggccctacgtccggttccttcccccgtcggccctaccccgtcctaccgaacgacgtcccg

SEQ ID NO: 141910 - DNA, 587 bp, Homo sapiens
  misc_feature: GYAE6OF02GTIHG.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatcctccctgtctgcaaccggtgggagacagtgtccaccatcacttggccgggacaaggtcggaacattcgacctaccttaatttaaattggtatacaacatacgaccgagggaccgaccctaagcctactaatctatgctgcactcctagtttgactaaggtcgggtacccagtcgaggttcaggtcggacaggtgatcgtagggactagtacttcacttctacacatacagtatctagacaagtagaaagttatttagacttaacttacttacgtagtacaaacgtaataacttaactaattacgtttaccgaaccgtaaggactaacgtaactaaacgtaaagttaaacgtaatgtagacgtagacctacgtatacgttcgttacttacacgttcctcccgtactacttctagtaac

SEQ ID NO: 141911 - DNA, 671 bp, Homo sapiens
  misc_feature: GYAE6OF02IEKRF.46.67.G01.1.454.CMB.1.raw
  modified_base (97)..(97): a, c, t, g, unknown or other
  misc_feature (97)..(97): n is a, c, g, or t
  modified_base (191)..(191): a, c, t, g, unknown or other
  misc_feature (191)..(191): n is a, c, g, or t
  modified_base (215)..(215): a, c, t, g, unknown or other
  misc_feature (215)..(215): n is a, c, g, or t
  modified_base (250)..(250): a, c, t, g, unknown or other
  misc_feature (250)..(250): n is a, c, g, or t
  modified_base (330)..(330): a, c, t, g, unknown or other
  misc_feature (330)..(330): n is a, c, g, or t
  modified_base (336)..(336): a, c, t, g, unknown or other
  misc_feature (336)..(336): n is a, c, g, or t
tcagactagcagtacacgaccggtgctcgatttagagtatacatattgggtttggggagtctcggtcaggacacagcatggacatgagggtccccgntcagctcctggggctcctgctactctggctccgaggtgccagatgtgacatcgagctgacccagtctccatcctcctgtctgcaaccgtggganacagtgacacatcacttggccggnaagtcggaacatgactactatttaaatgtatcaanatagcagggcgccctaagctctaatctatgctgctatctagtttgctaaagtgggtaccagtcgtagtcagtgcagtgancgtganagtattcactctacacatcaagtatctagactaacgtagtaagttctttacgtaacctaacgttttattaaccgttagttaaaccaaacgttaaacgttaaacgtttaaaccttaacgttttaccgggtttttaacccggaaccgggtaaaacgggtaccgtaaaccggtaaaccttaaaacgaaaacgttttaaaacggaaccgtttaacgggttgacccggttaagtacccggtaaacccttaaccgttacgttcccggtttaaccgttaccgttaaccgttttaccccggttaccccggtaccctttaaacgttcccgttaagttaacccgg

SEQ ID NO: 141912 - DNA, 607 bp, Homo sapiens
  misc_feature: GYAE6OF02GP19S.46.67.G01.1.454.CMB.1.raw
  modified_base (341)..(341): a, c, t, g, unknown or other
  misc_feature (341)..(341): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctgggctgggtccggcagctcccagggaagggctggaatacagttggaagtgtctctcatagtggaggttcctattacagtccgtctctcaagagtcgagtcacctatatctctggacacgtcagcaatctagttttcccagaacgtntgagttctgtcgaccgccgctagacacggtcgtttatactgtgtcgagagacggtctattatgtacttttggagttggttatttcgactacccgtagtacgtcggacgggtctccgtacccgtgggaccgaacgggtaacttacgtcggttaccgaccgttccttaccgttaccgtcccgttacccaccggaaacgggtcccctaagtcccggttacccttccccgtaccggcctaccccgtacccgtacccgtaacgcgtacccg

SEQ ID NO: 141913 - DNA, 606 bp, Homo sapiens
  misc_feature: GYAE6OF02GDFWW.46.67.G01.1.454.CMB.1.raw
  modified_base (384)..(384): a, c, t, g, unknown or other
  misc_feature (384)..(384): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgcaaccgtggagacagtgtcaccatcacttgccgggacaagtcggaacagttcgactaccttaatttaaattggtatcaacatagaccagggacggcccctaagctcctaatctatgctgcatcctagtttgacaaaggtcgggtcccagtcgagttcagtggcagtggatcgtagggactagtattcgactctaccactatanagtaatcgtgactaacgtacgtaagtattttcgacttaacttaattactagtactaacaagtaacttaactaagttcgtttacggaacgtaacggtaccaacgtaacttaaactaaaacgttaaacgttaacgtagtacgtacgtacgtaccgtaacctattccttagttaccctttacgtaccttacccgttacccgaccctacgttccgtacgttaaccg

SEQ ID NO: 141914 - DNA, 556 bp, Homo sapiens
  misc_feature: GYAE6OF02HQDZP.46.67.G01.1.454.CMB.1.raw
  modified_base (193)..(193): a, c, t, g, unknown or other
  misc_feature (193)..(193): n is a, c, g, or t
  modified_base (368)..(368): a, c, t, g, unknown or other
  misc_feature (368)..(368): n is a, c, g, or t
  modified_base (398)..(398): a, c, t, g, unknown or other
  misc_feature (398)..(398): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgtcaccatcacttgccggcaagtcggaacattgacactatttaaattgtatcaacatagaccaggacgcccctaagctcctaatctatgctgcatccagttttgacgtaaaggtcggggtaccccagtcgtaggttcagtggcagtggatcgtggacagtatttcactcncacatcagtaatctgactaacgtgtaagtnttttagactaactttattactgtacaactagtaaattacaattggtttacgacctaagggactaacgaacttaactaaaattaaacgaattacgagtactgaccactagtcctgttaccttacgtacttaccgttccccgacctacttcgtagtaacg

SEQ ID NO: 141915 - DNA, 555 bp, Homo sapiens
  misc_feature: GYAE6OF02HCBH4.46.67.G01.1.454.CMB.1.raw
  modified_base (212)..(212): a, c, t, g, unknown or other
  misc_feature (212)..(212): n is a, c, g, or t
  modified_base (246)..(246): a, c, t, g, unknown or other
  misc_feature (246)..(246): n is a, c, g, or t
  modified_base (282)..(282): a, c, t, g, unknown or other
  misc_feature (282)..(282): n is a, c, g, or t
  modified_base (320)..(320): a, c, t, g, unknown or other
  misc_feature (320)..(320): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtcccctcacctgcgctgtctctggtncctcatcagtgtggtttctgtgggctgggccgcngctccgagggagggctggaatacattggagtgtctntcatagtggtaggttctattacagtcctctctacaagngtcgagtcaccatactctcgtgactacgtcagctaactctacgttttcccagaagtatagtacgttcgtgtcgaccgtccgctcgacgacgggttctttattcgtgtcgcgtagacgcgtctacgttatgttagtttggagttgtttacttcgactactagacgtcggacgggctccggtacccgtgggaccgaaggtactacgtcggtcctaccgtcctacctcgccctacccg

SEQ ID NO: 141916 - DNA, 759 bp, Homo sapiens
  misc_feature: GYAE6OF02H441O.46.67.G01.1.454.CMB.1.raw
  modified_base (288)..(288): a, c, t, g, unknown or other
  misc_feature (288)..(288): n is a, c, g, or t
  modified_base (348)..(348): a, c, t, g, unknown or other
  misc_feature (348)..(348): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctggggtccggcagctcccgaggggaaggggctggaatacagttggaagtgtctctcatagtggagttcctattacagtccgtcttcncaagagtcgagtcaccatattctacctggaccacgtccagactaattctagttttccccngaaggtatgtagttctgtcgacccgtccgctgaccgtacgggtcgttttattacctgttgacgagacgacgggtacttagttagttggttagttttaggaggtttagggttttaactttaccggtaaccgtaaccccgttaaggtaacgttccggggtaaccggggggtcccgttacccggtaacccccggtaccggggggaccccggtaaggggaaacgtttacccgttcgggttacccgtacccggttacccgttacccgtttaaccgtacccgttaccccgtaaaccccggtaaacgggggtacccccctaaggttcccccgggtttacccctttaccccccccggttggttcccccgaaccccccctttcccggttaacccctaaacccgggtaccgtaacccccgg

SEQ ID NO: 141917 - DNA, 727 bp, Homo sapiens
  misc_feature: GYAE6OF02F85D3.46.67.G01.1.454.CMB.1.raw
  modified_base (212)..(212): a, c, t, g, unknown or other
  misc_feature (212)..(212): n is a, c, g, or t
  modified_base (714)..(714): a, c, t, g, unknown or other
  misc_feature (714)..(714): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtcncctccatcagttgttggtttctcgtggggctgggtccggcagcctccggaggggacgggctaggaatacagttaggaagtgtctctacagtaggtaggtacggttccttaattacgacgttcccgtactcgtacgaaggtacgtacgtacgtaccaacctattactcgtacgtacggaacaccgttacaagactaacttcgttacgttttacccaggtaacgtacttggtacgttctacggtacgtacccgtccgtacgttacgaccggttacgggtttactttacgtacgtggtacgtacggtaaggtaccgttacggttactttaagttagtttacggttaggtttttaggtaggttttacgtttacgttaccgtaaccgtacggttaaggaccggttaccgggggtaccgggttaccgtacccgggtacccggggtaccgggtacggtaaacggttacgtacccggttacgcccgttacccggttctacccggttaccnccccgtaacccgg

SEQ ID NO: 141918 - DNA, 687 bp, Homo sapiens
  misc_feature: GYAE6OF02JQHGW.46.67.G01.1.454.CMB.1.raw
  modified_base (208)..(208): a, c, t, g, unknown or other
  misc_feature (208)..(208): n is a, c, g, or t
  modified_base (297)..(297): a, c, t, g, unknown or other
  misc_feature (297)..(297): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctgggctgggtccgnagctccgagggagggctggaatacgattggaagtgtctctcagtgtggagttcctattacagtccgtactctcaagtgtcgagtcaccntatctcgtggacacgtccagcaatctagttttcccagtaacgtatgagtttccgtggtcgtacccggcccgtcgtacggtaacgtaccggggtactttttaacttaccgtggtcggaccgtaaggaacggtacggtaccttaagtttaacgttggttaattttttggggagtttcgggttttaacttttccggaacctacccgttaagtacggtaccgggtaccggggtccttacccgggaccccggtggggtaccgtaacggggtaactaccggttcggttaccgtacccgtccgttaccgttacgcccttacgaacccgtaacgggtccctagtcccggttacccttccccggcggtccctaccccgtcctccgtaacgtcgtacccg

SEQ ID NO: 141919 - DNA, 733 bp, Homo sapiens
  misc_feature: GYAE6OF02GX9DW.46.67.G01.1.454.CMB.1.raw
  modified_base (299)..(299): a, c, t, g, unknown or other
  misc_feature (299)..(299): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagaccctgtccctcacctgcgctgtctctggtgcctcatcagtagtggtttcttcgtggggctgggtccggcagcctcccgaggggaaggggctaggaatacgagttgggaagttgtctctacatagtggacggttctattacagtccgtctctacaagngtcagtcaccatactctcgtggacaccgtccagacaactctacgttttccctagaagtacgtagtagttctgtcgtaccggtcccgcgtcggaccgtacggggttacgttttacttacgttggtcggacggtaggaacggtacggtactttaacgtttagttgtttagttttgggtaaggtttggtttacgtttaccgtaaccgtacccgttaggtacgtcggggtaccggggtcccgtacccgggtaccccgggtcggggacccggtaacgggtaacgttacggttacggtacccgtaccggttccttcccgtttaccggtccccttaacccgacccggtaaccgggtacccctaccgggttacccgttccccgttcccccggtccgggtacccctacccccgttccccgtaaccgtaccgtcccgtacccgg

SEQ ID NO: 141920 - DNA, 741 bp, Homo sapiens
  misc_feature: GYAE6OF02HA1SI.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccactcctccctgtctgccaaccggtgggagacagtgtccaccatcacgttggccgggacaaggtacggaactagttgaacctaccttaattttaaagttggtaactacaaactatacgaccggacgggaccgacccctaagccttactaatctatgctgactactccgtagtttacgacgtaaacgggttcgggtaccctaggtccggtaggttcgaagggtcggacgtagggtaggtactcggtagggaactaggttactttaccaacgttcctaccacctaatacgtaagttaactccgtacggacgtaacggtagtaacgttacgtttacgtaaccttaacgtttacttaacgttcgtaacgtaaactaagttaaacttaacgtacggttttaccggtttaaccggaaccgtaacgggtaacctaaaccggttaaaccttaaaacgttaaaaaccggtttaaacggtaacgttacggtacggtacctacggtaccctaacgttaacgtttccttacggtttaccttacgttaccttcccgttacccgtaccttagttacccgtagttaaccg

SEQ ID NO: 141921 - DNA, 873 bp, Homo sapiens
  misc_feature: GYAE6OF02IHMG5.46.67.G01.1.454.CMB.1.raw
  modified_base (233)..(233): a, c, t, g, unknown or other
  misc_feature (233)..(233): n is a, c, g, or t
tcagactagcagtacacgaccggtgctcgatttagagtatacatattgggtttgggggacctcctgtgcaagaacatgaagcacctgtggtttgtcctcctgctggtggcagcctccagatcggttcctgtcccgtggtgacaactgcgaggaggtcccccccccccgggcacgacgtgggtgacggtccttcggacgaccctcgtccctcaccgtgcgctgtctcgtggtcncctcatcaggttagttggtttctcggtcggggcttcggggtccgatacgtccgtaccggaagggggaacggggcgtaggtaaactactagttgggaagttcgtcctcgtcagttaggtgggtacggtttccttaagttaccgacggtttccccttacgtccgtaacgtaaagggtacggttccggtaacgttaccaaccgtaattaccgttcccgttaccggtacgggtaacctacccggttacccgaacggtacctaaaacgttccgtttaaccgtttttccccgaaggtaaacggtactttaggtaacgttttcgtacggttaccgacccggtcccgtacgtaccggtaaccgggttaccggggtttacgttttaacgtttaccgtaggttcggtacgggaagtaccgggtacgtcgttaattagttacgttaaggtttttgggaagttttacgggttttactttaccggtaacccgttaaccgtaggttaaccggtaccgggggtaccgggggtccgttaccccgggtaacccccgggttacggggtacccgggtaaagggttaacccgttacggttacccgggttacccgtacccggttcccgtttaccggttaccccggtaccccgttaacccgg

SEQ ID NO: 141922 - DNA, 519 bp, Homo sapiens
  misc_feature: GYAE6OF02GL9PN.46.67.G01.1.454.CMB.1.raw
  modified_base (414)..(414): a, c, t, g, unknown or other
  misc_feature (414)..(414): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgcccctaagctcctaatctatgctgcatccagtttgcaaagtgggtcccatcgaggttcagtggcagtggatcgtgggacagtattcactctcaccatcagtaatctgcaacgtgaagtatttagactaacttattactgtacaanagtaattacaattgtttacggacaagggacaacgactaacaaattaaacgactagtgtctgacactatctcgttacttacacttcctacccgtctacttcagtac

SEQ ID NO: 141923 - DNA, 1011 bp, Homo sapiens
  misc_feature: GYAE6OF02IYDXQ.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctcgtggtcgcctcatcagttagttggtttccttcgtggggtccttggggtccggcacggtcctacccggaggggaacggggtctagggaatacgtagttagggaagttgtctctactagtaggtggtacggttccttaattacgagttccgttctctagagtagtcgacgttccaacctagtactactcgtaggaacctaccgtaccaggtacctaaattccgttacggttttttaccccaggtaaagtacttacggtttacgttaacgtttcgggttccgaaacccgggtcccggtacgtacgggtaaaccgtaccggggggtttactttttaaaccgttacgttcgggtttacggaccgggtaacggtaaccgggtaaacggttccgtttaaacgttttaaacgtttccgggttttaaaggtttttttaaccgggggtaagggtttttaacggggttttttaaacctttcccggggttaaaacccgttaaccccggttttaaacgggtaccggtttaaacccgggggggtaccgggggttacccccggtttaaccccggggttaaccccccggggttacggggggtaaccccggttaaaacggggggtaacccgttttaaccgggttccggggttaaaaccccgtttcccgttaccccggttttaaccccggtttacccgtacccccgttacccgggtaaaccccggtaaaccggggttcccccttaaccgggttaccccgggtttttccccccttttaccccccgggtaccgggttaaccccccttccccccgttttaaaccccggttaaccccggtttaaccgggaccccgttaacccccggg

SEQ ID NO: 141924 - DNA, 548 bp, Homo sapiens
  misc_feature: GYAE6OF02FOTNC.46.67.G01.1.454.CMB.1.raw
  modified_base (250)..(250): a, c, t, g, unknown or other
  misc_feature (250)..(250): n is a, c, g, or t
  modified_base (377)..(377): a, c, t, g, unknown or other
  misc_feature (377)..(377): n is a, c, g, or t
  modified_base (498)..(498): a, c, t, g, unknown or other
  misc_feature (498)..(498): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtcccctcacctgcgctgtctctggtgcctccatcagtagtggtttctctggggctggggtccgnagcctcccgagggaaggggctggaatacattggaagtgtctctcatagtggaggttcctattacagtccgtctctcaagagtcgagtcaccatatctctggacacgtccagcaatctagttttcccngtaagatgtagttctgtgaccgccgtctgacgacgggtcgtttattactgtgcgagagacgctattatgtagttttgagttggttatttcgactcctagagtcggacgggctcggtacccnggggccagggtaacttacgtgtacaccgttctccgttacgcccttacccg

SEQ ID NO: 141925 - DNA, 681 bp, Homo sapiens
  misc_feature: GYAE6OF02IZIRP.46.67.G01.1.454.CMB.1.raw
  modified_base (152)..(152): a, c, t, g, unknown or other
  misc_feature (152)..(152): n is a, c, g, or t
  modified_base (199)..(199): a, c, t, g, unknown or other
  misc_feature (199)..(199): n is a, c, g, or t
  modified_base (305)..(305): a, c, t, g, unknown or other
  misc_feature (305)..(305): n is a, c, g, or t
  modified_base (320)..(320): a, c, t, g, unknown or other
  misc_feature (320)..(320): n is a, c, g, or t
  modified_base (351)..(351): a, c, t, g, unknown or other
  misc_feature (351)..(351): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctnacctgcgctgtctctggtgcctccatcagtaggtcggtttcttccgnggggctggggtccggcagctcccgaggggacggggctggaacttacgattgggaacgttcgtctctcagtagtggaggttcctatacgagtccgtctcgtcaaggngttcgagtcaccatntctctggacacgtcagcaatcacgttttccngtaagatcgagtactcgtacgaccgtccgacttcgacgtacgggtcgtttaacttacgtcgtcgacggtagtacgggtaaccgtacttaagttacttgggtatttttgggaagttgggttaactttaccggaacttacccgttaggtacgttacggtccggggaccttcggaccccgttggggaccccgtaagggggtaacttaccgtcggttaaccgtccggtacgttcccgttaagccctaaccgtaccggaacggtacctcgtacccgttcccggttaccccctgggtaccctacccgttacccgtacccgtaagtacccggtaccc

SEQ ID NO: 141926 - DNA, 707 bp, Homo sapiens
  misc_feature: GYAE6OF02IZQ2S.46.67.G01.1.454.CMB.1.raw
  modified_base (199)..(199): a, c, t, g, unknown or other
  misc_feature (199)..(199): n is a, c, g, or t
tcagactagcagtacacgaccggtgctcgatttagagtatacatatttggggtttgtcctcctgctggtggcagctcccagatgggtcctgtccctgggtgcaactgcaggagtcgggcccacgactggtgaggcctttcggagaccctgtccctcacctgcgctgtctctggtgcctccatcagtagtggtttctcgngggctgggtccgcagctccgagggagggctaggaatacagttggaagtgtctctcagtagtggaggttcctattacagttcccgtctctacgaagacgtaccgagttccgaccattaacttcgtcgtgggaaccaccggtccagtaccaaattcgtaacgttttccccaggaacgtattcgtaagtttcgtgtacggacccgtcgtacgtacgaccgacggggttcgttttacttacgttggtaggtcggtaagacgacggtcttagttagtgttacgttttggagttacggtttaattccggtaactaccgttagtacgtccgggtaacggggtcctccgtacccggtggggacccgtaagggtaccttacgttcgggttacctacccggttacgttccgttacgcccgttaccaaccccggtaacgggccccttaaggttcccggttaccccgtttcccggtacccggtacccttaccccttcccgtacccgtacgcccgtacccg

SEQ ID NO: 141927 - DNA, 733 bp, Homo sapiens
  misc_feature: GYAE6OF02JDZ3K.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtccctcacctgcgctgtctctggtgcctccatcagtagtggtttcttcgtggggctgggtccggcagctcccaggggagggctgggaatacagttggaacgttgtactctcattaggtggtaggttcctattaccaggttccgtctctcgaaggtagtcgagttcaccattatctcgtggacacgtcagcaatcacgttttcccagaagtactggagtttccgtaggtcgacccgcgcttggaccgtaccgggttcgttttaattacgtggtcggaccggtaggtacggtacgggtacttatttagttggttacgtttttaggtaggtttacggttttacgtttaccgtaccgtaacccgttaggtaacgtcgggtaccgggggtccttacccgggtaccccggtcggggtaccgtaacggggtaacgttaccgttcgggtaccgttacccggtccgttacccgttacggtccccttacccgtaacccggtaacgggtccccctaacggttccccggttacccgtttccccccggtacggtaccccgtacccccgttacccgtcccgtaaacggtccgtaaccccg

SEQ ID NO: 141928 - DNA, 559 bp, Homo sapiens
  misc_feature: GYAE6OF02IB5FC.46.67.G01.1.454.CMB.1.raw
  modified_base (254)..(254): a, c, t, g, unknown or other
  misc_feature (254)..(254): n is a, c, g, or t
tcagactagcagtacacgaccggtgctcgatttagagtatacatattgggtttggggagtctcggtcaggacacagcatggacatgagggtccccgctcagctcctgggtctcctgctactctggctccgaggtgccagatgtgacatcgagctgacccagtctccatcctccctgtctgcaaccgtgggagacagtgtcaccatcacttgccgggcaagtcggaacattgacacctattaaattggtatcaanatagaccagggacgcccctaagctctaatctatgctgcatccagtttgactaaaggtgggtacccattcgaggttcagtggcagtgatcgtgggactaggatttcactctccacctatactagtaatctgacaaagtgaagtatttgactaactttattactcgttacaactagtaaatttactaaattcgttttacggaaccgtaaggactaacgaactaaaccgtaaaattaaacgaaactgtacgactcgactacctatctagttctactactccgttccccgacctacttaccgtgtaacg

SEQ ID NO: 141929 - DNA, 735 bp, Homo sapiens
  misc_feature: GYAE6OF02F7GFB.46.67.G01.1.454.CMB.1.raw
  modified_base (198)..(198): a, c, t, g, unknown or other
  misc_feature (198)..(198): n is a, c, g, or t
tcagactagcagtacacgaccggtgctcgatttagagtatacatattgggttgggagtctcggtcaggacacagcatggtacattgaggtcccgctcagctcctgggctcctgctactctggctccggtaggtgccaagtagttcgtgtacatcgtaagctgacccagtctccatcctcctgtctgcaaccgtggganacagtgtcacctagtcacttcggccgggacaagtccggaactagttgacaccgttatttaaacgttggttactcaaactagttagacctagggaccgaccctaagcctacctaagtcgactagctgactaagtcctagtttgacgtaaggtgggtcctaagttcgagttcagtggctaggtgatcgtagggacaggtattcgactccgtacgaaccgtctacgtaagtaacttcgttacgaccgtaacggtagtaaacgttactttacgtaacgtaaacttaacgttaacgttagtacgtaaacgtaaacgtaacttaaacgttaacgttacggttttaacggacccgttaaacgggtaaaccgtaaacgtaaaccgttaaacgttaaaacgttaaaaccgtaaccgtttaaggtacgggtaccggtaacggtaacccgtaaccgttaacggttaaccgtttaccggttaaccgtttaccgttacccgtttacccggtttaccccgtaccggtaccgttaccgtaccggttaacccg

SEQ ID NO: 141930 - DNA, 625 bp, Homo sapiens
  misc_feature: GYAE6OF02H5TJ5.46.67.G01.1.454.CMB.1.raw
  modified_base (217)..(217): a, c, t, g, unknown or other
  misc_feature (217)..(217): n is a, c, g, or t
  modified_base (284)..(284): a, c, t, g, unknown or other
  misc_feature (284)..(284): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacactatttaaattggtatcaacatagaccaggacgcccaagctctaatctangctgcatcctagtttgacaaaggtgggtcccatcgagttcagtgcagtgatcgtgggacagtattctactctacacatctagtaatctgactaaacgtagtaagttatttcgacctaaatttattacgtacgttacaaacgaagtaaatttaacaagtttcggttttaccgaacccggaaacgggtaactaaccgaaacttaaactaaaaaacgttaaaaccgaaacgttagtacggtactaccggtaacctaaccctaacgtttccgttacgtttacctttaacccgtactttaccccgtttacccccggaaccttacgtttaccgttaacgttaaaccg

SEQ ID NO: 141931 - DNA, 727 bp, Homo sapiens
  misc_feature: GYAE6OF02JFORB.46.67.G01.1.454.CMB.1.raw
  modified_base (256)..(256): a, c, t, g, unknown or other
  misc_feature (256)..(256): n is a, c, g, or t
tcagactagcagtacacgaccggtgctcgatttagagtatacatattgggtttggggagtctcggtcaggacacagcatggacatgagggtccccgctcagctcctggggctcctgctactctgctccgaggtgccagatgtgacatcgagctgacccagtctccatcctccctgtctgcaaccggtggagacagtcgtcaccatcacttggccggcaagtcggaacattcgacacctatttaagtggtatacaanatagaccgagggaccgaccctaagcctacctaatctatgctgcactccgtagtttcgaacgtaacggttcgggtaccctagtcggtaggtttccgaaggtcggtacgtaggttacgggtacgttacggtacgggtaacgtaacgtacgtttaccgtaacgttcctaaccgtaaacccgtacttacccggttaaaggttaaactaccgttacggttaaacgtaaaccgggtttaaggggtaaaactttacgttttacgaaccgtttaaaacgttttaactttaacgtacgttaaacgtaaacctaagttaaacgtttaacgtaaacgtttggtttacccggaacgtaaacggtacctaaccgtaaactaagttaaaaaccgtacgtaacgttggtaacgcttacggaaccctaacggtaactcgttacgtaccttaccgtacttacccgttcccgacttacgttctactacg

SEQ ID NO: 141932 - DNA, 863 bp, Homo sapiens
  misc_feature: GYAE6OF02JU5YF.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgatgccttcggagaccctgtccctcacctgcgctgtctctggtgcctccatcagtagtggtttcttcgtggggctggggtccggtcagcctccgagggagggctggaatacagtggaagtgtactctacgtatagtggacgtcctatacgtagtccgtctactacgtaagacgtcgacgtacacctatatctacgacggtacacgtaccagactaacgttcctacgttttacccagtaagtacgtagtacgttcgtagttacggaccgtccgtcgtacggtacggtacggggttacttttaactacggttcgtacgggacgagggtaacggtacggtaccggttactttaacggttgggtttaacgtttacgggggtaacgttttacgggggtttaatttacccgggttaaacccgttaccggtttaaacggttacggtttaacccgggggtacgggggtttaccctaaccccggggtaccccgggttaccggggggtaacccggtaaaggggtaaaccgtttacccggggttaaccggtaacccggttaacccggttaccggttttaaccccgtaccggttacccgttaccccggtaaacccggggttaaacccgggtccccgttaaacccgggttaccccggtttacccccggtttaaccccccgggtccggtttaacccccgtaacccccccggtttacccgttaaccccccggtaaaccggttaaccccggg

SEQ ID NO: 141933 - DNA, 593 bp, Homo sapiens
  misc_feature: GYAE6OF02GMWZJ.46.67.G01.1.454.CMB.1.raw
  modified_base (192)..(192): a, c, t, g, unknown or other
  misc_feature (192)..(192): n is a, c, g, or t
  modified_base (217)..(217): a, c, t, g, unknown or other
  misc_feature (217)..(217): n is a, c, g, or t
  modified_base (348)..(348): a, c, t, g, unknown or other
  misc_feature (348)..(348): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggnaagtcgaacattgacacctatttaatgtatcaacatagaccagggaccggcccctaagctcctaatctatgctgcatccagtttgacaaaggtcgggtcccagtcgaggttcagtggcagtgatcgtgganagtattcactctacactatcagtatctagacaacgtgaagttatttgacctaacttattactagtactaactaagtaactttaactaagtttcggttttaccggaccgtaagggacctaacgtaacttaaactaaaacttaaaccgaacgttacggtacggtactacggacctaacctaacttccgttacgttacctttacctaacgtttcccgtttaccccgacttacgttaccgtagttaccg

SEQ ID NO: 141934 - DNA, 695 bp, Homo sapiens
  misc_feature: GYAE6OF02JWUH2.46.67.G01.1.454.CMB.1.raw
  modified_base (254)..(255): a, c, t, g, unknown or other
  misc_feature (254)..(255): n is a, c, g, or t
  modified_base (445)..(445): a, c, t, g, unknown or other
  misc_feature (445)..(445): n is a, c, g, or t
  modified_base (479)..(479): a, c, t, g, unknown or other
  misc_feature (479)..(479): n is a, c, g, or t
  modified_base (498)..(498): a, c, t, g, unknown or other
  misc_feature (498)..(498): n is a, c, g, or t
tcagactagcagtacacgaccggtgctcgatttagagtatacatattggtttggggacctcctgtgcaagaacatgaagcacctgtggtttgtcctcctgctggtggcagctcccagatgggtcctgtcctggtgcaactgcaggagtcgggcccacgactggtgaggcctttcggacgaccctggtccctcacctgcgctgtctcgtggtcgcctccatcagttagtggtttctcgtggggcttggggtccgnngctccgagggaggctaggaatacgagttggaagtgtctctcgaataggtgggtacggttccttagttaccgacggttccgtcttccgtacgtaaaggtcggttcggtacgttacaacctaagttactccttcggtaggtaccacggtacccgtaggaccaagttccgttaacgttttcccaaggaacgtntacggttacgtttctaggtaccgaccgtcccgtntacggaccgtaccgggttnttttactacgttcgggtgtacggtacgacggtacgtcttattagtagtttacgttttggacgttaggttttacttacggacttaccgtaggttacgcgggtaccgggtctacccggcccgggttcgggacgaacgggtaactttccggtacgggttacctcccggtttactcccggttaccggccccttaacccggg

SEQ ID NO: 141935 - DNA, 722 bp, Homo sapiens
  misc_feature: GYAE6OF02J2JSY.46.67.G01.1.454.CMB.1.raw
  modified_base (286)..(286): a, c, t, g, unknown or other
  misc_feature (286)..(286): n is a, c, g, or t
tcagactagcagtacacgaccggtgctcgatttagagtatacatattgggtttgtcctcctgctggtgacagctcccagatgggtcctgtccctggtgcaactgcaggagtcggcccacgactggtgaggccttcggagaccctgtccctcacctgcgctgtctctggtcgcctccatcagtagttggttctcgtgggctgggtccggcagctcccgagggaaggggctaggatacagttggaagtgtctctcatagtgaggttcctatacagtccgtctctcagntcgagtcacatatctgtggactacgccagcaatctacgttttccccgagaacgtatcgtagtttcgtagtcggtacccgccgtcgtacggtaccgacggggttacttttaagttaccgtgttggccgggtaagtacggtacggtacttaagttagttacgttagtttttacgggtaagtttggtttacgtttacgtaccgtaacccgttaggtacgtacgggtaccgggggtacctacccggtacccgggtcggggacccggtaacgggtaacgttaccggttacggtaccggtaacccggttccgttacccggttaccgtcccgtacccgtaaccggaacccggggttacccaccggttacccggttcccgtttcccccggttacggtacccccgtaccccttaccccggtacccgtaccggaccgttcccccgg

SEQ ID NO: 141936 - DNA, 652 bp, Homo sapiens
  misc_feature: GYAE6OF02J1TP4.46.67.G01.1.454.CMB.1.raw
  modified_base (340)..(340): a, c, t, g, unknown or other
  misc_feature (340)..(340): n is a, c, g, or t
  modified_base (360)..(360): a, c, t, g, unknown or other
  misc_feature (360)..(360): n is a, c, g, or t
  modified_base (377)..(377): a, c, t, g, unknown or other
  misc_feature (377)..(377): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgagggaagggctggaatacagttggaagtgtctcgtcagtagtggaggttcctagttacagtccgtctctcaagagtcgagtcacatatctctggacacgtccagctaatctagttttcccngtaacgatcgtagttctgtnaccgccgcgttcgaacnccgggtcgtttaattacgtggtgacgagacggtacggcttagttatgtagttttggtagtttggtttatttacgaaccaccttagatacgggcgggtacctccggacccgtggggaccgtagggtacgttaacgtcggtaccgtaccgtcgttacccttacgtccctacccggtaacccgaaccgggggtccccaacggtttcccgggttaccccgtttcccccggacggttcccccaaccccgttcccgtaccctaacggtcccgtaaccccgg

SEQ ID NO: 141937 - DNA, 621 bp, Homo sapiens
  misc_feature: GYAE6OF02FX2W1.46.67.G01.1.454.CMB.1.raw
  modified_base (171)..(171): a, c, t, g, unknown or other
  misc_feature (171)..(171): n is a, c, g, or t
  modified_base (296)..(296): a, c, t, g, unknown or other
  misc_feature (296)..(296): n is a, c, g, or t
  modified_base (349)..(349): a, c, t, g, unknown or other
  misc_feature (349)..(349): n is a, c, g, or t
  modified_base (425)..(425): a, c, t, g, unknown or other
  misc_feature (425)..(425): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttcttcgtggggctgggtccggcagcctcccgaggggaagggctggaatacagttggaagtgtcctcgtcagtagtggtaggttcctattacagtccgtctctcaagngtcgagtcaccatactctctggacacgtccagcaatctacgttttcccagaanagtgtagttctgtcgaccgccgctacggacgacgggtcgttttaacgttacgttgtcggcgtaggaacggacggtnttaagtttagttgttagtttttaggaggtttggtttactttccgactacctagagtcgggtaccgggctccggacccgtgggaccagggtactacgtcgtcgaccgttctaccgttcgccctccgaccgacgggaccctacggtcccggttccttccccgtcgtccctacccgtcctacccgtacgtacgtacccg

SEQ ID NO: 141938 - DNA, 628 bp, Homo sapiens
  misc_feature: GYAE6OF02FTTK3.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcgaacattgacactatttaaatggtatcaacatagaccgagggaccgcccctaagctctaatctatgctgctatccagtttgactaaaggtggggtaccctagtccggtaggttcgagtcggacagtggatcgtagggactagtactttcactctcaccatacaagttaatcgtagacctaaggtgtaagtattttacgacttaaacttattacgtagtacaaatacgtaaacttacgtaagtttcgtttacggaaccgtaagggtaccgtaaacgtaaccttaaaacgtaaaaccgttaaacgtaaaccgttgtacgggtactaccggacgtaacccgttagtacccgttagttaccctttacgtactttcccgttaccccgtacctactttaccgtagttaaccg

SEQ ID NO: 141939 - DNA, 570 bp, Homo sapiens
  misc_feature: GYAE6OF02I4SA9.46.67.G01.1.454.CMB.1.raw
  modified_base (291)..(291): a, c, t, g, unknown or other
  misc_feature (291)..(291): n is a, c, g, or t
  modified_base (403)..(403): a, c, t, g, unknown or other
  misc_feature (403)..(403): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtcccggcagcctcccgagggaggggctggaatacagttggaagtgtctctcatagtggagttcctattacagtccgtctctcaagngtcgagtcaccatactctctggacacgtccagcaatctacgttttccagaagagtcgtagttcgtgtcgaccgcgctagacgacgggtctttatacgtgtgcgagagacgtntatagtgttagtttggtagttgttattacgtactacgtagtgtcgacgggtcgtcgtccgtcgggcgaggatacgtgtccgtacgtctcgtacgtcctaccgaccgaacggcctacgtccggttccttccccgtcggacctacccgtaccctaccgacgtcgtaccg

SEQ ID NO: 141940 - DNA, 591 bp, Homo sapiens
  misc_feature: GYAE6OF02F86XU.46.67.G01.1.454.CMB.1.raw
  modified_base (334)..(334): a, c, t, g, unknown or other
  misc_feature (334)..(334): n is a, c, g, or t
  modified_base (338)..(338): a, c, t, g, unknown or other
  misc_feature (338)..(338): n is a, c, g, or t
  modified_base (348)..(348): a, c, t, g, unknown or other
  misc_feature (348)..(348): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttcccngaanactgagttcngtcgaccgcgctgacacgggctttatacgtgtgcgagagacggctattatgtatttttggagttggttatttcgactacctagatcggacggggtcctcggaccccgtggggcccaggggaactacgtcggtcacccgtcttcccgttagccctaccgaccgtaacgggcccctaagttcccggttcctttccccccgtgggtcccctacccccgttccctacccgaacggtaccgtaccccg

SEQ ID NO: 141941 - DNA, 767 bp, Homo sapiens
  misc_feature: GYAE6OF02F6FRD.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctccgagggaggggctggaatacattggaagtgtctctcatagtggaggttcctattacagtcgtctctcagagtcgagtcaccatatctctgacacgtccagcaatctacgttttccctaggaacgtagtgtagttctggtaccggacccggtccgactcggaaccgtaccggggttacgtttttaacttaccgttgggtacggtacggaggtaacggtaccgggtactttaaagtttacgttggtttaagttttttaggggtaaggttttacggggttttaagttttccggaacccgtaaccccggttaagtaacggttaccgggtaaccggggggtcccgttaccccgggtaccccgggttacggggggacccgtaacgggggtaaacgttaccgttgggttacccgtaacccggtttccgttaccccgtttacgacccgttacccgaaccggtaaacccggggtcccctaaccggttcccggttaccccgtttcccccggttacggtcccctacccccgttccccgtacccgaaccggtaccgtaccccg

SEQ ID NO: 141942 - DNA, 719 bp, Homo sapiens
  misc_feature: GYAE6OF02I1WFW.46.67.G01.1.454.CMB.1.raw
  modified_base (151)..(151): a, c, t, g, unknown or other
  misc_feature (151)..(151): n is a, c, g, or t
  modified_base (171)..(171): a, c, t, g, unknown or other
  misc_feature (171)..(171): n is a, c, g, or t
  modified_base (191)..(191): a, c, t, g, unknown or other
  misc_feature (191)..(191): n is a, c, g, or t
tcagactagcagtacacgaccggtgctcgatttagagtatacatattgggtttgtcctcctgctggtggcagctcccagatgggtcctgtccctggtgcaactgcaggagtcgggcccagactggtgaggccttcggagaccctgtccctnacctgcgctgtctctggtcncctcatcagtagtgttctgngggctgggtccgcagcctccgagggaacgggctaggaactacgagttaggaagtgtctgtcagtcggtggacggttctattacgcgtcgtctctacaagagtcgagtcaacctatactctcgtaggactaccgtacacgtacaagtctaacgttttcccaggaactagtacgtacgttcgtcggttacgtacccggtaccgcgttaccggaacgtaccgggtttacgtttagttaccgtaggtccgaggtaacgacggtacggtacttaagttagttagttacgttttagggtagtttacggtttaacttacggttacccttaacccggtagtaacggttaccggggtacggggttcccgtaaccccggtccgggtaccgggaccggtaaacgggttaacgtaccgttcgggtaccgtaccgttccgttaccgttacgtcccgtaacggacccggtaaccggcccgttaacgtccggttccccgttacccgccggtacccacccgtcccgtaacgacgtaccgtcccg

SEQ ID NO: 141943 - DNA, 601 bp, Homo sapiens
  misc_feature: GYAE6OF02F18WD.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgaggggaagggctggaatacagttggaagtgtctctcagtagtggaggttcctattacagtccgtctctcaagagtcgagtcaccatatctctggacacgtcagcaatcagttttcccagaacgtatgagttctgtcgaccgccgctcgacgacgggtctttaatactgtgcgagagacggctattatgtattttggagttgttatttcgactaccctagtacgtcggacggggtactccgacccgtggggaccgaagggaactacgtcggtactaccggtctaccgttacgcctaccgaccgtaacgggcccctaacgtcccggttaccctttcccccgtacggtaccctacccctcccgtacctaacggtaccgtaacccg

SEQ ID NO: 141944 - DNA, 736 bp, Homo sapiens
  misc_feature: GYAE6OF02HS710.46.67.G01.1.454.CMB.1.raw
  modified_base (220)..(220): a, c, t, g, unknown or other
  misc_feature (220)..(220): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgacaccggtggacgacagtcgcaccatcacttcggccgganaaggtcggaactgttagacctacttatttaaattcggtatacaactatacgaaccgagggaccgaccctaagctacctaatctatagcttgcctagtcctagtttacgacgtaaagggtcggtacccagttacggacggtttacgaacggtggaccgtaggttacgggtacgttcggtacgggtaacgtacggtttaactttccgaacccgttcttaaccgaaccttacgtccgttaaagttaactccgttacgaacgtaaacggtggttaaacttacgttttacgtaaacttaacgtttaacttactacgttaacctaaaggtacttaaagtttaacgtaaacgttttcggtttaaccgggaacgtaaacgggtacctaaaccgtaacgttaaaccttaaacgttaaacgaaacggtttcgtacgggtacctcgtaaccgtaccttaacttccgttacgttaccctttacaaccggtttcccctaacccgtacccgttattaccgtagtaacccg

SEQ ID NO: 141945 - DNA, 776 bp, Homo sapiens
  misc_feature: GYAE6OF02IFMIV.46.67.G01.1.454.CMB.1.raw
  modified_base (214)..(214): a, c, t, g, unknown or other
  misc_feature (214)..(214): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggcctttcggagacccttgtccctcacctgcgctgtctctggtcncctccatcagttagtggtttctgtggggctgggtccgcacgcgtccgaggggaacggggctaggaatacgtgttggaagtgtctctcattaggtggtagtttccttattacacgtccgtctctcgaagagtcgagtccacctatactctcgtggaccacgtcagactaaacttcgtacgttttcccagtaacgtagttcggtaacgtttccgttggtaccggtaacccccggtccggtaccgttacggtaacccggttaaccgggggtttaccgttttttaacgtttaaccgttgggttacgggaaccgggttaggaaccgggtaccgggttactttaaggtttaagttcggtttaagttttttcggggaaagttttgggttttaacgttttcccgaaaccgttacccgttaaggtacgttacccgggggtacgggggttccctacccgggtaaccccgggtcggggggtaccctaaagggggttaacctttaccggttaccgggttacccggttaacccgtttccccttacccgggtttaccccgttcccctaaccccggg

SEQ ID NO: 141946 - DNA, 561 bp, Homo sapiens
  misc_feature: GYAE6OF02IDEI5.46.67.G01.1.454.CMB.1.raw
  modified_base (216)..(216): a, c, t, g, unknown or other
  misc_feature (216)..(216): n is a, c, g, or t
  modified_base (236)..(236): a, c, t, g, unknown or other
  misc_feature (236)..(236): n is a, c, g, or t
  modified_base (248)..(248): a, c, t, g, unknown or other
  misc_feature (248)..(248): n is a, c, g, or t
  modified_base (292)..(292): a, c, t, g, unknown or other
  misc_feature (292)..(292): n is a, c, g, or t
  modified_base (379)..(379): a, c, t, g, unknown or other
  misc_feature (379)..(379): n is a, c, g, or t
  modified_base (387)..(387): a, c, t, g, unknown or other
  misc_feature (387)..(387): n is a, c, g, or t
  modified_base (400)..(400): a, c, t, g, unknown or other
  misc_feature (400)..(400): n is a, c, g, or t
  modified_base (419)..(419): a, c, t, g, unknown or other
  misc_feature (419)..(419): n is a, c, g, or t
  modified_base (426)..(426): a, c, t, g, unknown or other
  misc_feature (426)..(426): n is a, c, g, or t
  modified_base (458)..(458): a, c, t, g, unknown or other
  misc_feature (458)..(458): n is a, c, g, or t
  modified_base (489)..(489): a, c, t, g, unknown or other
  misc_feature (489)..(489): n is a, c, g, or t
  modified_base (500)..(500): a, c, t, g, unknown or other
  misc_feature (500)..(500): n is a, c, g, or t
  modified_base (510)..(510): a, c, t, g, unknown or other
  misc_feature (510)..(510): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcgggagaccctggtccctcacctgccgctggtctcgtggtncctcatcagtgtgttctcgngggctgggccgnagctccgagggaggctggaatacagttaggatgctctcagtagnggtacgttcctattacagtccgtctctacaagagtcgagtacaccatatctcgtagacacggtccagactaattcctaagtttcccngtaaagtngtatctgcacgcntgcgtagggctttaattcngtcgtanacgtagacgtataattatcgtttagtttaggngtttaacgtttagttcgaactaccaggtacncgggaccgggntccgacccgngggtaccgaaaggtctaggtcgtaccaggtttccacgggttcaccctaccg

SEQ ID NO: 141947 - DNA, 665 bp, Homo sapiens
  misc_feature: GYAE6OF02FFXML.46.67.G01.1.454.CMB.1.raw
  modified_base (173)..(173): a, c, t, g, unknown or other
  misc_feature (173)..(173): n is a, c, g, or t
  modified_base (197)..(197): a, c, t, g, unknown or other
  misc_feature (197)..(197): n is a, c, g, or t
  modified_base (210)..(210): a, c, t, g, unknown or other
  misc_feature (210)..(210): n is a, c, g, or t
  modified_base (287)..(287): a, c, t, g, unknown or other
  misc_feature (287)..(287): n is a, c, g, or t
  modified_base (388)..(388): a, c, t, g, unknown or other
  misc_feature (388)..(388): n is a, c, g, or t
  modified_base (427)..(427): a, c, t, g, unknown or other
  misc_feature (427)..(427): n is a, c, g, or t
tcagactagcagtacacgaccggtgctcgatttagagtatacatattgggttgtcctcctgctggtggcagctcccagatgggtcctgtccctggtgcaactgcaggacgtcggcccagactggtgacggtcctggacgtccctgtccctcacctgcgtctgtctcgtggtcncctcatcagtgttcggttcttggngggctgggtccgntacgcctccggaggggacggctaggtaactcgtagtggtactcgtcctctagtagtaggtggacgttctattaccgngtccgtctcgtacaagtcgtcgatccgtaactatctcctggtcgaactaccgtacgcgtactaacttcgttacgtttaccagtaacgtatcggtactccgngtaccgcccggtcacggtacgaccgtcgggttactttanacggtgacgcgtaaggtcgacgtacttagttgttaggttagttcggtagttcgttaccgtaccgtaactaccggtagaccggcgggtccgggtaccgtaccggtaccggtcgggtaacgtaggtacgtacgtcgtaccctctaccgtcctaccgcctaccgaccggtaaccgtcctaccgggttccccgtcccgttcccggtacgaccctacccgactacggtacgtaccgtacccgg

SEQ ID NO: 141948 - DNA, 579 bp, Homo sapiens
  misc_feature: GYAE6OF02HP1PE.46.67.G01.1.454.CMB.1.raw
  modified_base (191)..(191): a, c, t, g, unknown or other
  misc_feature (191)..(191): n is a, c, g, or t
  modified_base (294)..(294): a, c, t, g, unknown or other
  misc_feature (294)..(294): n is a, c, g, or t
  modified_base (342)..(342): a, c, t, g, unknown or other
  misc_feature (342)..(342): n is a, c, g, or t
  modified_base (353)..(353): a, c, t, g, unknown or other
  misc_feature (353)..(353): n is a, c, g, or t
  modified_base (393)..(393): a, c, t, g, unknown or other
  misc_feature (393)..(393): n is a, c, g, or t
  modified_base (401)..(401): a, c, t, g, unknown or other
  misc_feature (401)..(401): n is a, c, g, or t
tcagactagcagtacacgaccggtgctcgatttagagtatacatattgggtttggggagtctcggtcaggacacagcatggacatgagggtcccgctcagctcctggggctcctgctactctggctccgaggtgccagatgtgcatcgagctgaccccagtctccatcctccctgtctgcaaccgtggganacagtgtccaccatcacttggaccgggcaaagtcggaaacagttgacctactatttaaagtgtatcaacatagaccagggaccgccctaagctcctaatctangctagcatcagtttgacaaggtgggacccagtcgagttcagtgcaggngatctgggacngtattcgactctcacagtacagtatctgtactaaacggtnaaacgttnttttagacttaacttagtacgttagtactaaacgaagtaacttaactacgttttacgtttacgggaccaaaggggacctaacgaacgttaacttaaaaacgtaaacgacgttaggtactacgtgttacccactacgttcttacgttctactcttactcccgttacacttagtctaacg

SEQ ID NO: 141949 - DNA, 587 bp, Homo sapiens
  misc_feature: GYAE6OF02F93QZ.46.67.G01.1.454.CMB.1.raw
  modified_base (341)..(341): a, c, t, g, unknown or other
  misc_feature (341)..(341): n is a, c, g, or t
  modified_base (395)..(395): a, c, t, g, unknown or other
  misc_feature (395)..(395): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgagggaagggctggaatacattggaagtgtctctcatagtggaggttcctattacagtccgtctctcaagagtcgagtcaccatatctcgtggacacgtcagcaatctacgttttcccagaagntgtagttctgtcgaccgcgctgacgacgggtctttagtacgtgtgcgagagcgntattatgtagttttggagttggttatttcgactaccgtagagtcggacgggtctccgacccggtggggaccgagggtaactacgtcgtacctaccgttctaccgttacgccctaccgaccgtaacgggtccctacgtcccggttcccttccccgtcggtccctaccccgttcccgtacccgaagcctacccg

SEQ ID NO: 141950 - DNA, 121 bp, Homo sapiens
  misc_feature: GYAE6OF02ICJXV.46.67.G01.1.454.CMB.1.raw
  modified_base (97)..(97): a, c, t, g, unknown or other
  misc_feature (97)..(97): n is a, c, g, or t
  modified_base (111)..(121): a, c, t, g, unknown or other
  misc_feature (111)..(121): n is a, c, g, or t
tcagactagcagtacacgaccggtgctcgatttagagtatacatattgggtttggggagtctcggtcaggacacagcatggacatgagggtccccgntcagctcctgggcnnnnnnnnnnn

SEQ ID NO: 141951 - DNA, 738 bp, Homo sapiens
  misc_feature: GYAE6OF02FF3G6.46.67.G01.1.454.CMB.1.raw
  modified_base (193)..(193): a, c, t, g, unknown or other
  misc_feature (193)..(193): n is a, c, g, or t
  modified_base (255)..(255): a, c, t, g, unknown or other
  misc_feature (255)..(255): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatcctccctgtctgcaaccgtggganacagtgtcaccatcacttgccgggcaagtcgaacattgacaccttatttaaatgtatcaacntagaccagggaccgcccctaagctcctaatctatgctgcatcctagtttgacgaaaggtcggggtacccagtccggtaggttcaggttggcaggtggatcgtaggggactagtactttccgacttcctacgaccctaatcctaagttaactcctaggtaccgtaacggttaggtaaagttactttttacggaaccttaaaccgttttaactttaaccgttacgtaacctaaaaccgtaacgttaaaacttttaaccgtaaacggttttacggttttttaccccggggaaccgtaaacggggtaaaccctaaaccggttaaaaccgttaaaaccgttaaaaaacgtttaaaaccgtaacggtttaacgggtacgggtaccgtacggtacccgtaaacccttacgttacctttacggtttaccctttaccgttacctttccccgtttacccccggtacccttacgttacccgttacgttaacccg

SEQ ID NO: 141952 - DNA, 629 bp, Homo sapiens
  misc_feature: GYAE6OF02IGZQM.46.67.G01.1.454.CMB.1.raw
  modified_base (212)..(212): a, c, t, g, unknown or other
  misc_feature (212)..(212): n is a, c, g, or t
  modified_base (419)..(419): a, c, t, g, unknown or other
  misc_feature (419)..(419): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtcncctcatcagtagtgtttctcgtgggctgggtccgcagcctccgagggagggctaggaatactagttaggaagtgtctctcagttaggtggtacggttacctagttacacgttccgtctctacaagtacgtcgtacgtcactatactctctaggtaccaccgtaccagactaacgttctacgttttcccagtaagtatgtagtttcgngtaccgaccgtccgtactcgaccgtacgggtcttttagtacgtggtcgacgtaggacgtaccggtattactagttgtttagttttggtagtttggtttattccgaacctacccgtagtacgtaccgggacgggtcctacccggtacccggtcgggaccgtagggtaacttacggtcggtacctaccggttctaccgttcgccctacccgg

SEQ ID NO: 141953 - DNA, 561 bp, Homo sapiens
  misc_feature: GYAE6OF02HHLXN.46.67.G01.1.454.CMB.1.raw
  modified_base (289)..(289): a, c, t, g, unknown or other
  misc_feature (289)..(289): n is a, c, g, or t
  modified_base (336)..(336): a, c, t, g, unknown or other
  misc_feature (336)..(336): n is a, c, g, or t
  modified_base (537)..(537): a, c, t, g, unknown or other
  misc_feature (537)..(537): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgagggaagggctggaatacattggaagtgtctctcatagtggaggttcctattacagtccgtctctcaagngtcgagtcaccatatctctggacacgtccagcaatctagttttcccngaagatgtagttctgtcgaccgccgctgacacgggtctttattactgtcgcgagagacggctattagtagtagtttttggagttggtttattcgactaccctagagtcggacgggctcgacccgtgggccagggactacgtcggtcaccgtctccgtacgcctccgaccgacggcctagtccgtccttccccgtcggtccnccctcctaccgtacgacgtacccg

SEQ ID NO: 141954 - DNA, 567 bp, Homo sapiens
  misc_feature: GYAE6OF02HLJJE.46.67.G01.1.454.CMB.1.raw
  modified_base (255)..(255): a, c, t, g, unknown or other
  misc_feature (255)..(255): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacaccttatttaaattgtatcaanatagaccagggacgcccctaagctacctaatctatgctgcatcctagtttgacgtaaggtcgggtaccagtcgtaggttcaggtggacgagtgatcgtgggacagtattcactctcactatcagtaatcctagacgtaagtggaattacttttgaactaactttattacgtagtacaacgtataacttataacgttggtttacgacgtaaacgggactaacgtaacttaaactaaaacgttaacgaacgttgtacggctacgaccactagtcgttatccttatacgtcccttaccgacttacgtcgtatacg

SEQ ID NO: 141955 - DNA, 622 bp, Homo sapiens
  misc_feature: GYAE6OF02FFW8J.46.67.G01.1.454.CMB.1.raw
  modified_base (172)..(172): a, c, t, g, unknown or other
  misc_feature (172)..(172): n is a, c, g, or t
  modified_base (413)..(413): a, c, t, g, unknown or other
  misc_feature (413)..(413): n is a, c, g, or t
  modified_base (437)..(437): a, c, t, g, unknown or other
  misc_feature (437)..(437): n is a, c, g, or t
tcagactagcagtacacgaccggtgctcgatttagagtatacatattgggtttgtcctcctgctggtggcagctcccagatgggtcctgtccctggtgcaactgcaggagtcggcccacgactggtgaggcccttcggagaccctgtccctcacctgcgctgtctctggtcncctccatcagtagtggtttcttcgtggggctgggtccgcagcctcccgaggggagggctaggaactacgattggaagttgtccttctcagttaggtggacggttcctagttaccacgtcccgttctccttacgaaggtacgtccgtagtaccacccattactcctcgtggacacggtccagacaattcctacgttttcccagaacgtatgtagttctgtcgacccgcgctcgacgtcggtnttttactcgtgcgcgagagacgtnttatagtgttagttttggagttgttacttcgacaccgtagcggtacgggccgggtcctacccggacccggtgggaccgaaggtaactacgttcgccctaccgtctacctacgccctaccgaccgtaacggccctacggtcccgtcccttcccgcgccctaccccgtccaccgacgtccgtacccg

SEQ ID NO: 141956 - DNA, 607 bp, Homo sapiens
  misc_feature: GYAE6OF02G5VLU.46.67.G01.1.454.CMB.1.raw
  modified_base (210)..(210): a, c, t, g, unknown or other
  misc_feature (210)..(210): n is a, c, g, or t
  modified_base (347)..(347): a, c, t, g, unknown or other
  misc_feature (347)..(347): n is a, c, g, or t
  modified_base (409)..(409): a, c, t, g, unknown or other
  misc_feature (409)..(409): n is a, c, g, or t
  modified_base (428)..(428): a, c, t, g, unknown or other
  misc_feature (428)..(428): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccgnagctccgagggagggctaggaatacagttggaagtgtctctacattagtggagttctattacagtccgtctctagagtagtcgacgtcactatatctcgtgaccacgtcagacactctacgttttcccagtaacgtntaggtagttccgtgtaccgaccgtccgtctacggacgtacgggttctttaacgtacgttggngtcgagtacggtaccggtnttaagtagttgttagtttggtagtttcggtttattccgaactaccgtagtaccgtcgggtcgggcctccggacccggtgggcgtaaggtactcgtcgtacctacgttcctaccgtacgtcctaccgaccgacggacctacgtccgtccttcccgcgccctccctcgtaccgagctaccg

SEQ ID NO: 141957 - DNA, 609 bp, Homo sapiens
  misc_feature: GYAE6OF02FO612.46.67.G01.1.454.CMB.1.raw
  modified_base (305)..(305): a, c, t, g, unknown or other
  misc_feature (305)..(305): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccgcagctccagggaagggctggaatacagttggaagtgtctctcatagtggaggttcctattacagtccgtctctcaagagtcgagtcaccatatctcngacacgtccagcaatctagttttcccagaagatgtagttctgtgaccgccgctgacgacgggtcttttatactgtgcgagagacggtctattatgtagttttggagttggttactttcgactacccgttagtactcgggacggggtcctaccggacccggtggggcccgtaagggtaacgtacgttcggtaccgtaccgttcgtcccgttacgccctacccgtaaccgaacgggccctacggttcccggttacccttcccccgtcggccctacccccgttccctacccgtaaggaccgtacccg

SEQ ID NO: 141958 - DNA, 733 bp, Homo sapiens
  misc_feature: GYAE6OF02GOK82.46.67.G01.1.454.CMB.1.raw
tcagactagcagtacacgaccggtgctcgatttagagtatacatattggggtttggggagtctcggtcaggacacagcatggacatgacgggtccccgctcagctcctgggggctcctgctactctggctccggaggtgccagatgtgacatcgagctcgacccagtcctccactcctccctgtctgccaaccggtgggacacgagtcgtccaccatcctacgttcgggcccgggactaaacggtaccggaactagttacgaacctaaccttaaattttaaaagttggtaactacaaactagtaacgaccgacggggaccgacccctaagcctacctaatctatcgtctcgacactccgtagttcgaacgtaacgggtcgggtaccagtcggtaggtctaggtcggtacgaggtcggtgtcggtagggactacggttactttaccaccgttactaccgacctaactaccgtaagttactccggtacgtaacggtaacggttaagtaacgtttagttttacgtaaacctttaacgtttacgtttaaccttacgttaaacctaaagttaaacgttaactttaacgtttaacgtttacgggtttaccggaaccggtaaacggtaacctaacgtaaacttaaacgtaaaacgttaaacgtagtcgtacgtactacgacctaacgtcttaccttacgttcttactaccgttcccgtaccctactcttacgtattaccg

SEQ ID NO: 141959 - DNA, 618 bp, Homo sapiens
  misc_feature: GYAE6OF02FZE2X.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacaccttatttaaattggtatcaacatagaccagggaccgcccctaagctacctaatctatgctgcatccagtttgacaagtcgggtccagtcgaggttcagtggcaggtgatcgtgggacagtattcactctcactatcaagtatcgtgacgtaacgtagtaagttattttagaccttaactttattacgttagtacaaacgtaagtaaactttaactaacgtttcggttttaccggaccggtaaacgggacctaaacgtaaccttaaactaaaacgttaaaacgtaaccgttaggtacgtacgtcgtaaccgtaacctacgttccgttagttcctttaccgtacctttcccgtttacccgtaccttacgttaccttagttaaccg

SEQ ID NO: 141960 - DNA, 552 bp, Homo sapiens
  misc_feature: GYAE6OF02G5QDM.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctccgagggaagggctggaatacattggaagtgtctctcatagtggaggttcctattacagtccgtctctcaagagtcgagtcaccatatctctggacacgtccagcaatcagttttcccctgaagatgagttctgtgaccgcgctgacacgggcgtttatactgtgcgagagacggctatatgtattttggagttggttattcgactaccctagagtcggacggggtcctcgaccccgtggggccgagggtaactacgtcggtcaccgtctccttagcctccaccgaacgggcccagtccggtcttccccgtggcctaccctcctccgacgcgtacccg

SEQ ID NO: 141961 - DNA, 677 bp, Homo sapiens
  misc_feature: GYAE6OF02FWVMN.46.67.G01.1.454.CMB.1.raw
  modified_base (333)..(333): a, c, t, g, unknown or other
  misc_feature (333)..(333): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtcccctcacctgcgctgtctctggtgcctccatcagtagttggttttctcgtggggctgggtccggcagcctcccgagggaaggggctggaatacattggaagtgtctctcatagtggaggttcctattacagtccgtctctcaagngtcgagtaccatatactctgtacgacgtaccacgactaactactacgtttaccgtttccgaagtagtagtacgttcgttacgtggtaccgcccgtcccgtgtaccggtaccgggttacggtttactttacgtcggttggtacggagtacggaacggtaccgttatttacgttagttagtttttagggttaggttaggttttacgtttaccgttacgtaacccttacggtagtaccgggtacggggtaccggttccgtaccccggtcgggtaccgggaacgggtaacgttacgtaccggtcgttacccgtaccgttcccgttacgtcccgtacccgtaaccccgg

SEQ ID NO: 141962 - DNA, 730 bp, Homo sapiens
  misc_feature: GYAE6OF02F1OVW.46.67.G01.1.454.CMB.1.raw
  modified_base (368)..(368): a, c, t, g, unknown or other
  misc_feature (368)..(368): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagaccctgtccctcacctgcgctgtctctggtgcctccatcagtagtggtttcttcgtggggctgggtccggcagcctcccgaggggagggctggaatacagttagggaagttcgtcctcgtcagttagtggaggttcctagttacacgtccgtctctcaagagtcgagtccacctatatctctaggacacgtccgagacaacttccgtacgttttacccgagaacgtntcggtacgtttcgtgtccggacccgtcccggtacgtacggtaccggtaccgggttacgtttttaacttacggttcggtggacggaggtacggacggttacttattacgttagttacggtttttagggaagtttggtttacttacgtaccgtacccgttagaccgttcgggaccggggtccgtacccggtacccgggtgggacccgtaaggggacttacgggtaccgttacccgtacccgttccgttacccgttacgcccgtaaccgtaaccggaaccgggtacccctccggttacccggttcccccgttacccggtccggtacccgtacccccctaccgtacccgtacggaccgtaccccgg

SEQ ID NO: 141963 - DNA, 609 bp, Homo sapiens
  misc_feature: GYAE6OF02GSKWK.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggagacagtgtcaccatcacgttgccgggcaagtcggaactattgactactatttaaattgtatacaacatacgaccgaggaccgccctaagctacctaatctatgctgctacgtctagtttgacgtaaaggtcgggtaccagtcgagttcaggtcggcgtagtgactcgtagggacagtactttcactctacacctatacgtagtaactcgtacgtaaccgtaacgtagtaagttattttacgaaccttaaattacgttacttacgtacaaactaagtaacttactaagtttcgtttaccggaccgtaaaggtacaaccgtaaacttaaactaaacgttaaacgtaacgttgacggtactacggaccactacttcgtcgttacttacctactttcctacccgactacttacgtagtaacc

SEQ ID NO: 141964 - DNA, 637 bp, Homo sapiens
  misc_feature: GYAE6OF02GT0LP.46.67.G01.1.454.CMB.1.raw
  modified_base (310)..(310): a, c, t, g, unknown or other
  misc_feature (310)..(310): n is a, c, g, or t
  modified_base (343)..(343): a, c, t, g, unknown or other
  misc_feature (343)..(343): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctccgaggggaagggctaggaatacattggaagtgtctctcatgtggaggttcctattacgagtccgtctctacaagacgtcgagtccacatatctntgacacgtcagacaatctacgttttccagaagntgtagttctgtcgaccgcgctgacgtacgggtctttatacgtgtacgacgagacggacggtctaagttagttagttagttttaggtaggtttgtttacgttacgacctaccgttagacgtacgggccgggtcgtaccggtacccggtgggaccgtaagggtaactacggttcggtacctacccgttccttcccgttacgtccccacccgtaaccggtaaccgggaccctacgtccggttacccctttaccccggccggtaccctccccgttacctacccggacgtaccgtcccg

SEQ ID NO: 141965 - DNA, 534 bp, Homo sapiens
  misc_feature: GYAE6OF02FVPYR.46.67.G01.1.454.CMB.1.raw
  modified_base (371)..(371): a, c, t, g, unknown or other
  misc_feature (371)..(371): n is a, c, g, or t
  modified_base (378)..(378): a, c, t, g, unknown or other
  misc_feature (378)..(378): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccaggacggcccctaagctctaatctatgctgcatccagtttgcaaagtggggtcccatcgaggttcagtggcagtgatctgggacagattcactctcaccatcagtatcngcaagtntaagattttgctaacttacttattcgtacaacagtaaattacaagttagttttccggacctaaagggacacggaactaacaaaattaaaccgaatagtagctacgactaaccgattctagttccttacgacttccttcccgcctacttcctgtaac

SEQ ID NO: 141966 - DNA, 860 bp, Homo sapiens
  misc_feature: GYAE6OF02J2F9Z.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcgcctccatcagtagtggtttctcgtgggctgggtccgctagcctccgagggagggctaggaatacagttggagtgtctctacgagttagtggtaggttctacttacgtacgtccgttcttcgtacgtaacgtacgtcggtaaaaaaaacgtccgtaacctacttactaccttcgtacggtaccgtaccgttaccgacgtactaacttaccgttacgttttacccgttacgtaaacgtacgttacgttacgtttcgttacgttacggtacccggtacccgtccgtacggtaaccggtaccggggttaccgttttaacggtttaccgttcggttacggtacggtaacggtaacggtaacggttacgtttaacgtttaacgtttagtttaaggtttttacgggttaagggttttacggttttaacgtttaccgttaaccgttaaccgttaacggttaccgtacggggtaccggggtaccggttacccggttacccgggtaccgggtacccgggtaacggggtaacgttacgggttaccgggttacccgtacccggttaccgttacccgttaccgtacccgtacccgtaacccggtaaccgggtaccccgtaccggttacccggttaccccgtttaccccgtacccggtaccccgtaccccgttaccccgtacccgtaccggtaccgtacccg

SEQ ID NO: 141967 - DNA, 578 bp, Homo sapiens
  misc_feature: GYAE6OF02FXC4P.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcgaacattgacacctatttaaatgtatcaacatagaccagggacggcccctaagctcctaatctatgctgcatccagtttgacaaagtggggtcccatcgaggttcagtggcagtggatcgtgggacagtattcactctcaccatcagtaatctgactaacgtgaagtattttgactaacttattactgtacaacagtaaattactaattcgttttacggacctaaagggtaccaacgtaactaaacgtaaaacttaaaacgaacgttagtacggtactagaccgtaacctacttaccgttcgttacctttacgtacttacccgtttaccccgacctaactttaccgtacgtaaccg

SEQ ID NO: 141968 - DNA, 700 bp, Homo sapiens
  misc_feature: GYAE6OF02IAQPH.46.67.G01.1.454.CMB.1.raw
  modified_base (295)..(295): a, c, t, g, unknown or other
  misc_feature (295)..(295): n is a, c, g, or t
  modified_base (347)..(347): a, c, t, g, unknown or other
  misc_feature (347)..(347): n is a, c, g, or t
  modified_base (367)..(367): a, c, t, g, unknown or other
  misc_feature (367)..(367): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggcctttcggagacccctgtccctcacctgcgctgtctctggtgcctccatcagtagtggtttcttctgggctgggtccggcagctcccgagggagggctggatacagttggaagtgtctctcataggtggacggtttcctaattacgagttccgtctctacaagngtcgatcaccatatctctggacacgtccagcaactctacgtttccagaagtntgtacttctgtcgacccgcncgtacgacgtacgggtactttagttacgtggtacgcgaggacggacggtattaattagtagttagttttggagtttggttagtttacgacctaccgtagacgtcgggacggggtcctaccggaccccggtcggggtacccgtaagggaaccgtttacgttcgggtacccgtacccgtttccgttacccggtttaccgccccgttaaccccggaacccggtaacccggggtacccccgttaacggttccccgggttaccccctttccccccggttaccgggcccccgttaaccccccgttcccgttaacccccgaaacggtcccgtaacccccg

SEQ ID NO: 141969 - DNA, 672 bp, Homo sapiens
  misc_feature: GYAE6OF02JWYOG.46.67.G01.1.454.CMB.1.raw
  modified_base (140)..(140): a, c, t, g, unknown or other
  misc_feature (140)..(140): n is a, c, g, or t
  modified_base (193)..(193): a, c, t, g, unknown or other
  misc_feature (193)..(193): n is a, c, g, or t
  modified_base (222)..(222): a, c, t, g, unknown or other
  misc_feature (222)..(222): n is a, c, g, or t
  modified_base (237)..(237): a, c, t, g, unknown or other
  misc_feature (237)..(237): n is a, c, g, or t
  modified_base (485)..(485): a, c, t, g, unknown or other
  misc_feature (485)..(485): n is a, c, g, or t
  modified_base (558)..(558): a, c, t, g, unknown or other
  misc_feature (558)..(558): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagangtgacatcgagctgacccagtcctccatcctccctgtctggcaaccgtggganacagtgtacaccatcactcggcccggggnaaggtacggaaaccnttcgactaccttaatttaaacgttggtatactaacaatacgaccgaagggccgtacccctaagtctaccctaaatcctaagcgtctagctatccgtagtttagcaaacggttgggtacccaagtcgtaggtcgacgtgcgaggttaggatcggttagggctaacggtattaccgtatcctacgtaccctatactaggtaactcgtacgtaactaacggtagtaacgttagtttcgaactacttttaancgttatacgaactagtaactttacaacggtttcggttacggaccgtaacgggtaacaacgttaaccgttaaanaaacggttaaaccgtaaatttcgggaacctacgtaagaccgtaacccgtatttaccgttaacggttcttaccggtacccttccgttacccggacctacgtttacgtactaaccg

SEQ ID NO: 141970 - DNA, 747 bp, Homo sapiens
  misc_feature: GYAE6OF02GH2EV.46.67.G01.1.454.CMB.1.raw
tcagactagcagtacacgaccggtgctcgatttagagtatacatattgggtttgggggaccgtcctgtgcaagaacatgaagcacctgtggtttgtcctcctgctggtggcagctcccagatgggtcctgtcccgtggtgcaactgcaggagtcgggcccacgactggtgaggccttcggagacccgtgtcccctcaccgtgccgtctgtctcgtggtgccctcatcagtagttcggtttcttcgtggggtcttgggtccggacgtaggcctcccggagggaggggcgtaggtactacgagttgggtaagtgtctcgtctagtggtggtacggttcctattacgaggttcctacgttctacgaagtacgttcgacgtccgaactagttactccttacgtacggactaccgtccgagaccgtaatccgttacttttcccgagtaaaggtaacttcggtacgtttacgtcgtaccggaccgtccgtactcggtaaccgtaccggggtttatttaccgtattcgggtcgtaccggtacggtaccggtaggtaccttaagttagttacgtttaggtttaggtacggttttacggtttaacttcgaacccgtttaacgaggttacgaccgggtaccgggtacggtcccccggtacgggtaccggggttacccgggtaacggttaacggttaacccggttcgggtaccttacccggggttccctttccggtacccggttccccttaacccggg

SEQ ID NO: 141971 - DNA, 605 bp, Homo sapiens
  misc_feature: GYAE6OF02IF0Y0.46.67.G01.1.454.CMB.1.raw
  modified_base (191)..(191): a, c, t, g, unknown or other
  misc_feature (191)..(191): n is a, c, g, or t
  modified_base (214)..(214): a, c, t, g, unknown or other
  misc_feature (214)..(214): n is a, c, g, or t
  modified_base (224)..(224): a, c, t, g, unknown or other
  misc_feature (224)..(224): n is a, c, g, or t
  modified_base (368)..(368): a, c, t, g, unknown or other
  misc_feature (368)..(368): n is a, c, g, or t
tcagactagcagtacacgaccggtgctcgatttagagtatacatattgggtttggggagtctcggtcaggacacagcatggacatgagggtcccgctcagctcctggggctcctgctactctggctccgaggtgccagatgtgacatcgagctgaccccagtctccatcctccctgtctgcaaccgtgganacagtgtcacatcacttgccggnagtcggaacnttgactacttatttaatggtatcaacatagaccgagggaccgacccctaagcctcctaatctatgctgcatccgtagtttgacgtaaggtcgggtcccagtcgaggttcaggtggacgtagtcgatcggtggactagtacttcnctctcacctatacagttactctacgacttaacgtagtaacgttattttacgaacttaacgtttaattccgtacgtaactaacgtaagtaacttacgtaacgtttgtttacccggacgtaaggtaaccaccgttaactaaaccgtaaattaaccgaaacgttggtacgtactacgtacgaacctagttccgtactacccgttctactttccttacccgcctttaactccgtagtaacg

SEQ ID NO: 141972 - DNA, 585 bp, Homo sapiens
  misc_feature: GYAE6OF02GC7XA.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagacccctgtcccctcacctgcgctgtctctggtgcctccatcagtagtgtttctcgtggggctgggtccgcagcctccgagggagggctggaatacattggaagtgtctctcatagtggaggttcctattacagtccgtctctcaagagtcgatcaccatatctctggacacgtccagcaatctacgttttcccagaagtatgagttctgtcgacccgccgtctagacgtacgggtctttaagtctgtgcgagacggacgtcttattagtgttagttttggtagttggtttactttcgaacctaccgttagtacgtccgggacggggtcctaccggaccccggttggggacccgaagggtaactaccggtcggtaccacccggttctaccgttacgcccctacccg

SEQ ID NO: 141973 - DNA, 556 bp, Homo sapiens
  misc_feature: GYAE6OF02FTGIH.46.67.G01.1.454.CMB.1.raw
  modified_base (338)..(338): a, c, t, g, unknown or other
  misc_feature (338)..(338): n is a, c, g, or t
  modified_base (496)..(496): a, c, t, g, unknown or other
  misc_feature (496)..(496): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgaggggaaggggctggaatacattggaagtgtctctcatagtggaggttcctattacagtccgtctctcaagagtcgagtcaccatatctctggacacgtccagcaatctagttttcccngtaagatgtagttcgtgtcgaccgtccgctcgacgacgggtcgtttattacgtgtgcgagagacgctattatgtagttttggagttgttatttcgactacctagacgtcggacgggctccgccgcgggccagggactcgtgtcgcgtcctctacgccnccgacgacggccctagtccgttcccttccccgcgacctaccccgtctaccacgcgacccg

SEQ ID NO: 141974 - DNA, 669 bp, Homo sapiens
  misc_feature: GYAE6OF02JQ7E6.46.67.G01.1.454.CMB.1.raw
  modified_base (215)..(215): a, c, t, g, unknown or other
  misc_feature (215)..(215): n is a, c, g, or t
  modified_base (419)..(419): a, c, t, g, unknown or other
  misc_feature (419)..(419): n is a, c, g, or t
  modified_base (492)..(492): a, c, t, g, unknown or other
  misc_feature (492)..(492): n is a, c, g, or t
  modified_base (501)..(501): a, c, t, g, unknown or other
  misc_feature (501)..(501): n is a, c, g, or t
tcagactagcagtacacgaccggtgctcgatttagagtatacatattggtttgggggaccgtcctgtgcagaacatgaagcacctgtggttgtcctcctgctgtggcagctcccagatgggtcctgtccctggtgcaactgcaggagtcgggcccacgactggtcgaggccttcgggagtaccctggtcccctcacctgcgctcgtctctggtcncctccatcagtcgtgtttctcgtgggctgggtccggcagtcctccgtagggacgggtctggaataccgagttcgggaagtcgttcgtctacagttacgtggtacggttcctaagtttacgagttcccggtctcgtactaaggtacgtcgtacgtccgaaccagttactctcgtaggacaccttcgagcaatccgtatttacccngaaagtctagtagttccttaggtcgacccggtccgacgttcgaaccggtgggttacccgttatttccgtaggnggttaccgngtaacgaccggttctatttacgtgttagttttcggtaagttgttttacggtttcaccgttaaccgtagtacgtaccggtacgggtccgtacccggtaccccggtacgggccggtaacggtaacgtcgtcggtacctacccggttcgtaccggtacctcccgtaacccg

SEQ ID NO: 141975 - DNA, 664 bp, Homo sapiens
  misc_feature: GYAE6OF02IVXN1.46.67.G01.1.454.CMB.1.raw
  modified_base (371)..(371): a, c, t, g, unknown or other
  misc_feature (371)..(371): n is a, c, g, or t
tcagactagcagtacacgaccggtgctcgatttagagtatacatattgggtttgggggagtctcggtcaggacacagcatggacatggagggtccccgctcagctcctgggggctcctgctactctggctccgaggtgccagatgtgacatcgagctgacccagtcctccatccctccctgtcctgcaaccggtgggagacagtgtccaccatcacttggccggcaagtcggaacattgacacttaattaaatggtatacaacatagaccgacgggaccgcccctaagcctcctaatctatcgctgcatcctaagtttgactaaaacggtcggggtacccctagtcggtaggttacaggtcggacgtaggngggtaatccggtagggacgtagtactttccgacttctaccgtacctatacgtacgtaacttcgtagaccgtaagtagtaaacgtttattttacggtactaactttaattaacgtcgtaactaaacgtaattaacgttactaaaccgtttaggttttaccggacgtaaagggtaacctaaccgtaaacttaaacctaaaacgttaaaccaacggttacgtcgtacgtacgaactaacccagttactacgttcttaacgtacctttccgtacccgaccttattaccacgttaacg

SEQ ID NO: 141976 - DNA, 742 bp, Homo sapiens
  misc_feature: GYAE6OF02JZ4B4.46.67.G01.1.454.CMB.1.raw
  modified_base (208)..(208): a, c, t, g, unknown or other
  misc_feature (208)..(208): n is a, c, g, or t
  modified_base (252)..(252): a, c, t, g, unknown or other
  misc_feature (252)..(252): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactgggtgaggccttgggagaccctgtccctcacctgcgtctgtctctggtcgcctcatcagtgtggttctcgtgggctgggtccgnagcctacccgagggagggctggaatacagttggaagttgtcctntcagttacgtggtacggttcctattacgacgtccgttctcctacgaaggtacgttcggagaccttaccattactcgtcgtacggacctaccggtccagtcctaattcgtacgttttcccgagaacgttagacgttcgttacgtgtccgacccgtccgtacgtcgtaacggccggtttacgtttaacgtttacgtggtacggacgtaacggtacgggacgttaactttacgtagttagttttggtttaagggttgttacgttttgtaccgtaccgtaccgttagtacgtacggggtaccggtccgtacccggtccggtacgggaccggtaacggtaactccggttagtcccgtaccgttccgttacccgtaccgtccctacccgtaacgggtccccggtaccgttaccggtcccgtttacccccgttcccggtaccggtaccccgttaccccgttcccgtaaaccggttacccggacccgttaaccccggg

SEQ ID NO: 141977 - DNA, 687 bp, Homo sapiens
  misc_feature: GYAE6OF02F5KBT.46.67.G01.1.454.CMB.1.raw
  modified_base (293)..(293): a, c, t, g, unknown or other
  misc_feature (293)..(293): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagaccctgtccctcacctgcgctgtctctggtgcctccatcagtagtggtttcttcgtggggctgggtccgcagcctccgagggaaggggctggaatacagttggaagtgtctctcataggtggaggttcctattacagtccgttctctcaagngtcgagtcaccatatctctcggacacgtccagcaatcgtacgttttcccagaagatgagttctggtcgacccgcgctacggacgtacggggttcgtttttaattcgttggtacgcgaaggtacggtaccggtcttaagtttagtgtttaagtttttgggaggtttgggtttaactttcggaacctacccttaggacgtccggggaccgggggtccttcccgggtaccccggtgggggacccgtaaggggtaacttaccggtggttaccctacccggttccttacccgttacggtccccttacccgaaccggtaaccgggcccctacggttcccggttccctttcccccgttcggcccctaacccccttcccgtacccgaacggaccgtaccccg

SEQ ID NO: 141978 - DNA, 674 bp, Homo sapiens
  misc_feature: GYAE6OF02GH6N6.46.67.G01.1.454.CMB.1.raw
  modified_base (274)..(274): a, c, t, g, unknown or other
  misc_feature (274)..(274): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtgggctgggtccggcagctcccgagggaaggggctggatacagttggaagtgtctctcatagtggagttcctattacgngtccgtctctcagtgtcgagtccacctatactctcgtaggaccacgtccacgacaacttccgttacgttttcccagtaagtagtagtacgttctggtcgacccggctcgtacgaccggtacgggttctttactacgtgtacggcgaggacgtacggtacttagttagttgttagttttgggtagttcggttacgttaccgaaccgtaccgttaggtacgtcgggtaccggggtcctacccggtacccggtcggggtaccgtaagggtacgttaccgtcggtacctcccgtccgttcctaccgtccctacccgtaaccggaccggtccctaccgggttcccggttccccgttccccgtcggtacccctaccccgttacccgtaccgtacgtaccgtacccg

SEQ ID NO: 141979 - DNA, 651 bp, Homo sapiens
  misc_feature: GYAE6OF02JOB3B.46.67.G01.1.454.CMB.1.raw
  modified_base (215)..(215): a, c, t, g, unknown or other
  misc_feature (215)..(215): n is a, c, g, or t
  modified_base (225)..(225): a, c, t, g, unknown or other
  misc_feature (225)..(225): n is a, c, g, or t
  modified_base (253)..(253): a, c, t, g, unknown or other
  misc_feature (253)..(253): n is a, c, g, or t
  modified_base (290)..(290): a, c, t, g, unknown or other
  misc_feature (290)..(290): n is a, c, g, or t
tcagactagcagtacacgaccggtgctcgatttagagtatacatattgggtttggggtagtctcggtcaggacacagcatggacatgagggtccccgctcagctcctggggctcctgctactctggctccgaggtgccagatgtgacatcgagctgacccagtctccatcctccctgtctgcaaccgtggagacagtgtcacatcacttgccggnaagtcgaacnttgacacctatttaatgtatcaacatanaccaggacggacccctaagctacctaatctaatgctncatccagtttcgactaaaggtgggtaccctagttccggaaggtttccaaggttcggacgtaggttaggtaagtcgtaggggtacaacggttattttacgaaccttacgttctaaccccgtatactaacggtaaacttcgttacgaactaacggttacgaagttacttttaggactaaacctttatttaactgttacctaaacgtagtaaactttaactaagtttacgttttacggaaccaaggggttaacaaccggtaacttaactaaaatttaaacggaaccttggttacgtacttacggtaccaaccgtaattccgtacgttcttaacgcgttcccttaccgcctaacttctacgtaac

SEQ ID NO: 141980 - DNA, 698 bp, Homo sapiens
  misc_feature: GYAE6OF02I4ZH0.46.67.G01.1.454.CMB.1.raw
  modified_base (194)..(194): a, c, t, g, unknown or other
  misc_feature (194)..(194): n is a, c, g, or t
  modified_base (234)..(234): a, c, t, g, unknown or other
  misc_feature (234)..(234): n is a, c, g, or t
  modified_base (489)..(489): a, c, t, g, unknown or other
  misc_feature (489)..(489): n is a, c, g, or t
tcagactagcagtacacgaccggtgctcgatttagagtatacatattgggtttggggagtctcggtcaggacacagcatggacatgagggtccccgctcagctcctggggctcctgctactctggctcggaggtgccagatgtgacatcgagctgacccagtctccatccctcctgtctgaccaaccggtgganacgagtgtccacatcacgttggccgggcaagtcggaactnttcgacaaccttatttaaagttggtatcaacatagaccgagggaccggacccctaagccgtactaatctatcgactgacacttccgtagtttcgacgtaaacggtcggggtacccctagttacggacggttacgtaggtcgggacgtaggtcgggattccggtagggaacgtacgtaattttaccgacgttcgtaccaaccttacgtacttaaggttacgttacctagggtaacctaacgggtagtaaacgtttntttacggacttacgttaacttacgtagttaccaaagtagtaacttaagtacgtttacggtttcggaaccgtaagggacctaaccgtaacgttaaaacttaaacgggttaaaccgtaacgttcggtaggtactaccggtaacctacggtaattaccgttagttacctttacgtaccttccgtttaccccgacttcgtacgtattaaccgg

SEQ ID NO: 141981 - DNA, 578 bp, Homo sapiens
  misc_feature: GYAE6OF02IYR1N.46.67.G01.1.454.CMB.1.raw
  modified_base (217)..(217): a, c, t, g, unknown or other
  misc_feature (217)..(217): n is a, c, g, or t
  modified_base (227)..(227): a, c, t, g, unknown or other
  misc_feature (227)..(227): n is a, c, g, or t
  modified_base (252)..(252): a, c, t, g, unknown or other
  misc_feature (252)..(252): n is a, c, g, or t
  modified_base (303)..(303): a, c, t, g, unknown or other
  misc_feature (303)..(303): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcacatcacttgccgggnaagtcgaacnttgactacttattaaatgtatcaanatagaccgagggcggaccacgaagctcctaatctatgctgcatcctagttncgaaagtcgggtaccagtcggaggttcgagtggactaggtggatcgtaggacgtagtactttccacttctaccacctattacgagttaatctgaccaagtagtagtatttagacttaacttattacttacgtacaactataaatttaccgtaagttagtttccggaacgtaggactaacgtactaaataaaacgtaaacgtaacgtggtacgtctacgccaaccgtagttccacgtttacttcctaccgtttacccttcccgaccttactctacg

SEQ ID NO: 141982 - DNA, 836 bp, Homo sapiens
  misc_feature: GYAE6OF02JYH22.46.67.G01.1.454.CMB.1.raw
  modified_base (302)..(302): a, c, t, g, unknown or other
  misc_feature (302)..(302): n is a, c, g, or t
tcagactagcagtacacgaccggtgctcgatttagagtatacatatggttgtctcctgctgtggcagctcccagatgggtcctgtccctggtgcaactgcaggagtcgggcccacgctggtcgaggccttcgggagaccctgtccctcacctgcgctgtctcctggtcgccctaccatccacgtaggtcggtttccttcgtggggtacctgggggtccgacgacgtcctcccgaagggggaacggggtcctagggaacttacggagtttcgggaaagttcggtacctacgtcaagttacggngggtaacggtttcctaagtttaaccgtacggttccgttctcgtaccgaaaggtacgtccggaagttccgaaccagttactacctcgtacgggtacctaaccggtccgtaacgtactaactccgtacgtttttaccccgagaaacggtatacggtaacgtttcgtagttaccggaacccggcccgtacgttacgaaccgtacgggggtccttttaagtaccctgggttacgaacggttacgaagggtaccggttacgttaacgttagttacggttaacggtttttacgggaggtttcggtttaacggttccggtaaaccgttaccgtaacggttacggtacccgggtaggggtcccgttaaccggacccggttgggtaacccggtaaggggtaacgttaccggtacgttcccgtaaccgttccgttacgtacccggtcctacccggaccggtaacggaccccttaggttccccgtacctttacccccggtggtaccccgtacccgttcccctacggtaacccgacgttaccccgg

SEQ ID NO: 141983 - DNA, 609 bp, Homo sapiens
  misc_feature: GYAE6OF02HZD37.46.67.G01.1.454.CMB.1.raw
  modified_base (578)..(578): a, c, t, g, unknown or other
  misc_feature (578)..(578): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtgggctgggtccggcagctcccgagggagggctggaatacagttggaagtgtctctcatgtggaggttcctattacagttccgtcttctcaagtagtcgagtcaaccatatctcgtgacacgtccagccaatctacgttttccccagtaagatgtagttcgtgtcgaccgccgtcgtacggacgtacgggtcgttttaactcgttgtgacgtagacgacggtacttatagttgttagttttggagtttggtttattcgtacgtacctagtacgtcggacggggcctccggcccggtacgggccgaagggaactacgtcgtccgtaccgtccttacgttacgcccgtaccaccgacggtccctacgtcccggtcccttccccgngtaccctacccgttcccactacgcgtacccg

SEQ ID NO: 141984 - DNA, 589 bp, Homo sapiens
  misc_feature: GYAE6OF02F0N5O.46.67.G01.1.454.CMB.1.raw
  modified_base (211)..(211): a, c, t, g, unknown or other
  misc_feature (211)..(211): n is a, c, g, or t
  modified_base (233)..(233): a, c, t, g, unknown or other
  misc_feature (233)..(233): n is a, c, g, or t
  modified_base (311)..(311): a, c, t, g, unknown or other
  misc_feature (311)..(311): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctcatcagtagtgtttctcgnggggctgggtccgcagcctccgagggagggctggaatacagttggaagtgtctctcatagtggtaggttcctattacncgtccgtctctcaagtgtcgagtcaccatactctcgtggactacgtccagacaatctacgttttcccagaagtatgtagtttctgtacgaccgcgtctgacgtacgggttctttactactgtgcgagacgacgtacttattagtgttagttttggagttgttatttcgactacctagtcgtcggacggggtctccggacccggtggggtacccgaagggtaacttaccggttcggttacccgtacccggttccttcccgttacggcccttaaccccgg

SEQ ID NO: 141985 - DNA, 575 bp, Homo sapiens
  misc_feature: GYAE6OF02I5ABS.46.67.G01.1.454.CMB.1.raw
  modified_base (139)..(139): a, c, t, g, unknown or other
  misc_feature (139)..(139): n is a, c, g, or t
  modified_base (218)..(218): a, c, t, g, unknown or other
  misc_feature (218)..(218): n is a, c, g, or t
  modified_base (368)..(368): a, c, t, g, unknown or other
  misc_feature (368)..(368): n is a, c, g, or t
  modified_base (378)..(378): a, c, t, g, unknown or other
  misc_feature (378)..(378): n is a, c, g, or t
  modified_base (385)..(385): a, c, t, g, unknown or other
  misc_feature (385)..(385): n is a, c, g, or t
  modified_base (399)..(399): a, c, t, g, unknown or other
  misc_feature (399)..(399): n is a, c, g, or t
  modified_base (421)..(421): a, c, t, g, unknown or other
  misc_feature (421)..(421): n is a, c, g, or t
  modified_base (451)..(451): a, c, t, g, unknown or other
  misc_feature (451)..(451): n is a, c, g, or t
  modified_base (503)..(503): a, c, t, g, unknown or other
  misc_feature (503)..(503): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagntgtgacatcgagctgacccagtctccatcctccctgtctgcaaccgtgggacacagtgtcaccatcgacttggcccggnaagtcggaacattgacactattaaattggtatcaacatagacagggtacgcccctaagctacctaagtctatgcctgctatcctagtttcgactaaacggtggggtacccctaagtccggtaagttcaggtgacagtggatccgtggganacgttattcnctctacncctaagctaagtanctggacaacgtgtaagtgtttnctaagttattacgttaccaagataacttanattacgtttcggacctaagggactaagactaaacgtaaattaaacgtaacgngttacggcttacgacaacccgtatacggttactcttaaccggctttccggtacccacctacggtttcaattc

SEQ ID NO: 141986 - DNA, 619 bp, Homo sapiens
  misc_feature: GYAE6OF02GJK78.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacgttgccgggcaagtcggaacattgacaccttatttaatgtatcaacatagaccagggacgacccctaagctcctaatctatgctgcatccagtttgacaaaggtcggggccccagtcgtaggttcaggtggcaggtggatcgtgggacagtatttcgacttctacaccatctagtatctgactaacgtagaaagttattttacggtaaactttattaccgttagttaaccaactaagtaaactttaactaaagtttcggttttaaccggaccgtaaagggtacctaacggtaaaccttaacgtaaaacgtttaaacgaacgttaggtacgactacggacctaaccgtattaccttcgttcctttactaccgtttcccttaccccgtaccttactcgttacgtacttaaccg

SEQ ID NO: 141987 - DNA, 615 bp, Homo sapiens
  misc_feature: GYAE6OF02GCGVC.46.67.G01.1.454.CMB.1.raw
  modified_base (211)..(211): a, c, t, g, unknown or other
  misc_feature (211)..(211): n is a, c, g, or t
  modified_base (335)..(335): a, c, t, g, unknown or other
  misc_feature (335)..(335): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctcatcagtagtgtttctcgtgggctgggtccgcagcctccgagggagggctaggaatacagttaggaagtgtctctcagtaggtaggtacgttaccttatacgtacgtccgtctctagaagngtcgacgtacaccgtatactctcgaggacaccgtacagactaactcttacttttcccagaaggtatgtacgttctggtcgaccgcgtcgtacgacgtacgggttattacgtacgtgtacgcgagaggcgacttattatgttattttgggagttagttacgttaccgactaccgtagtacgtcgggacggggtcctacccgggtacccggtaggggtaaccgaagggtaacttacggtacggtaccgtacccggttcttacccgtaccgtcccgtaacccg

SEQ ID NO: 141988 - DNA, 687 bp, Homo sapiens
  misc_feature: GYAE6OF02GOJKR.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagcttacccagtctccatcctccctgtctgcaaccgtgggagacagtgtcaccatcacttgccgggcaagtcggaacattgacacctatttaatggtatcaacatagaccaggaccggcccctaagcctcctaatctatgctgcatcctagtttcgactaaaggtcggggtcccagtcggtaggttcgagtcggctaggtggagttcgtgggactaggtacttttcgaacttctacaccgatccgtaacgttaactcgtacgactaaacgttggtaaagttagtttttacgacttaaaccttttaactttaaccgttgttaacctaaacctaaggttaaatttaacctaatttacgtttttaccgaaaccgtaaaggggtacctaaccgtaaaccttaaactaaaacgtttaaaaccgaacgttggtaacggtccgtacggtaaccaccgttaacttaccgttacggttaacctttaccgtaacgtttacccgtttaccccggacccttacgttacctttacggtaactttaaccgg

SEQ ID NO: 141989 - DNA, 634 bp, Homo sapiens
  misc_feature: GYAE6OF02GKXD0.46.67.G01.1.454.CMB.1.raw
  modified_base (333)..(333): a, c, t, g, unknown or other
  misc_feature (333)..(333): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagttagtggtttcttctggggctgggtccggcagctcccagggagggctggaatacattggaagtgtctctcatagtggaggttcctattacagtccgtctctcaagagtcgagtcaccatatctctggacacgtccagcaatcagttttcccngaagatgattctgtcgaccgccgctgacgacgggtcgtttattactggtgcgagagacggctattatgttattttggagttggttatttcgaacctacccgttagtacgtcgggacggggtcctccggtaccccgtcgggggtacccgaggggtaacgttaccgttcgggttaccgtacccgttccgttacccttacgggtcccctacccgtaacccgtaacgggcccctaacgttcccggttccccgtttacccccgtccgggtccctaccccgtccccgtccgtaacggccgtaccccg

SEQ ID NO: 141990 - DNA, 602 bp, Homo sapiens
  misc_feature: GYAE6OF02IZHL8.46.67.G01.1.454.CMB.1.raw
  modified_base (190)..(190): a, c, t, g, unknown or other
  misc_feature (190)..(190): n is a, c, g, or t
  modified_base (228)..(228): a, c, t, g, unknown or other
  misc_feature (228)..(228): n is a, c, g, or t
tcagactagcagtacacgaccggtgctcgatttagagtatacatattgggtttggggagtctcggtcaggacacagcatggacatgagggtccccgctcagttcctggggctcctgctactctggctccgaggtgccagatgtgacatcgagctgacccagtctccatcctcctgtctgcaccgtggganacagtgtcaccatcacgttgccgggcaaggtcggaacnttgacctacctatttaagtggtatacaacatagaccgagggaccgccctaagcctctaatctatgctgactatcctagtttcgactaaggttcgggtcccagtcgaggttcaggtggcaggtgatcgtaggactagtactttcgactcgtacactatcctaagtaactctacgacgtaacgtagtaacgtatttacgacttaactttattacgttacgtactaaactaacgttaattaactaagtttcggttttacggaccgtaaggtaacgtacgtaacctaactaaacgttaaacgacttaggtacgtacgtacgtacacgtactacttagtaccttactacgttccgtacctacctactctagtacttacg

SEQ ID NO: 141991 - DNA, 855 bp, Homo sapiens
  misc_feature: GYAE6OF02H2PUS.46.67.G01.1.454.CMB.1.raw
tcagactagcagtacacgaccggtgctcgatttagagtatacatattgggtttggggagtctcggtcaggacacagcatggacatgaggtccccgctcagctcctggggctcctgctactctggctccgaggtgccagatgtgacatcgagctgacccagtctccatccgtcctgtctgacaccgtgggatacagtgtcaccatcacgttcggcccgggacaacggttacgggaacatttacggacctaccttaatttaaagttggtaattaccaaacattaacggaccgtaacggggaccggacccctaaggtccttaccctaaatccttaatcgctacgtacacttccgtaggtttacacgtaaaaggttcggggtaccctaagttccggtaggtttacgaggttacggaccgtaggtcgggtaactcggttagggaaccgtaaggttaacttttaccgtaacccgtttccttaaacccgaccctaattaccggtaaacttacgtttaccgtacgggtaacctaaccgggttaacggtaaagtttttaaccgtttacgttaacccggttaaactttttaacggtttaaaccgttactttaaaccgtaaaaccggttaacgttaaaactttaaaggttaccgtttttaacgggtttaccccgggttaaccgtaaacggggaacccggttaaactaaacccgtttaaacgttaaaaaccggttaaacggtaaaacgttacggttacgggtccgttaacggtactaaacccggaacttttaccgtaaccggttttcctaccggtttacccgtacccgtttcccccaacctttacgttaccggttaattaaccccgg

SEQ ID NO: 141992 - DNA, 674 bp, Homo sapiens
  misc_feature: GYAE6OF02GDR0Y.46.67.G01.1.454.CMB.1.raw
  modified_base (212)..(212): a, c, t, g, unknown or other
  misc_feature (212)..(212): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtcccctcacctgcgctgtctctggtncctcatcagtagtgtttctcgtgggctgggtccgcagcctccgagggagggctaggaatacagttggaagtgtctctcatgtggtacgttcctatacagtccgtctctcaagtagtcgagtccacctatactctcgtacggactaccgtccagtactaactcttacgttttccctagtaacgtattgtacgtttcgtggtcgacccggccgtcgtacgaccggtacggggttacttttaacgttccgttggtcggacggtaggtacggtacggtactttagtttacgttcgtttaggtttttcgggagttttacggtttactttccgtaaccctaccgttaggtacggttcccgggacgggggttcctacccggtaccccgggtcggggacccgtaacggggtacttacggtcgggtaccttaacccggttccgttaccgtttaccggccccttaaccccgg

SEQ ID NO: 141993 - DNA, 675 bp, Homo sapiens
  misc_feature: GYAE6OF02JF8EP.46.67.G01.1.454.CMB.1.raw
  modified_base (289)..(289): a, c, t, g, unknown or other
  misc_feature (289)..(289): n is a, c, g, or t
  modified_base (335)..(335): a, c, t, g, unknown or other
  misc_feature (335)..(335): n is a, c, g, or t
  modified_base (341)..(341): a, c, t, g, unknown or other
  misc_feature (341)..(341): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtgggctgggtccggcagctccgagggaaggggctggaatacagttggaagtgtctctcatagtggaggttcctattacagtccgtctctcaagngtcgagtcaccatatctctggacacgtccagcaatcagttttcccngaacgntgtagttctagtcgtaccggcccgtctgacgaccggggtacgttttaagttacgttggtcggtacgaggtacggacgggtccttaagtttattgttagtttttggtaaggttggttttatttccggtaacctacccgttaagtacgttaccgggtacgggggtccttccggaccccgttacggggggcccgtaacggggaacttacggttcggtacccgtacccgttccgtaccgttacgtcccttccgaacccgtaacgggcccctaggtcccggttcccgttcccccgtcggtaccccgaccccgttcccgtacccgaacgtaccgtacccg

SEQ ID NO: 141994 - DNA, 600 bp, Homo sapiens
  misc_feature: GYAE6OF02I51L7.46.67.G01.1.454.CMB.1.raw
  modified_base (193)..(193): a, c, t, g, unknown or other
  misc_feature (193)..(193): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgtcaccatcacttggccgggcaaggtcggaacattgacaccttatttaatggtatacaacatagaccgagggaccgacccctaagctacctaatctatgctgcactcgtagtttgactaaggtcgggtcccagtcggtaggttcgaggtggcgtaggtggtagtcgtagggactagtacgtttacactcctccaacctactactaagttactcgtacgacgtaacgtagtaagttattttagttaaactttattacttagtactaacaagttaattaactaagttcgtttacggaccgtaaggacctaacgtaactaaacgtaaacttaaacgaactgtacgatacgactaactactctacgttcttctaccgttcctcccgtactactctacgtacttacg

SEQ ID NO: 141995 - DNA, 535 bp, Homo sapiens
  misc_feature: GYAE6OF02FUT9K.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggagacagtgtcaccatcacttgccgggcaagtcggaacattgacacctatttaaattggtatcaacatagaccagggacggcccctaagctcctaatctatgctgcatccagtttgcaaagtgggtcccatcgaggttcagtggcagtggatctgggacagatttcactctcacctatcagtaatctgacaacgtgaatattttgactaacttattacttgtacaacgagtaattactaattgttttcgaccgtaagggacctaacgactaacaaacttaaacgaactgtacgactagcaacctatactagttccttcacttccttacccgacctacttactgtaac

SEQ ID NO: 141996 - DNA, 804 bp, Homo sapiens
  misc_feature: GYAE6OF02JU2F1.46.67.G01.1.454.CMB.1.raw
tcagactagcagtacacgaccggtgctcgatttagagtatacatattgggtttggggtaggtctcggtcaggacacagcatggacatgagggtccccgctcagctcctggggctcctgctactctggctccgaggtgccagatgtgacatcgagctgacccagtctccatcctccctgtctgctaaccggtgggacacagtgtccaccatcacttcgccgggacaagtccggaatattcgaccgtaaccttattttaaaagttggtactactaaacagttaagacctaagggacggacccctaaggacctacctaatactaagttgaccttgaccacgtcctacgtttacgacgtaaaaggttccggggtacccctagtaccgtagggttacccagggttacggcctagggtaggtacttacggtgggaaccgtaacggtatttaccgtaaccgttctaacccgtacccgaacttaccgttaacgttaaacgttccgttaacgtaaccgtaaacggttacggtaaacggttaacgtttttaacgaaccgttaaaccgttttaaacgttttaccgttaaccggtttaacctaaacgtaaaccgggtaaactttaaaccgtaaacttttaacggttttaccgggtaacccgtaaagggtaccgttaaaccgtaaccgttaaacgtaaaaccgttaaacggtaaccgtacggttacggtacgttacggaaccgtaacgtaccgttacttggtttaccttaccgtacttacccgttccccgtaccgttacgttacccgtagttaaccg

SEQ ID NO: 141997 - DNA, 691 bp, Homo sapiens
  misc_feature: GYAE6OF02F1YIO.46.67.G01.1.454.CMB.1.raw
  modified_base (193)..(193): a, c, t, g, unknown or other
  misc_feature (193)..(193): n is a, c, g, or t
  modified_base (218)..(218): a, c, t, g, unknown or other
  misc_feature (218)..(218): n is a, c, g, or t
  modified_base (229)..(229): a, c, t, g, unknown or other
  misc_feature (229)..(229): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatcctccctgtctgcaaccgtggganacagtgtcaccatcacttgccgggnaagtcggaacnttgactaccttatttaatgtatcaacatagaccgaggaccggcccctaagctactaatctatgctgacactcctagtttgacgtaaaggtcgggtacccagttcgtaggttcaggtcggctaggtggatcgtagggacaggtacttcgactcgtacacctatactagtactactacgactaacggtagtaaagttacttttagaccttaacgtttacttacgttacgtaacctaacgtaagttaaacttaacgttaacgtttacggttttaacccggaccgttaaacgggaaccgtaaccgttaaaccgttaaaccgttaaaaacgtttaaaaccggtaaacgttacgggttacggtaccgttacggtacccgtaaaccgttacgtttaccgttacggtttaccctttaccgttacctttcccgtttaccccggtaccctaacgtttaccgtacgttaaccg

SEQ ID NO: 141998 - DNA, 662 bp, Homo sapiens
  misc_feature: GYAE6OF02GHYB0.46.67.G01.1.454.CMB.1.raw
  modified_base (178)..(178): a, c, t, g, unknown or other
  misc_feature (178)..(178): n is a, c, g, or t
  modified_base (214)..(214): a, c, t, g, unknown or other
  misc_feature (214)..(214): n is a, c, g, or t
  modified_base (457)..(457): a, c, t, g, unknown or other
  misc_feature (457)..(457): n is a, c, g, or t
tcagactagcagtacacgaccggtgctcgatttagagtatacatattgggtttgtcctcctgctggtggcagctcccagatgggtcctgtccctggtgcaactgcgaggacgtcggggcccacgactgggtgaggcctttcgggagaccctgtccctcacctgcgctgtctctggtcncctcatcagtagtggttctcgtggggctgggtccgnagcctcccgaggggacgggtctgggaatacgagttaggaagttgtcctctactaagttaggtggtacggttcctaattaacgacgttaccggtctcctacaaggtacgtcgagtccaccattctctcgtggacctacgtccaagctaactctacgttttcccagaagtgtgtagttctggtcgaccggcgtcgtcgaccgtacgggttctttacttactggtcgacgagacgcgtctaagttntagttagttttaggagtttgttacttcgactaccgtagtacgtcgggtacgggtcctaccggtacccggtcggggtaccgtaagggtaacttaccgtacggtacctaccgttaccttaccgtcgaccctaccgaccggaacggtccctacgtcccggttccctccccgtcggtccctaccccgtaccgtaccgacgtcgtacccg

SEQ ID NO: 141999 - DNA, 668 bp, Homo sapiens
  misc_feature: GYAE6OF02JSYQF.46.67.G01.1.454.CMB.1.raw
  modified_base (194)..(194): a, c, t, g, unknown or other
  misc_feature (194)..(194): n is a, c, g, or t
  modified_base (209)..(209): a, c, t, g, unknown or other
  misc_feature (209)..(209): n is a, c, g, or t
  modified_base (232)..(232): a, c, t, g, unknown or other
  misc_feature (232)..(232): n is a, c, g, or t
  modified_base (254)..(254): a, c, t, g, unknown or other
  misc_feature (254)..(254): n is a, c, g, or t
  modified_base (286)..(286): a, c, t, g, unknown or other
  misc_feature (286)..(286): n is a, c, g, or t
tcagactagcagtacacgaccggtgctcgatttagagtatacatattgggtttggggtaggtctcggtcaggacacagcatggacatgagggtcccgctcagctcctggggctcctgctactctggctccgaggtgccagatgtgacatcgagctgacccagtctccatcctccctgtctcgcaaccgtggganaccaggtgtcaccancacttgcccgggaagtcggaacnttgacactattaatgtatcaanatagacaggacgccctagctctaatctatcgntgcatcctagtttcgactaagtcggggtccctagtcgtacggttcaaggttcggaccgtaaggtggtacgtcgtacgggtaccgtaaggtactttaccgtaacttcccgttacaaccgtacgtacctaaggtaaacttccgttacgaccgtaaaaccggtagttaaagggtaacctttttagggaccttaaaccgtttacttacgttacgttacgtaaacgtacgtaaatttaactacgttagtttaccgtaccgtaagggaacctacggtaactaaacgtaaacgtaaacgttaacgtagtacggtcttacggtacctaacggtattcgtacgttacgttacctacgttccgttacccgtacctacttacgttacgtaacg

SEQ ID NO: 142000 - DNA, 580 bp, Homo sapiens
  misc_feature: GYAE6OF02GMT4R.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgcccctaagcctctaatctatgctgcatccagtttgactaaaggtgggtacccagtccggtaggttcaggtggcaggtggatcgtgggacagtatttcactctcacctatacagtaatctagactaacgtagtaagtatttgactaacttattacttagtacaactataattactaagttgtttacggaccgtaagggacaacgtaacttaaacaaacttaaacgaacgttagtacggtactacggacctaacctattccgttagttacctttactacgtttacccttccccgtacctacttcctagtaacc

SEQ ID NO: 142001 - DNA, 635 bp, Homo sapiens
  misc_feature: GYAE6OF02FUZNZ.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggagacagtgtcaccatccacttgccgggcaagtcggaacattgactacctatttaaagttggtatcaacatacgaccgaggaccgcccctaagctacctaatctatgctgcatcctagtttgactaaggtcgggtcccagtcgagttcagtcggcagtggatcgtgggacagtacttcactctacacattacagtactctacgactaacgtagtaaagttcgttttacgacttaactttacttacgttacgtacaaactaagtaaactttaacgttaacgtttacgttttaccggaaccgtaacgggtaacctaacgtaacttaaacgtaaaaacgttaaacgtaacgttacgtacggtacgtacgtacctaaccctattcccgttagttaccctttacgtacctttccccgttaccccgtaccttacgttccgttacgttaaccg

SEQ ID NO: 142002 - DNA, 701 bp, Homo sapiens
  misc_feature: GYAE6OF02FMM4K.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctcgacccagtcctccatccctccctgtctgaccgaaccggtgggagacagttcgtccaaccatacctacgttcgggacccgggactaaggtaccggaaactagtttacgaacctaacctttaattttaaagttggtatacaaactatacgaaccgacgggaccggtacccctaagtcctacctaatctatgctcgctactcctagtttacgacgtaaggtccgggtacctagtcggtaggttcaaggtggacaaggtggacttccggtagggacgtagttactttaccgaccttcctaccgaacctacgttacaagttaacttcgtaggaaccgtaacgtagtaagttaattttaccggaacttaacttagtttacttacgtaactaacgtaataactttaactagtttcggtttaccgacggtaaacgtacctaacgtaactaaaccttaaaacgtaaacgtaagtacggtacgtacctacgaaccttacctaattctacgttaccttctacccgttccctaccgacctactttacgtacgttaacc

SEQ ID NO: 142003 - DNA, 572 bp, Homo sapiens
  misc_feature: GYAE6OF02F5Q9N.46.67.G01.1.454.CMB.1.raw
  modified_base (384)..(384): a, c, t, g, unknown or other
  misc_feature (384)..(384): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaaggtcggaacattgacacctatttaaattggtatcaacatagaccagggacggcccctaagctcctaactctatgctgcatccagtttgcaatgggggggggggtccagtcgaggttcagtggcagtggatctgggacagatttcactctcaccatcagtaatctncgaacgtagaagtattttgactaacttattacttagtactaacgagtaaattactaattgttttacggaccgtaacggactaacgacttaaacgtaaaacttaaacgtaaacgttagtaggtacgtagtacgaacctatacttacgttctttacctacttaccttacccgttccacttcgttagtacg

SEQ ID NO: 142004 - DNA, 776 bp, Homo sapiens
  misc_feature: GYAE6OF02JRK6A.46.67.G01.1.454.CMB.1.raw
tcagactagcagtacacgaccggtgctcgatttagagtatacatattgggtttggggtagtctcggtctaggacacagcatggacatgagggtcccgctcagctcctggggctcctgctactctggctccgaggtgccagactgtgacatcgacgctgacccagtctccatcctcctgtctgacaccggtggacgactagtgtaccacctatccacgttggccccgggataacgtcggaaccagtttacgggaccacccttaagtttaaaattcgggtactactaaacattaacggacctacggggtaaccggacccccgttaaaggccttaaccttaagaccgttaatcgggtctacgcctaaagtccctaggttttacgacgttaaaacgggtccggggtaccctacggtacggtaaccggggtttacacgggtttacggactacgggtaggtaacgtcgttacgggggaactacgggttactttacgaaccgtttctaacaccgtatccgtaagttaacgtactacggtactaaaccggtagtaaacgttactttaaggtaccttaaacctagtttaacctagttaccctaagtacgtaaacttactagtttagttccggtaaccgtaacggtacgaaccgtacttaacgtaaaacttaacggtaaccgttacgtacgttacgtaaccttacgtaaccttaccgtttagtaaccttaccttaaccgttcccgtttaccctaccggttaactttacccggttagtaaacttccg

SEQ ID NO: 142005 - DNA, 708 bp, Homo sapiens
  misc_feature: GYAE6OF02IAP4L.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctgggggctcctgctactctggctcgaggtgccagatgtgacatcgagctgacccagtctccatcctccctgtctgcaaccgtggganacagtgtcacatcacttggccgggcaaggtcgaactagttgacacctaatttaaatggtatcaactatagaccgagggaccgcccctaagcctctaatctatcgctgcatcctagtttgacgtaaaggttcggggtacccacgttacggtacggttacgaggttggacgtacggtggtacgttcgtaggggtaactagtagtttccaacttctaccgtacaattaccgtaagttaacgtcttacgaacgttaacgtaggtaaacgtttagtttacgtaaccttaacgttttaattaacccgtagtttaacgaaactaaggtttaaactttaacgtaaacgttttacggttttaacccggaacgtaacgggtaacctaacggtaacttaaaaccgttaaacgttaaacggaacgttaggttacgtacgtacgtaccgtaaccttaacctcgtttccgttaacctttaccgtaccttcccgtttaccccgaacccgttagttaccgttacggttaacg

SEQ ID NO: 142006 - DNA, 581 bp, Homo sapiens
  misc_feature: GYAE6OF02F14PZ.46.67.G01.1.454.CMB.1.raw
  modified_base (323)..(323): a, c, t, g, unknown or other
  misc_feature (323)..(323): n is a, c, g, or t
  modified_base (374)..(374): a, c, t, g, unknown or other
  misc_feature (374)..(374): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccgcagctcccgagggagggctggaatacattggaagtgtctctcatgtggagttcctatacagtccgtctctcaagngtcgagtcacatatctctggacacgtcagcaatctacgtttcccagaagtntagtagttcgtagtcgaccgcgtctgacgtacgggtctttacttacgtgtgcgagacgacgcttagttacgtgttagttttggagtttggtttatttccgactacccgtagtacgtcgggaccggggtctacccggtacccggtgggaccgtaagggtacttacggtcggtaccgtacccgttcctcccgttacgcccttaaccccg

SEQ ID NO: 142007 - DNA, 567 bp, Homo sapiens
  misc_feature: GYAE6OF02FHO51.46.67.G01.1.454.CMB.1.raw
  modified_base (224)..(224): a, c, t, g, unknown or other
  misc_feature (224)..(224): n is a, c, g, or t
  modified_base (249)..(249): a, c, t, g, unknown or other
  misc_feature (249)..(249): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccggcagtcgacntgacacctattaatggtaatcaacntagaccagggaccgcccctaagcctcctaatctatcgctgcatcctagtttgactaaaggtcgggtaccagtcgaggttcaggtgcagtgggatcgtagggacagtactttcgactccgcacatacagtactctcgacaacgtagaagtatttacgactaacttattactgtacaactaagtaacttacaagtttcggtttacggaccgtaaagggtaccaaacgtaactaactaaacttaaacgacttagtacgtctacgacctaactactacgtcgttaccttacgtactccttacccggacctacgtctagtaac

SEQ ID NO: 142008 - DNA, 620 bp, Homo sapiens
  misc_feature: GYAE6OF02JY0CC.46.67.G01.1.454.CMB.1.raw
  modified_base (209)..(209): a, c, t, g, unknown or other
  misc_feature (209)..(209): n is a, c, g, or t
  modified_base (335)..(335): a, c, t, g, unknown or other
  misc_feature (335)..(335): n is a, c, g, or t
  modified_base (360)..(360): a, c, t, g, unknown or other
  misc_feature (360)..(360): n is a, c, g, or t
  modified_base (392)..(392): a, c, t, g, unknown or other
  misc_feature (392)..(392): n is a, c, g, or t
  modified_base (532)..(532): a, c, t, g, unknown or other
  misc_feature (532)..(532): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagaccctgtccctcacctgcgctgtctctggtgcctccatcagtagtggtttcttctgggctgggtccgnagctcccagggaagggctggaatacattggaagtgtctctcatagtggtaggttcctatacagtccgtctctacaagtcgtcgagtcaccatactctctggacacgtccagcaatcacgttttccngaacgtatgagtttctagtcgaccnccgctcgacgacgggtctttacgtactgtcgngtacggagacggtcttaatagtgtagtttttgggaagtttggtttaactttcgactaccgtagtagttcgggacggggtcctcggaccccgtggggccgtaggtaactacgttcggtacctaccggtacttccgttaacncccgttaccaccggacgggtacccacgttcccggttacccttccccggttacgtccctaccccttccgtacccgtacgaccgtacccg

SEQ ID NO: 142009 - DNA, 664 bp, Homo sapiens
  misc_feature: GYAE6OF02I9IOU.46.67.G01.1.454.CMB.1.raw
  modified_base (222)..(222): a, c, t, g, unknown or other
  misc_feature (222)..(222): n is a, c, g, or t
  modified_base (451)..(451): a, c, t, g, unknown or other
  misc_feature (451)..(451): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgccaaccggtgggagacagtgtccaccatcacttgcccggganaacgtcggaacattgacaccttatttaaattggtatcaacatagaccgagggaccgcccctaagctacctatctatgctgacatccagtttgacgaaaggttcgggtccccagtcggtacggttcaggtcggcgtaggtaggtagttccgtgggaactaaggtctttaccgacttccacaccgtataccgtaagttaactcgttgactaacggtagaaagttagttttnaacttaactttaagtttaccgtagttacaaacctaagttaaacttacctacgtttacggtttaaccggaccgtaaacgggtaacccaacgtaaccttaaacgtaaaacgttaaaaccgtaacgttacgggtcgtacttacgaccgtaaccggttaccttcggtacttcctttactacgttaccccttccgacccttaccttcttaccggtaac

SEQ ID NO: 142010 - DNA, 581 bp, Homo sapiens
  misc_feature: GYAE6OF02IGEGZ.46.67.G01.1.454.CMB.1.raw
  modified_base (207)..(207): a, c, t, g, unknown or other
  misc_feature (207)..(207): n is a, c, g, or t
  modified_base (328)..(328): a, c, t, g, unknown or other
  misc_feature (328)..(328): n is a, c, g, or t
  modified_base (333)..(333): a, c, t, g, unknown or other
  misc_feature (333)..(333): n is a, c, g, or t
  modified_base (341)..(341): a, c, t, g, unknown or other
  misc_feature (341)..(341): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctgtgggctgggtccgnagctccgagggagggctggaatacagttggaagtgtctctcatagtggaggttctattacagtccgtctctcaagagtcgagtcaccatatctctggacacgtcagcaatctagtttcccngaagntgtagttntgtgaccgccgctcgacgtacggtcgtttattctgtcgcgagacgacgtcttatatgttacgttttaggagttgttagttcgtactaccgtagtacgtcggacgggtcgtccgacccgtagggaccgtaagggaactacgtgtccgtacgtcctccttacgccctccgtaccgaacggaccacgttaccgtcccgtttccccgtcgccctacccttaccctacgtacgtaccgtacccgg

SEQ ID NO: 142011 - DNA, 618 bp, Homo sapiens
  misc_feature: GYAE6OF02HF9U6.46.67.G01.1.454.CMB.1.raw
  modified_base (192)..(192): a, c, t, g, unknown or other
  misc_feature (192)..(192): n is a, c, g, or t
  modified_base (420)..(420): a, c, t, g, unknown or other
  misc_feature (420)..(420): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacacctaatttaaattggtatacaacatacgaccagggaccggacccctaagcctacctaatctaatcgctgcactcctagtttcgacgtaaaggtcgggtcccagtcgaggttcaggtggacaggtggatcgtaggacagtattcactctcacatacgaagttaatctagactaaacgtgtaaagttntttacgacttaacttattactcgtaacaacgtaagtaaattactaagtttcggtttaccggaaccgtaacgggaactaaccggtaacttaaactaaaacgttaaacgaacgttagtacggtactacggacctaacctaagttccttacgttaccttacgtactttccccgttcccgtaccctattaccgtacgttaac

SEQ ID NO: 142012 - DNA, 725 bp, Homo sapiens
  misc_feature: GYAE6OF02H4IZQ.46.67.G01.1.454.CMB.1.raw
  modified_base (251)..(251): a, c, t, g, unknown or other
  misc_feature (251)..(251): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactgggtgaggccttcggagaccctgtccctcacctgcgctgtctctggtcgcctccatcagtagtggtttctcgtggggctgggtccgnagcctccgagggaaggggctaggaatacagttggaagtgtactctcatagtggtacggttctaattacaggtccgtctctcaagtagtcgagtcacctatactctcgtcggacaccgtccagcaattctacgttttcccgtagaacgtatcgtagttcgtaggtcggacccgtccgtcgtacggtaccgtacgggttacgttttaacgttacgttcggtacggtcggtaggaccgggtacggtacttaaggtttagttacggtttaaggttttttagggtacggtttacgggttttacgttttacccggtaaccgtaccccgtttaagggtacggttaccgggaccggggggttacccttacccggggtacccccgggttcgggggtacccgaacggggttaacctaccggttacgggtacccgttaccccggttccgtttaccccgttacccggtaccccgttaacccccggg

SEQ ID NO: 142013 - DNA, 650 bp, Homo sapiens
  misc_feature: GYAE6OF02IOCWC.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccggcagctcccgagggaaggggctggaatactagttgggaagttcgtctctcatagtggaggttcctattacacgtccgtctcctcgaagacgtcgagtcacctatactctctggaccacgtccagctaactctacgttttcccagaagatgagttctgtcggaccgcgctgaccgtacggggtcttttaatacgtggtcgacggtagacggtacggtactattagtgtttattttgggagtttggttagtttccgacctaccgtagacgtacgggtacggggtcctcggtaccccgtggggaccgtaagggtaacttcgtacggtccgacccggttccgttccgtacgtccctacccgaaccggaccgggtacccacggttcccggttcccgtttccccgtcggtacccctacccccgttacctaaccgaccggactacccgg

SEQ ID NO: 142014 - DNA, 733 bp, Homo sapiens
  misc_feature: GYAE6OF02IA1PH.46.67.G01.1.454.CMB.1.raw
  modified_base (190)..(190): a, c, t, g, unknown or other
  misc_feature (190)..(190): n is a, c, g, or t
  modified_base (216)..(216): a, c, t, g, unknown or other
  misc_feature (216)..(216): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaacgtggganacagtgtcacatcattcggccggganaaggtacggaactgttagacctacttatttaaagttgtatacaacatacgacgagggaccggaccctaagctacctaatctaatgctgctatcctagttttcgacgtaaacggtcggggttacccaagttccggaagggtttccaagggttggacagggttaggatccgtagggaccgtaaggtactttccgaacttcctaccacctaagttctaagttaactccgtagaactaacggtagtaaacgttattttacgactaacttttattacgttacgtaactaacgtaaagttaactttaacgtaacgttttcggtttttaacccggaccggtaaaacgggttaaccgtaaaccggttaaaccttaaaaccttaaaaacggttaaaacccgtaagttaacggggtaccgttacgttaccgtaacccggtaacctaacgtttaccgtttaccggtttacctttaacgttaccgttccccgtttacccgtaacctacgtttaccgttacgttaaaccg

SEQ ID NO: 142015 - DNA, 607 bp, Homo sapiens
  misc_feature: GYAE6OF02FTTOI.46.67.G01.1.454.CMB.1.raw
tcagactagcagtacacgaccggtgctcgatttagagtatacatattggggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacgttcgccgggcaagtccggaacattcgactacctatttaaattggtatcaacatacgaccagggacgcccctaagctcctaatctatgctgcatcctagtttgctaaaggtcgggtacccagtcgaggtttcaggtggacgtagtggatcgtagggacagtactttcactctacaccatacagttaacttcgtagacaaacgtgtaaagttattttagaccttaaacttactttaacgttagtacaaacgtaagtaaactttaactaattcggttttacggaccgtaaggacaacgtaactaaactaaattaaacgattaggtacggtactacgactaactacttcgttacgttcttacctacgtttacccttcccgaccttacttacctagtaaccg

SEQ ID NO: 142016 - DNA, 776 bp, Homo sapiens
  misc_feature: GYAE6OF02F1PY5.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacgttcggccgggacaaaggtccggaaactagttacgaacctaaccttaaatttttaaaacgttgggttaataccaaactaagtacgaacccgaggggaacccggacccccttaaaggccttacctaattacctatcgtctgactactccgtagtttcgacgaaagggttcgggtaccctagttcgtacggtttacaggtcggactaggtggtaactcggttagggaactagttactttaccgtacttcctaccgtaacctcttaaccgtaaagtttaacgtacgtacgtaaccgtaacggttaacgtaagtttacgttttacgaccttaaactttacgtttactacgttacaaacgttaagttaaactttacgttaagtttacggtttaccgggaaccgtaaacggggtaacctaaccggttaaacttaaacgttaaaaacttaaaaccggtacgtttaagggtacggtaccgtaagtaacccgtaaccttacctttacgttacgtttacctttaacccgtacctttaccccgttaccccgtacccgttacgttaccgttattaaccgg

SEQ ID NO: 142017 - DNA, 572 bp, Homo sapiens
  misc_feature: GYAE6OF02GVAMH.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaattggtatcaacatagaccagggacggcccctaagctcctaatctatgctgctatccagtttgacgaaaggtcggggtacccatcggagttcaggtgcagtggatcgtggacagtattcactctacactatcagtaatctagactaacgtgaagttatttgactaacttattacctgtacaactagtaaattacaattcgtttcggaccgaagggaactacggtaaccttaacaaaacgtttaaaccgaattacgtagtacctacgacctacctattccgtacgttacctttactaccttccgttaccccgtcctaacttccgtagtacc

SEQ ID NO: 142018 - DNA, 560 bp, Homo sapiens
  misc_feature: GYAE6OF02FU7AM.46.67.G01.1.454.CMB.1.raw
  modified_base (248)..(248): a, c, t, g, unknown or other
  misc_feature (248)..(248): n is a, c, g, or t
  modified_base (375)..(375): a, c, t, g, unknown or other
  misc_feature (375)..(375): n is a, c, g, or t
  modified_base (435)..(435): a, c, t, g, unknown or other
  misc_feature (435)..(435): n is a, c, g, or t
  modified_base (440)..(440): a, c, t, g, unknown or other
  misc_feature (440)..(440): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttggagaccctgtccctcacctgcgctgtctctggtgcctccatcagtagtgtttctcgtggggctggggtccgnagctcccgagggaaggggctggaatacattggaagtgtctctcatagtggtaggttcctattacgagtccgtctctcaagtagtcgagtcactatatctctgacacgtcagcaatctagttttcccngtaagatgtagttctgtcgaccgccgctcgacgacggtcgtttatactgtgcgagagcgntattntgtagttttggagttggttatttcgactacctagacgtcggacggggtctccggaccccggtggggaccaagggtactacgtcggtaccgtaccgttccgtaccttacgcccctaccccg

SEQ ID NO: 142019 - DNA, 775 bp, Homo sapiens
  misc_feature: GYAE6OF02JW7TM.46.67.G01.1.454.CMB.1.raw
  modified_base (223)..(223): a, c, t, g, unknown or other
  misc_feature (223)..(223): n is a, c, g, or t
  modified_base (240)..(240): a, c, t, g, unknown or other
  misc_feature (240)..(240): n is a, c, g, or t
  modified_base (254)..(254): a, c, t, g, unknown or other
  misc_feature (254)..(254): n is a, c, g, or t
tcagactagcagtacacgaccggtgctcgatttagagtatacatattgggtttggggacctcctgtgcaagaacatgaagcacctgtggtttgtcctcctgctggtggcagctcccagatgggtcctgtccctggtgcaactgcaggtagtccgggcccacgacctggtgaggcccttgggacgaccctgtccctcacctgccgctgtctctggtgcctccancagttgtggtttctcgnggggctgggtccgnacgcctcccgagggtaagggctaggaactacgagttcggaagtcgttctcgtctagtaggtggtaggttccttaattacgtgtaccgtctcgtctaagcgtcgagtccgacctagtacgttactcgtacggtacctaccggttacccaggtaccaacgttacccgttaacggtttttacccccgaagttaagtacgttacgttacggtttaccgttcggtacggacccccgtcggtaccgttacggaaaccgtaccggggtttacccgttttagttaccggtgggtttacgaccgtaaggtacgggtaaacggtcgttaacggtttacgtagttttaggttttacgggtaacgtttggttttaccgttacgtaaacccgtacccgttaaggtacgttacccgggtacggggttacgttacccccggaaccgggttacggggaccggttaaacgggtacccgtttaaggtcccgggtttaccgtaccgttaccgtaaccccgtttgacccccgttaacccgg

SEQ ID NO: 142020 - DNA, 788 bp, Homo sapiens
  misc_feature: GYAE6OF02JOTJQ.46.67.G01.1.454.CMB.1.raw
  modified_base (172)..(172): a, c, t, g, unknown or other
  misc_feature (172)..(172): n is a, c, g, or t
tcagactagcagtacacgaccggtgctcgatttagagtatacatattgggtttgtcctcctgctggtggcagctcccagatgggtcctgtccctggtgcaactgcaggagtcggcccacgactggtgaggccttcggagacccctgtccctcacctgcgctgtctctggtcncctcatctagtagtcggtttctcgtgggcttgggtccgcacgtcctcccgaggggacgggctaggaactacgagttggaacgttggtcctcgtcgaagttaggtgggtacggtttccctaagttaccgtaacgttcccggttcttccgttaacgaaggtacggttcgacgtactaccctaatacttctactcggtacctacgtccagacctacttacgtacgtttttcccaggtaactagttacgattccgtggtccgtaccggcgtctcggtaacggtcggttacgtttactacggttcgtcgcggtacgacggacgtacgttattagttacgttaggttttaggtacggttacgttttacgttaccgaacccgtttaaacccgttaggtaaccggtttcggggtaacccggggtccgttaccccgggttaccccgggtacggggtaaccgttacggggaaccgttacccgggttcggtacccgtacccgtttccgtaccgtttaccgacccgttaccgaaccccggtaaccgggccttaccgttacccggttccccttaccccgggccgtttaaccccacccgtttacccgtacccgtacgtacccgtacccgg

SEQ ID NO: 142021 - DNA, 566 bp, Homo sapiens
  misc_feature: GYAE6OF02FR9IS.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagacagggacggcccctaagctcctaatctatgctgcattccagtttgcaaagtgggtcccatcgagttcagtggcagtggatcgtgggacagtatttcactctcaccatcagtatctgacaacgtgaagtattttagactaactttattacgttagtacaaatacgaaattactaattgttttcgacgtaacgggtacacgtaacttaaactaaacttaaacgtaacgtagtaggtcttagaccgtaacgattaccgttacgttactttcctagtttcccttaccccgtacctacttacctagttaacc

SEQ ID NO: 142022 - DNA, 601 bp, Homo sapiens
  misc_feature: GYAE6OF02IVC8X.46.67.G01.1.454.CMB.1.raw
  modified_base (192)..(192): a, c, t, g, unknown or other
  misc_feature (192)..(192): n is a, c, g, or t
  modified_base (215)..(215): a, c, t, g, unknown or other
  misc_feature (215)..(215): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccggtggganacagtgtcacatcacttgccggnaagtcggaacattgacacctattaatggtatcaacatagaccagggacgcccctaagctcctaatctatgctgctatccagtttgactaaaggttcggggtacccctagttacggaggttcacggtggacgtaggtggtatcgtgggactagtactttcacgtctacacctatacgagtaatcgtagacgtaaacggtagaaagttattttagacttaaacttatacgttactacgtaactagtaaacttactaagttcgtttacggacgtaacgggactaacgtaacttaacgtaaaagttaaaccgaacgtgtcggtactcggacctacgtacttcgttacttccttacgactttccccttaccgtctacttacctacggtaac

SEQ ID NO: 142023 - DNA, 583 bp, Homo sapiens
  misc_feature: GYAE6OF02FF8NE.46.67.G01.1.454.CMB.1.raw
  modified_base (275)..(275): a, c, t, g, unknown or other
  misc_feature (275)..(275): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccggcaagtcggaacattgacacctatttaaatggtatcaacatagacagggacgccctaagcncctatctatgctgcattcccagtttacgactaaaaggtcggggtacccaagttcggaggtttcgaggtgggcaggtgggatcgtagggacgtagtatttcgactctccacctatcaagttaatctagcaacgtgaaacgtattttgacaacttattacgtgtcaaactaagtaattaacaagtttgtttaccggacgtaaacgggaactaacgtaactaaacgtaaaactttaaaccgaactagtacggtctacgtactaaccgtatctacgttcttactaacttccgttaccccgctactctagtac

SEQ ID NO: 142024 - DNA, 689 bp, Homo sapiens
  misc_feature: GYAE6OF02JX419.46.67.G01.1.454.CMB.1.raw
  modified_base (528)..(528): a, c, t, g, unknown or other
  misc_feature (528)..(528): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcgggacgaccctgtccctcacctgcgctgtctcgtggtcgcctccatcagttagttgttttctcggtggggtctcggggtccgcagcctccggaggggaagggctagggaatacgtagttagggaagtcgtctctacagttaggtggtacggttccttaacgttacgacggttcccgtctcgtacgaaggtcgtacggacgttacacctaatactcgtacgacggactaccggtaccaaggacctaacttccgtttacgttttacccgtaaggaacgtatcggttaacgtttcgtacggtaccgaccccggtcgtacttcggaaccggttacgggttacctttacgttaccgnggttcgacggtagaacgcgtatttatttagtgtttagttttggagttttacgtacgttacgaacctcgtaagtacgtccggggacgcgtcccggacggtagggaccgtaagggtactaccggttcggtaccgtaccgttaccgcgttaccgaccctaccgg

SEQ ID NO: 142025 - DNA, 820 bp, Homo sapiens
  misc_feature: GYAE6OF02JXF3A.46.67.G01.1.454.CMB.1.raw
tcagactagcagtacacgaccggtgctcgatttagagtatacatattgggtttggggtagtctcggtcaggacacagcatggacatgagggtccccgctcagctcctgggctcctgctactctggctccgaggtgccagatcgtgacatcgagctgacccagtcctccatcctccctgtctgaccaaccggtggacgacagtcgtacaccattccaactttcggacccgggctaaaggtcggaacatttcgacctaaccttaattttaaactggttaatacgaaactactaagacccgtaagggaccggtaccccttaaggccttacctaaactctattacgacttcggactaactaccgtagtttacggaccgtaaacggttcgggttacccctagttaccgggtaggtttacctacgggttagaccgttaaggtaccggtaagttccggttaaccggggtaaagtacgggttaacttttacccggtaaccttacccgttacggtaacccctaagttaaccgttaacgtaaattcccgttaagcccgttaaacgacgttaaaagttcgttttaacggaacttaaacgtttaacgtttactaacggtttacaaaacgttaacggttaaactaaccttaaagttttcgggttaaaccctaaccgggaaacgggttaactaaccggtaaacttaaacgttaaaacttaaaacggtaaccgtttagagggttacctacgtaccgtaacgttaaacctcgttacggtttacctaactttaacccttccgttaaccccgttataacccgtttcttaaccggtaac

SEQ ID NO: 142026 - DNA, 573 bp, Homo sapiens
  misc_feature: GYAE6OF02JX8N1.46.67.G01.1.454.CMB.1.raw
  modified_base (192)..(192): a, c, t, g, unknown or other
  misc_feature (192)..(192): n is a, c, g, or t
  modified_base (217)..(217): a, c, t, g, unknown or other
  misc_feature (217)..(217): n is a, c, g, or t
  modified_base (228)..(228): a, c, t, g, unknown or other
  misc_feature (228)..(228): n is a, c, g, or t
  modified_base (259)..(259): a, c, t, g, unknown or other
  misc_feature (259)..(259): n is a, c, g, or t
  modified_base (404)..(404): a, c, t, g, unknown or other
  misc_feature (404)..(404): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggnaagtcggaacnttgacacctatttaaattggtatcaacatanaccaggacgccctaagctcctaatctatgctgcactcagtttgacgtaagtcgggtacccagttaccgaggttacagtcggacaggttcggattcgtaggggtaacagtatttcaacgtctcgaccagtcagtatctgctaacgngaagtatttgactacgttatactgtcaactagaattactatagtttcgacgtaaggactaacgacttaacaaatttaaacgaacgttacgtagtaccttcgaaccgtctaacttcgttagtccctttagacccgtttccgttaccccgcgttaacttcgttacttaacg

SEQ ID NO: 142027 - DNA, 816 bp, Homo sapiens
  misc_feature: GYAE6OF02FF3CX.46.67.G01.1.454.CMB.1.raw
  modified_base (191)..(191): a, c, t, g, unknown or other
  misc_feature (191)..(191): n is a, c, g, or t
tcagactagcagtacacgaccggtgctcgatttagagtatacatattgggtttggggagtctcggtcaggacacagcatggacatgagggtcccgctcagctcctggggctcctgctactctggctccgaggtgccagatgtgacatcgagctgacccagtctccatcctcctgtctgcaaccggtggganacagtgtcaccatccacttcggccgggcaaaggtcgggaactatttcggacctaacccttaattttaaaacgttgggttaactcaaactattaacggaacccagggggtaaccggaccccccttaaaggccttaccgttaacttcctaattcggtctcgactacttccctaggttttgacgtaaaaggtcggggggttacccaagttcggtaacggtttcaagggttcggccgtaagggttcggaacttccgtacggggacaacggtactttccaaccttcgtacctaaccctaagtttaccgaagtttaacttcgtacggtaccgtaaacggttacgtaaacggttactttttaggtaaccttaaaccttttaacgttttaaccgttacgggttaacctaaaaccgtaaacggttaaaacttttaaccgtaaagttttacggtttttacccgggaaccgttaaaacggggtaccgtaaaccgtaacgttaaacctaaaacgtttaaaaccggaaacgttcgggttacgggtactacggtacccgaaaccgtaactttaccgtagttacccttaccgtacctttacccgttacccccggtacttaccgttaccgttacgtaaccg

SEQ ID NO: 142028 - DNA, 575 bp, Homo sapiens
  misc_feature: GYAE6OF02GWMHF.46.67.G01.1.454.CMB.1.raw
  modified_base (426)..(426): a, c, t, g, unknown or other
  misc_feature (426)..(426): n is a, c, g, or t
  modified_base (544)..(544): a, c, t, g, unknown or other
  misc_feature (544)..(544): n is a, c, g, or t
  modified_base (551)..(551): a, c, t, g, unknown or other
  misc_feature (551)..(551): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtccctcacctgcgctgtctctggtgcctccatcagtagtggtttcttctggggctgggtccggcagcctcccaggggaagggctggaatacattggaagtgtctctcatagtggaggttcctattacagtccgtctctcaagagtcgagtcaccatatctctggacacgtccagcaatctagttttcccctgaagactgagttctgtcgaccgccgctcgacgacggggtcgttttaattacgttgtgcgagagacggtctattatgttagttttaggngttggttatttcgaactcccgtagagtcggacggggctccgacccgtggggaccgagggactacgtgtccaccgtctccgtcgcctccgacgacggcccacgtccgtccttcccccgnggtcccncccgttccctaccacggctacccg

SEQ ID NO: 142029 - DNA, 684 bp, Homo sapiens
  misc_feature: GYAE6OF02IBPXZ.46.67.G01.1.454.CMB.1.raw
  modified_base (213)..(213): a, c, t, g, unknown or other
  misc_feature (213)..(213): n is a, c, g, or t
  modified_base (239)..(239): a, c, t, g, unknown or other
  misc_feature (239)..(239): n is a, c, g, or t
  modified_base (256)..(256): a, c, t, g, unknown or other
  misc_feature (256)..(256): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctatccctggtgcaactgcaggagtcgggcccacgactggtgaggccttacggagaccctgtccctcacctgcgctgtctctggtcncctccatcagtagtcggtttcttcgnggggctaggggtcccgnacgcctaccgaggggaagggctaggaatacagttggaagtgtctctcatagtggacgttctattacgacgtccgtctctctaaggtagtacgagtaccacctatacgtcctacgtggacaaccgtccagacaactctacgttttacccagaactagtcgaagtttctggtacgacccgacgcgttacgaacggtacggttacggttttacttaccggtagttcgacggtaacggtacggtaccgtagttaacgtttaagtcggtttaagttttgggaagtttacggttttatttaccggaaccttaccgtaagtagttaccgggaccgggggtccttacccgggtacccggtaggggacccggtaaagggtaacttacggtacgggtacctacccggttccgtaccgtttaccggcccttaaacccgg

SEQ ID NO: 142030 - DNA, 727 bp, Homo sapiens
  misc_feature: GYAE6OF02H6077.46.67.G01.1.454.CMB.1.raw
  modified_base (349)..(349): a, c, t, g, unknown or other
  misc_feature (349)..(349): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggcctttcggagaccctgtccctcacctgcgctgtctctggtgcctccatcagttagtggtttcttcgtggggctgggtccgcagcctccgagggagggctggatacagttggaagtgtctctcagttaggtggtaggttccttaattacagtccgtctctcaagagtcgtagtcaccattatctctggacaccgtccagcaatctagttttcccagaanatgacgttctgtcgaccgccgtcgtcgacgtacgggtcgttttaacttacgtggtacgtccggtaagacgggtaccggtcctttaagtttagttacggtttaagttttttggggaaggtttggttttagttttaccggaccttaacccgtagtacgttcggggaccggggtccgttacccggacccccgggttaggggacccgtaaggggtaaacgttaccggttacgggttcccgtacccggtccgttacccgttaccgtccccgttacccgaacccggtaacggggccccctaacggttccccggtttccccgttaccccccggttcggacccctacccccgttccccgtaaccctaaccggtaccgtacccccgg

SEQ ID NO: 142031 - DNA, 644 bp, Homo sapiens
  misc_feature: GYAE6OF02HMCDK.46.67.G01.1.454.CMB.1.raw
  modified_base (309)..(309): a, c, t, g, unknown or other
  misc_feature (309)..(309): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgagggaagggctggaatacagttggaagtgtctctcatagtggaggttcctattacagtccgtctctcaagagtcgagtcaccatatctcnggacacgtcagacaatctagttttcccctagaagatgagttctgtacgaccgcgctgacgtacgggtcgtttattacgtgtcgtcggagtacgacgggtacttaacgttattaggttagtttttcgggaaggtttggttttacgtttaccgtaacctaccccgttaagtacgtacgggaccgggggtccgtaccggtaccccggtggggtcccgaagggtaactacggttcggtaccgtaccgtccgttaccgttacgccctaccgaccgaaccgggccctacgtccggttcccttccccgtcggaccctaccccttcctaccgacgcgtacccg

SEQ ID NO: 142032 - DNA, 718 bp, Homo sapiens
  misc_feature: GYAE6OF02GY3WI.46.67.G01.1.454.CMB.1.raw
tcagactagcagtacacgaccggtgctcgatttagagtatacatattgggtttgggggacctcctgtgcaagaacatgaagcacctgtggtttgtcctccagctggtggcagctcccagatgggtcctgtccctggtgcaactgcaggagtcgggcccacgactggtgaggccttcggacgaccctgtccctcacctgcgctgtctctggtcgcctccatcagttagtggtttctcgtggggcttggggtccgcagcctccgaggggaagggctaggaatacagttggaagtgtctctcagtagtggtaggttcctattacacggttcctctctacgaagtgtcgagtccaactatactctcgtacggactaccggtcacgctaaatcgttaacgttttcccaggtaaacgtatacggtacgttcgtcgtacggacccggtccgtcgtacggaccgtaccggggttacgttttaacgttacgtggttcggtacggtaaggtacggaaccgggtactttaacgtttaggttacgttaggttttttaggagggttttaggtttaacgtttccgtaaaccgtacccgtaagttacgacccggggttaccggggtacctaccccgggacccgggtagggggaccccgtaagggtaaacccgttcgttaccgggttaccgtaacccggttccgttacccgtttaccggccccttaaccccggg

SEQ ID NO: 142033 - DNA, 951 bp, Homo sapiens
  misc_feature: GYAE6OF02J048U.46.67.G01.1.454.CMB.1.raw
  modified_base (226)..(226): a, c, t, g, unknown or other
  misc_feature (226)..(226): n is a, c, g, or t
  modified_base (281)..(281): a, c, t, g, unknown or other
  misc_feature (281)..(281): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcagggagtccgggcccacgactgggtgacgggtcccttcgggacgaccccttgtcccctcacctgcgcttgtctcgtggtcnccctaccatcaggttagttcggttttctcggtgggggccttcgggggtacccggnacggtcccttacccggaaggggtaacgggggcgtacgggaacttaccgtagtttagggaaacggttcgtccttccgtacgtaacgttaggttggggtacggtttacccgttaagtttaccggaacggttcccggttaccgttaccttacgaaacgggtacggttaccggtaacggttaccaacccgtaagttaaccgttcccgttaccggttacgggtaaccgtaacccggttacccgaaacggtacctaaacgttacccgtttaaccgttttttacccccgtaaggtaaaggtacgttacggttaacggttttacccgtggtaacccggaccccggtcccggtacgtacgggtaacccggttaaccggggtttacctttttaacgttaaccggtcggttacgggtaccggtaacgggttaaccgggtaccggtacgttttaacgtttagtttaagggttttacggttttttacggggtaagttttacgggttttaaccgtttacccggtaaccgttaacccgggttaagttaaccgggttacccggggtacggggtacccgttaacccgggcccccgggttaggggacccggttaaacgggtaacgtttaccggtaccggttaccctaacccgggttcccttacccggttaccgtccccgtaaccccgg

SEQ ID NO: 142034 - DNA, 705 bp, Homo sapiens
  misc_feature: GYAE6OF02JZ2QN.46.67.G01.1.454.CMB.1.raw
  modified_base (209)..(209): a, c, t, g, unknown or other
  misc_feature (209)..(209): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtgggctgggtccgnagctccgagggagggctaggaatacattggaacgtgtctcgtcataggtggaggttctattacgagtccgtactcgtctaaggagtcgagtccaaccgtatactctacgtggaccacgtccagccaattctacgttttccctagaacgtagtgtagttctgtacgaccgtccgacttgaccgtacgggttcttttagttaccgtgtcggacgtaggaacgtacggtacttagttaagttgtttaagttttacgggtaggttacggtttagtttacggtaccgttaaccgttacgacggttacgggtaccgggtaccgttcccggtacccgggtacgggcccggtaagggtaccgtacgttacgggtccgtaacccgtcgttaccgttaccgtccgtacccgtaccggacgggtaccctaacggttcccgttaccccttacccccggtacggtacccctaccccgttaccccgtaccggtaaccgtacgtaaccccg

SEQ ID NO: 142035 - DNA, 616 bp, Homo sapiens
  misc_feature: GYAE6OF02FO53D.46.67.G01.1.454.CMB.1.raw
  modified_base (252)..(253): a, c, t, g, unknown or other
  misc_feature (252)..(253): n is a, c, g, or t
  modified_base (325)..(325): a, c, t, g, unknown or other
  misc_feature (325)..(325): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctatccctggtgcaactgcaggagtcgggcccacgactggtgaggccttcggacgaccctgtcccctcacctgccgctgtctctggtcgcctccatcagtagtgtttctcgtggggctgggtccgnngcctcccgagggagggctggaatacgagttggagtgtctctcataggtggagttcctattacagtcctctcnaagtgtcgagtcaccatactctctggactccgtaccagacaactccttacgttttccctagaacgtattcgtacgtttctcggtacgaccgcccgtcgtacgaccgtcgggttacgtttatcgttggtcgcgtaggagacgtcttattagttgttagttttaggtagttggtttacttcgacctaccgtagacgtcgggacgggtcctaccggtacccggtcgggaccggtaagggtacttacggtcggtccgtaaccccgttcgttacccggttacgcccgtaaccccgg

SEQ ID NO: 142036 - DNA, 689 bp, Homo sapiens
  misc_feature: GYAE6OF02H2WCZ.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtccaccatcacttcgccgggacaagtcggaacattgacctaccttaatttaaacgttggtattacaactatacgaccgaagggaccggacccctaagcctacctaatccgtatcgtctgactattccgtatttcacgtaaaggttcggggtaccctagtaccggtaggttccaggtcggcgtagtaggacgttcgtagggtaactagtactttcaccgttctaccaccgtatactaaagtactctacgacgtaaagtagtaaagttgtttacgattaaacgttttattacgttataactaacgtaattaattaaccgtattttcggtttaaccggaacctaaaggggtaccaacgttaaaccgtaaacgtaaaacgtttaaacgaacgttggtacggtacctacggtacctaaccttcgttccgttaactttcctttaccgtaaccgtttccccggtttaacccctaccgtttactcgttacgttaacccg

SEQ ID NO: 142037 - DNA, 685 bp, Homo sapiens
  misc_feature: GYAE6OF02GXQFK.46.67.G01.1.454.CMB.1.raw
  modified_base (671)..(671): a, c, t, g, unknown or other
  misc_feature (671)..(671): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccggtgggagacagtgtacaccatcacgttggccgggacaacggtcggaactattcgaactaaccttaattttaaacgttggtaataccaaacattacgaaccgaaggggaccggcccctaaagcctacctaaatctaactgtctcgctaactcctagtttacgacgtaaacggtcgggttaccctagttaccgggtaggtttaccgaggtcggactagggtaggtagttcgtagggaacgtaggtactttaccgtaaccttcgtacctaccgtaactacgtaagttaactccgtagaaccgttaaacgtagttaaagttacgttttacgtaacttaaactttacttacgttagttacaaactagttaaacgttaactaagtttcggtttaccgacggtaacgggtacaagtaacctaaacgttaaaactaaacgtaactggtagtctagaccgtactagttctacgttactacgtacttccgttaccnctacttctagtacc

SEQ ID NO: 142038 - DNA, 599 bp, Homo sapiens
  misc_feature: GYAE6OF02G8J88.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctccgagggaggggctggaatacagttggaagtgtctctcagtaggtggaggttcctattacagtccgtctctcaagagtcgagtcaccatatctctggacacgtccagcaattctacgttttcccagaacgtatgtagttctggtgaccgccgtctggacctacggggtcttttaattacgtgtgcgaggacgagtctaattagtgttagttttgggagtttggttagtttcgtactacctagctcggcgggctccgcccgtggggaccagggtactacgtcggtacctaccgtcttccgttacgccctccgaaccggtaacgggccctacggttcccggtccctttccccgcggtccctaccctcccgtaccgaagccgtaccg

SEQ ID NO: 142039 - DNA, 589 bp, Homo sapiens
  misc_feature: GYAE6OF02I28JK.46.67.G01.1.454.CMB.1.raw
  modified_base (249)..(249): a, c, t, g, unknown or other
  misc_feature (249)..(249): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttgccggcaagtcgaacatgacactatttaatgtatcaanatagaccagggaccggcccctaagctacctaatctatgctgcatcctagtttgacgtaacggtcggggtaccctagtcggtaggttcaggtgcaggtggagtcgtaggacagtacttacactctacacatcagtatctagacaagtagtagttatttacgactaacgttattacctagtacaactagtaacttactaagttcgtttacggaacctaagggactaacgtaactaacgtaaaacttaaagaaccttaggtacgtactacgaccgtaacctacgttacgttacgttcctttaccgtacttacccgttacccgtacctacgttcctacgtaacg

SEQ ID NO: 142040 - DNA, 557 bp, Homo sapiens
  misc_feature: GYAE6OF02HTY5I.46.67.G01.1.454.CMB.1.raw
  modified_base (245)..(245): a, c, t, g, unknown or other
  misc_feature (245)..(245): n is a, c, g, or t
  modified_base (367)..(367): a, c, t, g, unknown or other
  misc_feature (367)..(367): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcggcccacgactggtgaggccttcggagaccctgtccctcacctgcgctgtctctggtgctccatcagtagtggttctctggggctgggtccgnagctccagggaaggggctggaatacattggaagtgtctctcatagtggaggttcctattacagtccgtctctcaagagtgagtcaccatatctctggtacacgtcagcaatcagttttcccngaagatgagtttctgtgaccgccgctgacgacgggtcgttttacttactgttgtcgagagacggctattatgtattttggagttaggttatttcgactaccctaagagttcgacggggtctcccggtcccgtcgggggccaggggtaactacgtcggaccgtaccggttcctccgttagccctaacccgg

SEQ ID NO: 142041 - DNA, 558 bp, Homo sapiens
  misc_feature: GYAE6OF02G1I66.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctggggtccggcagctcccgagggaagggctggaatacattggaagtgtctctcatagtggaggttcctattacagtccgtctctcaagagtcgagtcaccatatctctggacacgtccagcaatctagttttcccctgaagactgagttctgtcgaccgccgctgacacgggtctttatactgtgcgagagacggctattatgtattttggagttggttatttcgacctaccgtagactcggacggggtctcgacccgtgggccgagggacgtacgtcgtcaccgtctcctacgcctccaccgacggcctacgtccgtccttccccgtcggcctaccctcctaccacgacgtacccg

SEQ ID NO: 142042 - DNA, 596 bp, Homo sapiens
  misc_feature: GYAE6OF02GUUB3.46.67.G01.1.454.CMB.1.raw
  modified_base (191)..(191): a, c, t, g, unknown or other
  misc_feature (191)..(191): n is a, c, g, or t
tcagactagcagtacacgaccggtgctcgatttagagtatacatattgggtttggggagtctcggtcaggacacagaatggacatgagggtccccgctcagctcctggggctcctgctactctggctccgaggtgccagatgtgacatcgagctgacccagtctccatcctcctgtctgcaaccgtggganacagtgtcaccatcacttgccgggcaaggtcggaacattgactaccttatttaattggtatcaacatagacagggacgccctaagcctcctaatctatgctgcatcctagtttgactaaggtggggtcccagtcgtaggttcaggtggctaggtggatcgtgggactagtattcactctcaccatcagttatctacgactaacggtgtaagtagtttagactaactttattactacgtacaacgattaacttactaatttacggtttacggaccgtaaacgggaactaacggtaactaaacgtaaaacgttaaacgaacttacgggtacgtcgtacgacctaacctactcgttacgtacctttcgtaaccttccttacccgaccttacgtaccgttatacttacg

SEQ ID NO: 142043 - DNA, 620 bp, Homo sapiens
  misc_feature: GYAE6OF02FP2OX.46.67.G01.1.454.CMB.1.raw
  modified_base (172)..(172): a, c, t, g, unknown or other
  misc_feature (172)..(172): n is a, c, g, or t
  modified_base (300)..(300): a, c, t, g, unknown or other
  misc_feature (300)..(300): n is a, c, g, or t
  modified_base (353)..(353): a, c, t, g, unknown or other
  misc_feature (353)..(353): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagaccctgtccctcacctgcgctgtctctggtncctccatcagtagtggtttcttcgtggggctggggtccggcagcctcccgaggggaaggggctagggaatacagttggaagttgtctctcagtagtggaggttcctatttacagtccgtctctcaagngtcgagtcaccatatctctggacacgtccagcaatctacgttttcccagaagntgtagttctgtgacccgcgctgaacgcgggtctttaatctgtcgcgagaggcggacttagttatgttagttttgggagtttggttacttttcgactaccctagtcgtacggaccggggtctcccggacccgtcggggaccaaggggaacttacgtcggttacgaccggttcctccttacgcccctaccaccggaaccgggtcccctacggttcccggttccccttccccggtcgtccccaccccgtttcccaccgaacgcgtacccg

SEQ ID NO: 142044 - DNA, 556 bp, Homo sapiens
  misc_feature: GYAE6OF02H2AJ6.46.67.G01.1.454.CMB.1.raw
  modified_base (192)..(192): a, c, t, g, unknown or other
  misc_feature (192)..(192): n is a, c, g, or t
  modified_base (217)..(217): a, c, t, g, unknown or other
  misc_feature (217)..(217): n is a, c, g, or t
  modified_base (421)..(421): a, c, t, g, unknown or other
  misc_feature (421)..(421): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggnaagtcggaacatgacactattaatgtatcaacatagccaggacgcccctaagctcctaatctatgctgcatcctagtttgctaaagtcggggtacccatcgtagttcgagtggcagtggatcgtgggacagtatttcactctacacgatacaagtaatctagacgaacgtagtaaagtattttcgaactaactttattaacgtntacaactagtaaacttacaatttgtttaccggaccgtaagggtaaccacgtaactaactaaaagttaaacgaacgtagtacgtactagacctaactacttctagttacttcactttcctcccgctactctagtac

SEQ ID NO: 142045 - DNA, 577 bp, Homo sapiens
  misc_feature: GYAE6OF02G2LOK.46.67.G01.1.454.CMB.1.raw
  modified_base (228)..(228): a, c, t, g, unknown or other
  misc_feature (228)..(228): n is a, c, g, or t
  modified_base (340)..(340): a, c, t, g, unknown or other
  misc_feature (340)..(340): n is a, c, g, or t
  modified_base (365)..(365): a, c, t, g, unknown or other
  misc_feature (365)..(365): n is a, c, g, or t
  modified_base (380)..(380): a, c, t, g, unknown or other
  misc_feature (380)..(380): n is a, c, g, or t
  modified_base (394)..(394): a, c, t, g, unknown or other
  misc_feature (394)..(394): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacnttgacacctatttaaattggtatcaacatagaccagggacggcccctaagctacctaatctatgctgcatccagtttgctaaggtcgggtcccagtcgtaggttcagtggcnggtgatcgtggacagtattcactcncacatacatatcgtncgaacgtgtaagtntttacgacttaactttattactcgtacaactataaatttactaattcggtttaccggacgtaacgggacctaacgtaacttaaactaaacttaaaccgaacgttagtacggtactcggtacctaaccgtattcgttcgttacctttactactttcccttccccgtacctacttaccgtgtaac

SEQ ID NO: 142046 - DNA, 741 bp, Homo sapiens
  misc_feature: GYAE6OF02I5TP6.46.67.G01.1.454.CMB.1.raw
  modified_base (364)..(364): a, c, t, g, unknown or other
  misc_feature (364)..(364): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctccgaggggagggctggaactacagttggaagtgtcctctcatagtggtaggttcctattaccgtacgtccgtcttcctacgaaggagtcgagtaccaacctatactcctcgtaggaccaccgtccagacaattctagtttcccagtaangtgtagttcttcgacgaccgtcgtctacgacgtacggttacgttttagttaccgtgtcggacgtaggacggtacgggtacttaagtttagtagtttagtttttagggtaggtttacggtttactttaccggtaacctaacccgttaggtaccggtccggggtaccgggggtcctttacccgggaccccgggttacggggtacccggtaaggggtaaaccgtttacggtccgggttaccgtacccggttaccgttccgttaccgaccccgttaacccggaacccggtaaccgggtccctaaccggttcccggttacccccgttcccccgttacgggacccccgtaccccttacccgtacccgtacggacccgtacccg

SEQ ID NO: 142047 - DNA, 685 bp, Homo sapiens
  misc_feature: GYAE6OF02F3K6V.46.67.G01.1.454.CMB.1.raw
  modified_base (320)..(320): a, c, t, g, unknown or other
  misc_feature (320)..(320): n is a, c, g, or t
tcagactagcagtacacgaccggtgctcgatttagagtatacatattgggtttgtcctcctgctggtggcagctcccagatgggtcctgtccctggtgcaactgcaggagtcggcccacgactggtcgaggccttcggagaccctgtccctcacctgccgctgtctcgtggtcgcctccatcgagttagttcggtttcttcgtgggctgggtccgcacgtcctccgagggagggctaggaatacgagttggagttcgtctcgtcagttggtggtacgttcctagttaccgagtccgtctctcgaagtgtcgagtccactntactcctcgtggaccacgtccagtctaatccgtacgttttcccagaacgtagtacggtacttcgtggtaccgtacccggcgtacgtacggaccgtaccggggttacttttaacgtaccggttgtcggcggtaacggacggtacgtcgttaatttagtgttaggttttaggtaggttcgtttaagtttccgaaccgttaccgttagtacgttccgggaccgggtccgtacccgcccgggtagggcccgtaagggtactcgtacggttccacgttctaccgtagtccctaccgacggtaaccgtccgtacgttccccggttccttcccccgtgcccctacccgttccctaccgtacggcctacccgg

SEQ ID NO: 142048 - DNA, 602 bp, Homo sapiens
  misc_feature: GYAE6OF02HJJS6.46.67.G01.1.454.CMB.1.raw
  modified_base (508)..(508): a, c, t, g, unknown or other
  misc_feature (508)..(508): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgagggaagggctggaatacattggaagtgtctctcatagtggaggttcctattacagtccgtctctcaagagtcgagtcaccatatctctggacacgtccagcaatcgtacgttttcccagaagtatcgtagttctgtacgaccgccgtctcggacgaccgggtcgttttaatacgttgtcgcggagaggacggtcttaagttatgttagtttttaggagttggttacttcgactacccgtagacgtcgggacggggctacggcccgtgggaccgagggactcgtcgtccnccgtctccttcgcctacccgacgaacgggccctaggttcccggtccttacccccgtggacccctacccctccccgtacccgtagtaccgtcccg

SEQ ID NO: 142049 - DNA, 566 bp, Homo sapiens
  misc_feature: GYAE6OF02GFG2V.46.67.G01.1.454.CMB.1.raw
  modified_base (335)..(335): a, c, t, g, unknown or other
  misc_feature (335)..(335): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgaggggaagggctggaatacattggaagtgtctctcatagtggaggttcctattacagtccgtctctcaagagtcgagtcaccatatctctggacacgtccagcaatcagttttcccngaagatgagttctgtgaccgccgctgacacgggtcgttttatactgtgcgagagacggactattatgtatttttggagttggtttatttcgactacccttagtacgtcggacggggctcggacccgtgggccagggatacgtgtcaccgtctcctagcctccaccgaacggccctacgtccggttcccttccccgtcggccctacccctccctacccgacgtacgtacccg

SEQ ID NO: 142050 - DNA, 599 bp, Homo sapiens
  misc_feature: GYAE6OF02JCMZ7.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgccaacgtgggagacagtgtcaccatcgacttgccgggcaaggtccggaacattgacacctatttaaatggtatcaacatagaccagggacggcccctaagctcctaatctatgactgcatcctagtttgactaaaggtcgggtacccagtcgtaggttccaggtcgcagtggatcgtgggacagtatttcacgtctcacctatctagtatctgacaagtagaagtattttacgtaactttaattacttagttacaactaataacttaactaaattcggttttaccggaccgtaagggtacctaaacgaaattaactaaaagttaaacgtaactagttacggtcgtacgtacgtacctaacttccgttgttacttacctagtttcccgttaccctactacctcgttacgtacttaaccgg

SEQ ID NO: 142051 - DNA, 734 bp, Homo sapiens
  misc_feature: GYAE6OF02G2ZGB.46.67.G01.1.454.CMB.1.raw
  modified_base (153)..(153): a, c, t, g, unknown or other
  misc_feature (153)..(153): n is a, c, g, or t
  modified_base (192)..(192): a, c, t, g, unknown or other
  misc_feature (192)..(192): n is a, c, g, or t
  modified_base (204)..(204): a, c, t, g, unknown or other
  misc_feature (204)..(204): n is a, c, g, or t
  modified_base (273)..(273): a, c, t, g, unknown or other
  misc_feature (273)..(273): n is a, c, g, or t
  modified_base (282)..(282): a, c, t, g, unknown or other
  misc_feature (282)..(282): n is a, c, g, or t
  modified_base (313)..(313): a, c, t, g, unknown or other
  misc_feature (313)..(313): n is a, c, g, or t
tcagactagcagtacacgaccggtgctcgatttagagtatacatattggggtttgtcctcctgctggtggcagctcccagatgggtcctgtccctggtgcaactgcaggagtcgggcccacgactggtgaggccttcggagaccctgtccctnacctgcgctgtctctggtgcctcatcagtgtgttctcgngggctgggccgnagctccgagggagggctggatacattggaatcgtctctcataggtggtaggttccttatacagtccgtntctacaagntcgaggtcacatactctctggacacgtccancaatctacgtttcccagaagtatcgtagttctagtcgaccgtccgactcggacaaccggggtgttttaacgttaccttgggtttacgacgggaaggtaacgggtaccggtacctttaagtttacgtaggtttaacgtttttagggagggtttaggtttaacgtttaccggaaccttaacccgttaggtacgttacggggaaccggggggtaccttcccgggtaaccccggttcgggggtacccggaacgggttaacgttaccggttacgggtaccgtacccgttacccgttacccgttacggtccccttaccgtaacccggtaaccggggtaccctacggttacccgggttcccctttcccccggtacgggtcccctaacccccgttacccggtaaccccgacggtaacccggtaccccgg

SEQ ID NO: 142052 - DNA, 678 bp, Homo sapiens
  misc_feature: GYAE6OF02IPM6T.46.67.G01.1.454.CMB.1.raw
  modified_base (208)..(208): a, c, t, g, unknown or other
  misc_feature (208)..(208): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctgggctgggtccggnagcctccgagggaagggctggaatacagttggaagtcgtctctcatagtggagttctatacgagtccgtctctacgaagagtcgagtcaccatatctcgtaggacctacgtccagtccaaattcgtacgttttccctaggaagtactgtattcgtgtacgaccgccgctacgaccgtacgggtcttttaatccgtaggtcgacgaaggacgaacggtcttaagttagtagttagttttagggtaaggtttcggtttactttccggaacctaccgtaagtacgtccgggacggggtcctaccgggaccccggttagggggacccgaaggggtaacttaccggtacgggtaccgaccgttaccgttcgttaccgtccctacccgtaaccggaaccgggccctaaccggttcccggttacccgtcccccggttcggacccctaccccgtcctaacccgaacgtccgtaccccg

SEQ ID NO: 142053 - DNA, 618 bp, Homo sapiens
  misc_feature: GYAE6OF02GTVA9.46.67.G01.1.454.CMB.1.raw
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacaccttattaatgtatcaacatagaccaggaccgcccctaagctcctaatctatgctgctatcctagtttcgacgtaaaggtcgggtacccagtcggtaggttcaggtggcaggtgatcgtgggactagtactttcactctacaccatctaagtaatcgtacgactaacgtgtaagtatttagactaaactttacttacgttacgtaactaataagtaaacttaactaagttcggttttacgaccggtaacggtaactaaccgtaacttaaacgtaaaacgttaaaccgtaacgttagtacggtacgtacgtacgaacccgtaattaccgttacgttccttacgtacctttacccgttaccccgtaactacttaccgtattaaccg

SEQ ID NO: 142054 - DNA, 619 bp, Homo sapiens
  misc_feature: GYAE6OF02HBH0Z.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaatggtatcaacatagaccaggacggacccctaagctcctaatctatgctgcatcctagtttgactaaaggtcgggtcccagtcgtaggttcaggtcggacgagtggatcgtgggacagtattcactctacacctatacgaagttatcctagactaacgtagtaagtatttagacttaacttattacgttacgtacctaaacgtagtaaattactaagtttcggtttaccggaaccgtaacgggtaacctaaccggtaacttaaacgtaaaacgttaaaccgtaacgttaggtacggtacgtagtacccaaccgtacttacgtcgttaccttacctaccgtttacccttccccgtaccgtacttaccgtagttaaccg

SEQ ID NO: 142055 - DNA, 667 bp, Homo sapiens
  misc_feature: GYAE6OF02I5CE8.46.67.G01.1.454.CMB.1.raw
  modified_base (342)..(342): a, c, t, g, unknown or other
  misc_feature (342)..(342): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtccctcacctgcgctgtctctggtgcctcatcagtagtggtttcttcgtggggctgggtccggcagctcccgaggggaagggctggaatacagttggaagtgtctctcatagtggaggttcctattacagttccgtctctcaagagtcgagtcaccatatctctggacacgtccagacaatctagttttaccccngtaagatagagtttctggtcgacccgccgtcgtcgaaccgtacggggtacgttttacgttacgttggtgtacggaggtacggacgggtcttagtttatgttagtttttgggtagtttagggtttactttacggtaccgtaacccttaggtacgtccgggtaccgggggtccttcccggaccccggtcggggtacccgaggggtaactacggtcggtcgtacccgttccgtccgttagtccctcccgaaccgtaccgggccctacgtccgttccccttaccccgtcggaccctacccccgtccgtacccgtaacggacgtaccccg

SEQ ID NO: 142056 - DNA, 644 bp, Homo sapiens
  misc_feature: GYAE6OF02IF5R7.46.67.G01.1.454.CMB.1.raw
  modified_base (331)..(331): a, c, t, g, unknown or other
  misc_feature (331)..(331): n is a, c, g, or t
  modified_base (349)..(349): a, c, t, g, unknown or other
  misc_feature (349)..(349): n is a, c, g, or t
  modified_base (588)..(588): a, c, t, g, unknown or other
  misc_feature (588)..(588): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtctccatccgtcctgtctgcaaccggtgggagacagtgtccaccatcacgttcggacccggggactaaaggtcgggaaacctagtttaggaacctaaccttaattttaaaagttcggtaattacaaacataacgaccgaagggaccgacccctaagctactaatctaancgctgctatcctagtttnacgtaaaggtcgggtacccagtcggaggttcgagtggactaggtggactcgtggacgtagtaacttccaacgttcctacacctatacaagttaactctagactaagtagtagttatttcgaactacgtttatacgtagtacaagtaagtaatactaagtttacgttacggaaccgaaggtaccaacgtaactaaacgttaaactaaacggaacttagggcgtactacgacctaaccgtnttaccgttacgttctaaccgtcttacccgttaccccgactagttccctagttaacg

SEQ ID NO: 142057 - DNA, 640 bp, Homo sapiens
  misc_feature: GYAE6OF02F9B8I.46.67.G01.1.454.CMB.1.raw
  modified_base (193)..(193): a, c, t, g, unknown or other
  misc_feature (193)..(193): n is a, c, g, or t
  modified_base (231)..(231): a, c, t, g, unknown or other
  misc_feature (231)..(231): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccgtggganacagtgtcaccatccacttggccgggcaaggtcgaacnttcgacaccttatttaaattggtatcaacatacgaccgagggaccggcccctaagcctcctaatctatgctgcatcctagtttgacgtaaaggtcggggtcccagtcgtaggttcgaggtggcgtaggtggatcgtagggacagtatttcacttctacaccatcgaagttaactcgtacgactaacgttagtaaagttagttttacgaccttaaacttactttaacgttacgtactaaacgtaattaaacttaactaagtttacggttttaccggaaccgtaaaggggtacctaaacggtaaccttaaactaaaaacggtttaaaccgaaccgttaggtacggtactacgaccgtaacctacttctacgttacttacgtacttcccgttacccgactacttcgtatacg

SEQ ID NO: 142058 - DNA, 783 bp, Homo sapiens
  misc_feature: GYAE6OF02IIXPB.46.67.G01.1.454.CMB.1.raw
  modified_base (223)..(223): a, c, t, g, unknown or other
  misc_feature (223)..(223): n is a, c, g, or t
  modified_base (358)..(358): a, c, t, g, unknown or other
  misc_feature (358)..(358): n is a, c, g, or t
tcagactagcagtacacgaccggtgctcgatttagagtatacatattgggtttgggggacctcctgtgcaagaacatgaagcacctgtggtttgtcctctgctggtggcagctcccagatgggtcctgtccctggtgcaactgcaggagtccgggcccacgactgggtgacggtcccgttcggacgacccctggtcccctcaccgtgcgctgtctcgtggtcncctcatcagttacgttcggtttctcggtggggcttggggtccgcacgcctaccggaaggggacgggctagggaactacgagttaggagttgtcctctacgagtaggtcggtacgttcctagttacgacgtccgtntactacgaagtcgttccgagtaccaccgtattacgtctacggtacggacctaccgtaccgaagtactaaacgtttccgttaaccgttttcccgaaggtaaacgtcgtttacggtaacgtttcgtcggttaccggaaccccgtccggttacgtaacgggtaacggttacccggggttttacttttaacgttcgtggttacggaaccgggtaaggaccggttaccgtactttacgtttagttaggtttacggtttttagggacgttttacggtttttaccttaccggacccttaacggtacggttacggttaccggggacggggttacccttacccgggaacccggtgggggtaaacctaacgggtaaccttacggtccgggtttaaccaccggtttcccgtaacggtttacccggcctaacccggg

SEQ ID NO: 142059 - DNA, 607 bp, Homo sapiens
  misc_feature: GYAE6OF02HW2DS.46.67.G01.1.454.CMB.1.raw
  modified_base (192)..(192): a, c, t, g, unknown or other
  misc_feature (192)..(192): n is a, c, g, or t
  modified_base (219)..(219): a, c, t, g, unknown or other
  misc_feature (219)..(219): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtcgtcaccatcacttcgccgggnaaggtcggaactattgactaccttatttaaatggtatcaacatagaccgagggacgcccctaagctcctaatctatgctgcatcctagtttcgacgaaaggtcgggtacccagtcggaggttcaggtggcgagtggtatcgtgggaactagtacttcacttctaccacatcagtatctgactacgtagaagtatttacgactaacttattaactcgtaacaactaagtaattaataacgtttcggttttaccggaccgtaaagggtacctaacgtaacttaaacgtaaaagttaaaaccgaaacgttaggtacgtacgtacgaccgtaacctacttacgttacgttaccttctacttccgttacccctacctacgttacctagtaacg

SEQ ID NO: 142060 - DNA, 594 bp, Homo sapiens
  misc_feature: GYAE6OF02JCG14.46.67.G01.1.454.CMB.1.raw
  modified_base (190)..(190): a, c, t, g, unknown or other
  misc_feature (190)..(190): n is a, c, g, or t
  modified_base (214)..(214): a, c, t, g, unknown or other
  misc_feature (214)..(214): n is a, c, g, or t
  modified_base (224)..(224): a, c, t, g, unknown or other
  misc_feature (224)..(224): n is a, c, g, or t
  modified_base (337)..(337): a, c, t, g, unknown or other
  misc_feature (337)..(337): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaccgtggganacagtgtcaccatcacttgccggnaagtcgaacnttgacacctatttaaatggtatcaacatagacagggacggcccctaagctcctaatctatgctgcatccagtttgctaaagtgggtcccagtcgagttcagtgcagtgatcgnggacagtattcactctcacctatcagtaatctgactaacgtgaagtactttgactaacttattacttacgtacaactagtaactttaacgtaacgtttaggttttaccggaaccgttaacggggacctaacggtaaccttaaacgttaaaaccgttaaaacgtaacgttaggttaccgacttcggaaccgtaaccgtacttcgttacttcgtttacctacgtttaccccttcccgtcctaacgttccgttagtaacg

SEQ ID NO: 142061 - DNA, 615 bp, Homo sapiens
  misc_feature: GYAE6OF02I3YYS.46.67.G01.1.454.CMB.1.raw
  modified_base (181)..(181): a, c, t, g, unknown or other
  misc_feature (181)..(181): n is a, c, g, or t
  modified_base (319)..(319): a, c, t, g, unknown or other
  misc_feature (319)..(319): n is a, c, g, or t
tcagactagcagtacacgaccggtgctcgatttagagtatacatattgggtttgggggacctcctgtgcaagaacatgaagcacctgtggtttgtcctcctgctggtggcagctcccagatggggtcctgtccctgggtgcaactgcaggagtcgggcccagactggtgaggccttcgganaccctgtccctcacctgcgctgtctctggtgcctccatctagtagtggttttctcgtggggctggggtccggcagccgtccgagggaggggcgtggaatacagttggaagtgtctctcatagtggtaggttctattanagtccgtctctcaagagtcgagtcacctatatctctggacacgtcagctaactctacgtttcccagtaagtatagtagttctacggtcgaccgtccgcgtacgtacgtaccgggttacgtttagttaccttggcgcgagtaggacgtactagtttatgtttagttttaggtaggtttagtttacgttttaccgacttaacccgtagtacggtacgggtaccggggtctacccggtacccggttggggaccctaagggtactaccggtcgtactcccgttctcctacgtcctaccgg

SEQ ID NO: 142062 - DNA, 586 bp, Homo sapiens
  misc_feature: GYAE6OF02G6V7W.46.67.G01.1.454.CMB.1.raw
  modified_base (447)..(447): a, c, t, g, unknown or other
  misc_feature (447)..(447): n is a, c, g, or t
  modified_base (451)..(451): a, c, t, g, unknown or other
  misc_feature (451)..(451): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccgcagcctccgagggagggctggaatacattggaagtgtctctcatagtggtaggttcctattacagtccgtctctacaagtgtcgagtcacctatactctctggacacgtccagactaactcgtacgttttcccaggtaagtactgtacgtttctgtcgacccgtccgcgtcgacgacgggttctttatacgtgttcgngagngacgtctattatgttatttggtagttgtttattcgactaccctagtacgtcgggaccgggtcgtcccggacccggtcgggccgtaagggtaactacgtcggtccgtacccgttcttacccgttacgccctacccg

SEQ ID NO: 142063 - DNA, 591 bp, Homo sapiens
  misc_feature: GYAE6OF02F0I1P.46.67.G01.1.454.CMB.1.raw
  modified_base (192)..(192): a, c, t, g, unknown or other
  misc_feature (192)..(192): n is a, c, g, or t
  modified_base (406)..(406): a, c, t, g, unknown or other
  misc_feature (406)..(406): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcgaacattgacacctatttaatgtatcaacatagacagggaccgcccctaagctactaatctatgctgcatcctagttgacaaaggtcggggtaccagtcggtaggttcaggtggacagtggatcgtagggactagtacttcactctacacactacagtactcgtagactaacggtgtaaagttnttttacgacttaacttattacgtagtactaaactagtaaattactaagtttacgtttaccggaacgtaacggtactaacggtaacttaaactaaagttaaaacgacgttagtacggtactcgactaacctattacgttcgttaccttacgtactttaccttccccgattacttccgtagtaaccg

SEQ ID NO: 142064 - DNA, 674 bp, Homo sapiens
  misc_feature: GYAE6OF02JUDAO.46.67.G01.1.454.CMB.1.raw
  modified_base (139)..(139): a, c, t, g, unknown or other
  misc_feature (139)..(139): n is a, c, g, or t
  modified_base (193)..(193): a, c, t, g, unknown or other
  misc_feature (193)..(193): n is a, c, g, or t
  modified_base (196)..(196): a, c, t, g, unknown or other
  misc_feature (196)..(196): n is a, c, g, or t
  modified_base (620)..(620): a, c, t, g, unknown or other
  misc_feature (620)..(620): n is a, c, g, or t
tcagactagcagtacacgaccggtgctcgatttagagtatacatattgggtttggggtaggtctcggtcaggacacagcatggacatgagggtccccgctcagctcctggggctcctgctactctggctcgaggtgccngatgtgacatcgagctgacccagtctccatcctccctgtctgccaccggtgganacngtgacaccatcacttggcccggcaacggtcggaaactcttggaacctaccttattttaaaactggttaatacgaacattacgaaccgtacgggaccgacccaagtcctactaactctatgactgactactccgagtttcgctaaaggtcgggtacccaagtcggtaaggttccgagtcggacgtagttcggattcgtacgggtacagtactttcgacttaccgttaccaactaggtacctagtaacttcgtacgactaacggtatacgttatttagacttaacgtactttaactctaccgtaaataacgtaacttaaacgtaatttaccgggttaactaaccgaaaggttaccgaaacgtaacttaaacctaaaggttaaaacctaacggttagttaccgtagttaacctaaccgtaaccgttntaacttccggttacttacttaccgttcgttccccttaatacttactagtaaccg

SEQ ID NO: 142065 - DNA, 515 bp, Homo sapiens
  misc_feature: GYAE6OF02HDJVX.46.67.G01.1.454.CMB.1.raw
  modified_base (494)..(494): a, c, t, g, unknown or other
  misc_feature (494)..(494): n is a, c, g, or t
  modified_base (512)..(512): a, c, t, g, unknown or other
  misc_feature (512)..(512): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaattggtatcaacatagaccagggacggcccctaagctcctaatctatgctgcatccagtttgacaaagtgggtcccatcgagttcagtgcagtggatcgtgggacagtatttcactctcaccatcagtaatctgacaacgtgaagtattttgctaacttattactgtacaacagtaattactattgtttcgacctaagggacacgactaactaaactaaacaatgtagactgaccgtaacatctagtcttanacttcctccgcctatctntac

SEQ ID NO: 142066 - DNA, 698 bp, Homo sapiens
  misc_feature: GYAE6OF02GVXJK.46.67.G01.1.454.CMB.1.raw
  modified_base (396)..(396): a, c, t, g, unknown or other
  misc_feature (396)..(396): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtcccctcacctgcgctgtctcgtggtcgcctccatccagtagtggttttcttcgtggggctggggtccggcacgcctcccgaggggaaggggctggaatacagttggaagtgtctctcatagtggaggttcctattacgagtccgtctctcaagtagtcgagtccaccatatctcgtgacacgtccagcaatctagttttcccagaagtntagagtttctgtcggacccgccggctcgacgtacggggtcttttacgtacgttggtcgacggaagacggtacgggtctttaagttacgttaggttacgttttttagggtacgtttagggttttacttttaccgggaacccgttacccgttaaaggaccggttaccggggaccggggggtcccttacccgggtacccccgggttacggggtaccccgggaaaggggttaaccgttacggtttccgggtacccgttaccccgggttcctttaccccggtttaccgtacccccgttaacccccgg

SEQ ID NO: 142067 - DNA, 502 bp, Homo sapiens
  misc_feature: GYAE6OF02HNEVT.46.67.G01.1.454.CMB.1.raw
  modified_base (387)..(387): a, c, t, g, unknown or other
  misc_feature (387)..(387): n is a, c, g, or t
  modified_base (413)..(413): a, c, t, g, unknown or other
  misc_feature (413)..(413): n is a, c, g, or t
  modified_base (418)..(418): a, c, t, g, unknown or other
  misc_feature (418)..(418): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacgcccctaagctctaatctatgctgcatccagtttgcaaagtgggtcccatcgaggttcagtggcagtggatcgtgggacaggatttcactctcaccatcagtatctgcaacgtagaagtntttgctaacttatacttgtacaacanaattnactaatgtttcgactaaggacacgtactaacaaataaacgactagtgactgcactatctgtcttcacttctcccgctatctacg

SEQ ID NO: 142068 - DNA, 647 bp, Homo sapiens
  misc_feature: GYAE6OF02JDHLF.46.67.G01.1.454.CMB.1.raw
  modified_base (192)..(192): a, c, t, g, unknown or other
  misc_feature (192)..(192): n is a, c, g, or t
  modified_base (352)..(352): a, c, t, g, unknown or other
  misc_feature (352)..(352): n is a, c, g, or t
tcagactagcagtacacgaccggtgctcgatttagagtatacatattgggtttggggagtctcggtcaggacacagcatggacatgagggtccccgctcagctcctggggctcctgctactctggctccgagtgccagatgtgacatcgagctgacccagtctccatccctcctgtctgctaaccggtgganacagtcgtcaccatcacttcggccggacaaggtcgaactattacgactacttaatttaagtggtatcaactagtacgaccgagggtaccgaccctaagcctactaactctatcgctacgactatcgtagttcacgtaaggtcggtaccagtcgtacgttnacggtgactaaggtcgtatcggtaggactacgttcgttacacttacgtaccacgtagtactagtaacttctacgacgtaagtcttagttatttcgaacttacgttactacgttcgtaactaagttaacgtacttaagttcgttaggttaccggaacgtaacggtactaaccgtaacgttaaacgtaaaccgtaaagtacgttacgtacggtacctaagtacccggtaattacgttccgttaacgtacccgttagtaacccgtttccgtacccgtacgttctacgttagtaacccg

SEQ ID NO: 142069 - DNA, 772 bp, Homo sapiens
  misc_feature: GYAE6OF02JFO43.46.67.G01.1.454.CMB.1.raw
  modified_base (170)..(170): a, c, t, g, unknown or other
  misc_feature (170)..(170): n is a, c, g, or t
  modified_base (214)..(214): a, c, t, g, unknown or other
  misc_feature (214)..(214): n is a, c, g, or t
  modified_base (241)..(241): a, c, t, g, unknown or other
  misc_feature (241)..(241): n is a, c, g, or t
tcagactagcagtacacgaccggtgctcgatttagagtatacatattgggtttggggacctcctgtgcaagaacatgaagcacctgtggtttgtcctcctgctggtggcagcctcccagatgggtcctgtcccgtggtgcaactggcaggagtcgggcccacgactggtnaggccttggagaccctgtccctcaccgtgcgctagtctctggtnccctccatcaggtagttgttcttacgnggggctagggtccgcaggcctcccgtaggggaacgggtcgtaggaactacgtaggttaggaagtcggtaccgttcgtaccgagttaggtagggttacggttcccttagttaccgtaggttcccgtcttccgtaccgtaaaggacgttacggtaaccggtcaacccgtaattactaccgttacgtaccggaactaccggttacccacggtaactaacgtccgtaaaccgtttttccccaggtaaacggtcgttaacgtacgtttccgtacggttaccgaccggtaccccgtcgtacgtaaccggtaccgggttcggtttaacttccgtagggttcgtacgtacgggaacggtcggttaactaacgtttagtaacgggtttagtttttacggggtgtttaacggtttacgttaccggttactaacccgttagtcgtaaccgggtcggggcttacccgggaccgttcggggactaacgggtactaccggtacggtccgtaacccggttcgtaacgttaccggcccttaacccgg

SEQ ID NO: 142070 - DNA, 662 bp, Homo sapiens
  misc_feature: GYAE6OF02JVCRM.46.67.G01.1.454.CMB.1.raw
  modified_base (232)..(232): a, c, t, g, unknown or other
  misc_feature (232)..(232): n is a, c, g, or t
  modified_base (617)..(617): a, c, t, g, unknown or other
  misc_feature (617)..(617): n is a, c, g, or t
tcagactagcagtacacgaccggtgctcgatttagagtatacatattgggtttggggaggtctcggtcaggacacagcatggacatgagggtccccgctcagctcctggggctcctgctactctggctccgaggtgccagatgtgacatcgagctgacccagtctccatcctccctgtcctgacaaccgtgggacgacagtgtcaccatcacttgccggcaaggtccggaanagttcgacaccgttaatttaaacttggtaatctaacaagttacgaccagggaccggacccctaaggcctaccgtaataccgtaattcgacttcgactacgtctacgtttacgtacgtaaacggttaccggggtccctaagtacggtacggttaccagggtcgacgtacggtgtagttcgtagggactagtattcacgtctcaccgatctagtactctacgactaacggtagtattagtttacacgtaactttacttacgttacgttacaaacgtagtaaacttactaatttacggttttacgaaccgtacgggtaacctaacggtaacctttaaacaaacgtttaaacgaacggtattacggattacgacctaacctagtttacncgttaccttactacgttaccgtacccctagtaactccgtataacg

SEQ ID NO: 142071 - DNA, 681 bp, Homo sapiens
  misc_feature: GYAE6OF02F9G41.46.67.G01.1.454.CMB.1.raw
  modified_base (224)..(224): a, c, t, g, unknown or other
  misc_feature (224)..(224): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtggagacagtgtcacatcacttgccggacaagtcgaacnttgactacctatttaaagtgtatcaacatagaccagggacgacccctaagctacctaatctatgctgctactcctagtttcgacgtaaaggtcggggtaccctagtacggtaggttctggtcggcgtaggtggatcgtggggctagtacttcgactcctaccactatacaagttaactcgtacgactaaacggtagtaaacgttaagttttacggtaacttaaaccgtttaatttaaccgttacgtaacctaaaacgtaacgttaaactttaaccgttagttttacggttttaccgggaaccgtaaacgggaaccctaaacgtaaaccgttaaacgtaaaacttaaaacgtacgttaggttacgtaccgtacgtaccctaaccgtacttccgttacgttaccgtttacctaaccgtttcccgttaccccgtacccttacgttaccgttagtaacccg

SEQ ID NO: 142072 - DNA, 613 bp, Homo sapiens
  misc_feature: GYAE6OF02GX8FW.46.67.G01.1.454.CMB.1.raw
  modified_base (219)..(219): a, c, t, g, unknown or other
  misc_feature (219)..(219): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacgttgccggganaagtcggaacattgactactatttaaatggtatacaacatagaccagggaccgacccctaagcctacctaatctatcgctgcatcctaggtttcgactaaaggtcgggtaccctagtcggtaggttcgaggtcggcgtaggtggatcgtaggggacagtatttcacttctcgacatacgtaagtaactcgtacgtacaacggtagtaaagttatttacgacttaaactttacttacgttagtacaaacgtagttaaacttaacgtatttcggtttaccgaacgtaacggtacaacgtaacttaaactaaacgttaaacgtaacgtagtagtactacgacctaactactacttacgttacttactacgttcccttaccgactacttctacgtacg

SEQ ID NO: 142073 - DNA, 569 bp, Homo sapiens
  misc_feature: GYAE6OF02GQ3F2.46.67.G01.1.454.CMB.1.raw
  modified_base (193)..(193): a, c, t, g, unknown or other
  misc_feature (193)..(193): n is a, c, g, or t
  modified_base (357)..(357): a, c, t, g, unknown or other
  misc_feature (357)..(357): n is a, c, g, or t
  modified_base (562)..(562): a, c, t, g, unknown or other
  misc_feature (562)..(562): n is a, c, g, or t
tcagactagcagtacacgaccggtgctcgatttagagtatacatattggggtttggggagtctcggtcaggacacagcatggacatgagggtccccgctcagctcccggggctcctgctactctggctccgaggtgccagatgtgacatcgagctgacccagtctccatcctccctgtctgcaaccgtggganacagtgtcaccatcacttgccgggcaagtcggaacattgacacctatttaaattggtatcaacatacgaccagggacgcccctaagctacctatctatgctgcagtcctagtttgacgtaaaggtcggggtcccagtcgtaggttcaggtggcaggtggatcgnggacagtattcactcacacatcaagtatctagactaacgtgaagtatttagacttaattatactgtacaatagtaacttacatttcgttacggacgaagggtactaacgaactaacgtaaaacttaaaccgaacgttagtacgtacgtacgactaactacttacttacgtaccttacacttacccgttcccgacttactcgttanacttacg

SEQ ID NO: 142074 - DNA, 649 bp, Homo sapiens
  misc_feature: GYAE6OF02GKFHQ.46.67.G01.1.454.CMB.1.raw
  modified_base (340)..(340): a, c, t, g, unknown or other
  misc_feature (340)..(340): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggacaagtcggaacattgacacctatttaaatggtatcaacatagaccagggaccggcccctaagctacctaatctatgctgctatccagtttgacgtaaaggtcgggtacccatcggtagtcagnggacgagtggatcgtaggacagtactttacgactcttacacctatacgaacgttaatacgtcgacctaaacggtagtaagttactttttacgttaaactttatttacgtaggttaaccaaactaagtaaatttaactaaagtttacggtttttaccggacgtaaacgggtaccaaaccggtaacttaaaccgtaaaactttaaaaccgtaacgttagttacggtaccttaggacctaacctaacgttacctttacgttaacctttcttaaccttccgtttacccgaccttacttcgttacgtattaccg

SEQ ID NO: 142075 - DNA, 604 bp, Homo sapiens
  misc_feature: GYAE6OF02IQV6V.46.67.G01.1.454.CMB.1.raw
  modified_base (342)..(342): a, c, t, g, unknown or other
  misc_feature (342)..(342): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccggcaagtcggaacattgacactattaatgtatcaacatagaccaggacgccctagctctaatctatgctgcatccgtagtttgacgtaaaggtcgggtcccagtcgtagttcagtggctagtggatcgnggacagtattcactctacactactactagtaactcgtacgactaacgtagtaaagttatttagaccttaactttacgttacttacgtactaaacgaagttaaacttaccgtaaagtttcggttttaccggaccgtaaagggtaacctaaccgtaacttaaacctaaaagttaaaccgtaaacgtgtacggtactacgtaacctactaacttcttcgttaccttacgtaccgttaccgttccccgacctacttcgtagtaacc

SEQ ID NO: 142076 - DNA, 653 bp, Homo sapiens
  misc_feature: GYAE6OF02HJK9E.46.67.G01.1.454.CMB.1.raw
  modified_base (192)..(192): a, c, t, g, unknown or other
  misc_feature (192)..(192): n is a, c, g, or t
  modified_base (401)..(401): a, c, t, g, unknown or other
  misc_feature (401)..(401): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttggccgggacaagtcggaacattgacaccttatttaaattgtatcaacatagaccagggacggcccctaagctcctaatctatgctgcatccagtttgacaaaggtcggggtcccagtcggaggttcaggtggctaggtggatcgtgggacagtatttcactctcaccatcagtatctgactaagtgaagtntttacgactaacttattacttcgtacaactaagtaacttaactaagtttcgttttaccggaccgtaacggggaacctaaccggtaacttaaaccgtaaaaacgtttaaaaccggtaaacgtttacgggttacgggtaccgttaacggtacccgtaaccgtacgtttaccgttaccggttttaccctttaaccgttacccgttttaccccgtttacccccgtacccgttaacgtttccgttaacgttaacccg

SEQ ID NO: 142077 - DNA, 630 bp, Homo sapiens
  misc_feature: GYAE6OF02HVU61.46.67.G01.1.454.CMB.1.raw
  modified_base (375)..(375): a, c, t, g, unknown or other
  misc_feature (375)..(375): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctcgacccagtctccatcctccctgtctgcaacggtgggagacagtgtcaccatcacgttggccgggacaaggtcggaaactagttcgaacctaaccttaattttaaagttggtaactacaaactataacgaccgacgggaccggtacccctaagccttacctaatctaatgctgctatccgtagtttcgacgtaaggtccgggtacctagtcgtacggttnaggtggcgaggtggacgtcggtagggaacagttacttacacttcctacaaccatacgtatactctacgactaaggtagtaagttactttagacttaatttataacttcgtaacaatagtaactatacgtttcgttaccgaacggtaggtaaccaacgtaactaaataaacgtaaacgaattcggtagaccgtacgacctaactcgttatcgttacttccgaacctttcccgtacccgtctacgttccgtaagtac

SEQ ID NO: 142078 - DNA, 506 bp, Homo sapiens
  misc_feature: GYAE6OF02FK7M3.46.67.G01.1.454.CMB.1.raw
  modified_base (350)..(350): a, c, t, g, unknown or other
  misc_feature (350)..(350): n is a, c, g, or t
  modified_base (358)..(358): a, c, t, g, unknown or other
  misc_feature (358)..(358): n is a, c, g, or t
  modified_base (371)..(371): a, c, t, g, unknown or other
  misc_feature (371)..(371): n is a, c, g, or t
  modified_base (476)..(476): a, c, t, g, unknown or other
  misc_feature (476)..(476): n is a, c, g, or t
  modified_base (485)..(485): a, c, t, g, unknown or other
  misc_feature (485)..(485): n is a, c, g, or t
  modified_base (495)..(495): a, c, t, g, unknown or other
  misc_feature (495)..(495): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgagttcagtgcagtgatcgtgggacagtnttcactcncacatcagtatcngacaagtgaatatttcgactaacttattacgtgtacaatagtaattactaattgtttacgacgaagggacaacgactaacaaattaaacgactgtgctgacaacntctgtcttnactcgtcccnctactctgtac

SEQ ID NO: 142079 - DNA, 698 bp, Homo sapiens
  misc_feature: GYAE6OF02IAHQT.46.67.G01.1.454.CMB.1.raw
  modified_base (208)..(208): a, c, t, g, unknown or other
  misc_feature (208)..(208): n is a, c, g, or t
  modified_base (251)..(251): a, c, t, g, unknown or other
  misc_feature (251)..(251): n is a, c, g, or t
  modified_base (273)..(273): a, c, t, g, unknown or other
  misc_feature (273)..(273): n is a, c, g, or t
  modified_base (288)..(288): a, c, t, g, unknown or other
  misc_feature (288)..(288): n is a, c, g, or t
  modified_base (360)..(360): a, c, t, g, unknown or other
  misc_feature (360)..(360): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggcctttcggagaccctgtccctcacctgcgctgtctctggtcgcctcatcagtagtgtttctcgtgggctgggtccgnagctccgagggacgggctaggatacagttaggaagtgtctctnataggtggtaggtcctattacngtccgtctctcaagngtcgagtcaccatatctcaggacacgtccagctaactcgttacgttttcccaggtaactagtagtaccgttnttacgtacgacccgctcgtacgacgtacggggtcttttaataccgtagtcggaacgtaggtaacggtaccggtactttaaagttacgttacgtttaggtttttacgggaacgtttggtttttaaacgtttaccgaacctacccggtttaagacggttccggggacccgggtaccggtcccgttacgggaccggtaaggtacgtacgttccggtactaacccgtcgttaccgttacgtccctacccgaccggtaacccgccgtaccgttacccggttcccgttcccccgtcggtacccgtacccctaccgttacccgaatacccggtacctaccccggg

SEQ ID NO: 142080 - DNA, 1051 bp, Homo sapiens
  misc_feature: GYAE6OF02I0E7Y.46.67.G01.1.454.CMB.1.raw
  modified_base (193)..(193): a, c, t, g, unknown or other
  misc_feature (193)..(193): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgtcaccatcacttcgccgggacaacggtccgggaaactagttcgaacctaacccgttaattttaaaacgttggttaacttaccaaacctaagttaacggaacccgaacggggaaccggaccccccttaaaggtaccttacccttaaacttccttaagtcggtccttacggacctacgttaccctaggttttacggaaccgtaaaacgggttccgggggttacccctaaggttaccgggtacgggtttaccgtaacgggttacggtaccgtaagggttacgggtaacgttccggttaacgggggtaaaccgtaacggtttaacttttacccgtaaacctttaccccgttaacccggtaaaccccttaacgtttaacccggtaaacggttttaaaccgttacccggttaaccggttaaacccggttaaaaccgggtttaacgggttaaaacggttttaaacggttttttaaccggtaaacccgttttaaaaaccttttaacgttttaaaccgttaacggtttaaaccccgtaaaaaccggttaaaaccggtttaaaacgtttaaaccgttaaaacggttttaaccgggttttttaaacccgggaaacccgggttaaaacccggggtaaaacccgttaaaacccggttaaaacccgtttaaaaaaccgtttaaaaaaccggtttaaaaaccggttaaaaccgtttaacggggtttaaccgggttaaccgttaccggtaacccgtaaacccgttaaccgtttacccggttaaccgtttaacccgttttacccgttaacccggtttaccccgtttacccccggtaacccttaaccgtttacccgttacgttaaacccg

SEQ ID NO: 142081 - DNA, 842 bp, Homo sapiens
  misc_feature: GYAE6OF02ITAXO.46.67.G01.1.454.CMB.1.raw
  modified_base (173)..(173): a, c, t, g, unknown or other
  misc_feature (173)..(173): n is a, c, g, or t
  modified_base (254)..(254): a, c, t, g, unknown or other
  misc_feature (254)..(254): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagacccctgtccctcacctgcgctgtctctggtncctcatcagtgtgtttctcgtgggctgggccgcacgcccgtacggaggggacgtcgtaggtactactagtaggagtctctnacgtagtgtggtacgtctactacgtacgtcgtctactagtacgcgtacgtacgtaccactattactcgtacgtacggaccgtacgaccgacgactaacgttaccgtttaccgtttacgaagtaacgttgtaacgttcgttacgtccggtaccgtacccgcgtacggttacggaaccggtttacgggtttactttaaacgttcggtcggtacgggtacggtaacgggtaccggtaccggtttaacgttttaagttacggtttaacggtttttaggggttttaggttaacggggttttacgttttaaccgtttaaccggaacccgtttaacgttaacggttaaccggggtacccggggtaccgggttacccggttaaccccgggtacccgggggttcgggaaaccggttaaccggggtaacgttaccgggttaccgttaaccccggtccgttaccgttacccgttacccgtacccgtaacccggttaaacccgggcccggtaacccgtccgggtttaccccggttccccttacccgggcccttaccccggtaccccgttacccggaaccgtaaccggtaccgtaccccgg

SEQ ID NO: 142082 - DNA, 566 bp, Homo sapiens
  misc_feature: GYAE6OF02GPYIK.46.67.G01.1.454.CMB.1.raw
  modified_base (246)..(247): a, c, t, g, unknown or other
  misc_feature (246)..(247): n is a, c, g, or t
  modified_base (323)..(323): a, c, t, g, unknown or other
  misc_feature (323)..(323): n is a, c, g, or t
  modified_base (341)..(341): a, c, t, g, unknown or other
  misc_feature (341)..(341): n is a, c, g, or t
  modified_base (346)..(346): a, c, t, g, unknown or other
  misc_feature (346)..(346): n is a, c, g, or t
  modified_base (375)..(375): a, c, t, g, unknown or other
  misc_feature (375)..(375): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctcatcagtagtgtttctctggggctgggtccgnngctccgagggagggctggaatacattggaagtgtctctcatagtggaggttcctattacagtccgtctctacaagngtcgagtcaccatatctntgacncgtcagcaatctagttttcccagaacgtntgtagttctgtcgcccgcgctgacgcgggtctttattcgtgtgcgagagacgctattatgttagttttggagttggtttacttcgactaccgtagacgtcggaccgggtctccggtacccggtcgggaccgaagggtacttaccggtcggtccgtacccggtttcctaccgtttaccgcccttaaccccgg

SEQ ID NO: 142083 - DNA, 555 bp, Homo sapiens
  misc_feature: GYAE6OF02H8L9L.46.67.G01.1.454.CMB.1.raw
  modified_base (161)..(161): a, c, t, g, unknown or other
  misc_feature (161)..(161): n is a, c, g, or t
  modified_base (219)..(219): a, c, t, g, unknown or other
  misc_feature (219)..(219): n is a, c, g, or t
tcagactagcagtacacgaccggtgctcgatttagagtatacatattgggtttggggagtctcggtcaggacacagcatggacatgagggtccccgctcagctcctgggggctcctgctactctggctccgaggtgccagatgtgacatcgagctgacccngtctccatcctccctgtctgcaaccggtgggagacagtgtcaccatcacttgccgggnaagtcggaacattgacacctatttaaattggtatcaacatagaccagggacgcccctaagctcctaatctatgctgcatccagtttgacaaagtggggtcccatcgaggttcaggtgcagtggatcgtgggactagatttcactctacaccatacagttaatctagacaaacgtgtaaacgtattttggactaaactttattaactgttacaaacagtaaattacaagttgtttcggaccagggaacacgaactaactaaataaacgaactgtacgactcgactaccaattctagttaccttacgtacttccttacccgaccctattccagttaac

SEQ ID NO: 142084 - DNA, 549 bp, Homo sapiens
  misc_feature: GYAE6OF02JCA70.46.67.G01.1.454.CMB.1.raw
  modified_base (538)..(538): a, c, t, g, unknown or other
  misc_feature (538)..(538): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctgggctgggtccggcagctccagggagggctggaatacattggaagtgtctctcatagtggaggttcctattacagtccgtctctcaagagtcgagttcaccatatctctggacacgtccagcaatcagttttccctgaacgatgagttctgtgaccgccgctgacacgggtctttattacgtgtgccgtagagacggctacgttatcgagtttttcggagtggttatttcgactacccgtagatcgacggggctcgacccgtgggccagggagtactggtccaccgtctccttacgcctccaccgacggcccactcggtccttccccgtggccctaccctccnccacgcgtacc

SEQ ID NO: 142085 - DNA, 729 bp, Homo sapiens
  misc_feature: GYAE6OF02J0JBC.46.67.G01.1.454.CMB.1.raw
  modified_base (152)..(152): a, c, t, g, unknown or other
  misc_feature (152)..(152): n is a, c, g, or t
  modified_base (193)..(193): a, c, t, g, unknown or other
  misc_feature (193)..(193): n is a, c, g, or t
  modified_base (219)..(219): a, c, t, g, unknown or other
  misc_feature (219)..(219): n is a, c, g, or t
  modified_base (229)..(229): a, c, t, g, unknown or other
  misc_feature (229)..(229): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcganctgacccagtctccatcctcctgtctgccaaccggtggacncagtgtccaccatcacttggccgggnaaggtcgaanttgactacttaatttaagtggtactacaactaagtacgaccgacgggaccggtaccccctaagtcctacctaagtcctaagtcgacgtgccaagtccctaaggtttcacggtaaacgttcggggtaccagtcggacgttacgacgtggacgtaggtacggtacgtacggtcgggtaacagttacttcgtactcgtcaccgtatacgtagttactactacgactaacggtataacgttattttacgtaacgttattaccgtagttacctaagtaacgttaacttaacgtaagtttaccgggtttaaccggtaaccggtaaacggtaaccgtaaaccgttaaataaacccggtttaaaagttaaaccgtaacgttacggttacgggtaactcggtaaacccttaacgtaacgtttaccgtttacggttaaccctttaccgtaacccgtttcccgtttaacccccggtacgtttaacctcccggtttaactacccgtttaacg

SEQ ID NO: 142086 - DNA, 792 bp, Homo sapiens
  misc_feature: GYAE6OF02J2MKH.46.67.G01.1.454.CMB.1.raw
  modified_base (334)..(334): a, c, t, g, unknown or other
  misc_feature (334)..(334): n is a, c, g, or t
tcagactagcagtacacgaccggtgctcgatttagagtatacatattgggtttgggagtctcggtcaggacacagcatggacatgagggtccccgctcagctcctgggctcctgctactctggctccgaggtgccagatgtgacatcgagctgacccagtctccatcctccctgtctgaccaaccggtggagacagtgtccaccatccacttcgccgggcaaggtccggaacagtttgaacctaccttaattttaaaacgttggtactaccaacgtaagtagacctaagggacccggtacccctaaaggcttaccctaaattcctatgccgtanactaatcccgtagtttcgactaaacggttcggggtaccctagtccgggtaagtttccgaagggtttcggcgtaacggttacggatttccgggaggggacttaaggttaccttttacggaccctttacccggtacgtaaccctactttccgtaaacgtttaacgttacccgtaggttaaccgaaacccgggtttaagtaacgttaacgttttaacggtaccttaaacttttaaccttacgttaaccgttacgtaaacgttaaacgtaaactttacgtaaaccgtttaggttttaccgtaacggttaaaccgggtactaaaccggtaaccgttaaaaccgttaaacgttaaaaccggtaacgttacgtacggtacgtacgttacgtaaccgttataccgttacgttacctttacgttacccgtttacggtacccccttaggtaccttacgttacgtaacg

SEQ ID NO: 142087 - DNA, 541 bp, Homo sapiens
  misc_feature: GYAE6OF02FKDAG.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccggcagctcccagggaaggggctggaatacattggaagtgtctctcatagtggaggttcctattacagtccgtctctcaagagtcgagtcaccatatctctggacacgtccagcaatctagttttcccagaagatgagttctgtgaccgccgctgacgacgggtctttattactgtgcgagagacggcttattatgtatttttggagttggttatttcgactacctagatcggacggggctccggacccgtgggccgagggaactacgtcggtcaccgtctccttacgcctacccg

SEQ ID NO: 142088 - DNA, 861 bp, Homo sapiens
  misc_feature: GYAE6OF02I1ZIK.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcggcccacgactggtgaggccttcggagaccctgtccctcacctgcgctgtctctggtgcctccatcagtagtggtttcttcgtgggctgggtccggcagctcccgagggaagggctggaatacagttggaagttgtctctcagtaggtggtaggttcctaattacagttccgtctctcaaggtacgtcgacgtcaaccattactctcgtggactacgtccagactaaattcgtaacgttttccccgagtaagtactaggtaacttcgtggtaccgaacccggccgttcgttacggaaccgtaccggggttacgtttttaaactttaccgtaggttacggacggtaacggtaacggtaccggttaaccgtttaagtttaacgtttaggttaaggttttttacgggtaacggtttaggtttttaacgtttaccgtaaaccgttaaccccgttaaaggtacgttaccggggtaaaccgggggttcccgttaacccgggtaccccccgggttagggggtaaccccggtaaacgggggttaaacctttaaccggttaccggggttacccgtaaaccccggtttacccgttaacccggtttaacccggtacccctaaccccggtaacccggtaaacccggggtaacccccgttaaccgggttccccgggtttaccccccgtttacccccggtacccggtacccccgttaccccccgttacccgtaccccggtaaaccggacccgttaacccccgg

SEQ ID NO: 142089 - DNA, 686 bp, Homo sapiens
  misc_feature: GYAE6OF02JMDV5.46.67.G01.1.454.CMB.1.raw
  modified_base (195)..(195): a, c, t, g, unknown or other
  misc_feature (195)..(195): n is a, c, g, or t
  modified_base (206)..(206): a, c, t, g, unknown or other
  misc_feature (206)..(206): n is a, c, g, or t
  modified_base (230)..(230): a, c, t, g, unknown or other
  misc_feature (230)..(230): n is a, c, g, or t
  modified_base (618)..(618): a, c, t, g, unknown or other
  misc_feature (618)..(618): n is a, c, g, or t
tcagactagcagtacacgaccggtgctcgatttagagtatacatattgggtttggggagtcgtcggtcaggacacagcatggacatgagggtcccgctcagctcctggggctcctgctactctggctccgaggtgccagatgtgacatcgagctgacccagtctccactcctccctgtcctgcaacccgtgggancagtgtcaccntcacttgccgggacagtccgaacnttgactaccgtattaaatgtatacacatacgacaggaccgaccgtaacgactcctaactactactgtcgtgtcactctacgtttgacctaaggtcggggtaccctagtaccgtagttaccgtagtcggtacgaggttaggtactcgttaggggacttagggtactttaccgtacttcgtaccctaaccgtacgtaactaacggttactacgttacgtaaccttaacggtaggtaacgttaattttcggaacctttaacgttattaaacggttcgtaactaacgtaagtaaactttaactaacgtttacgtttaacgggtaaccagggttacctaacggaaccttaaagtaaaccttaaaacggtacgtaaccgttaagtaccggtaanacccgttaacgaagttcctaagttccgttaacctacgtacctttacccggacttacctactagttaac

SEQ ID NO: 142090 - DNA, 656 bp, Homo sapiens
  misc_feature: GYAE6OF02IUI2M.46.67.G01.1.454.CMB.1.raw
  modified_base (645)..(645): a, c, t, g, unknown or other
  misc_feature (645)..(645): n is a, c, g, or t
tcagactagcagtacacgaccggtgctcgatttagagtatacatattgggtttggggagtctcggtcaggacacagcatggacatgagggtccccgctcagctccgtggggctcctgctactctggctccggaggtgccagatgtgacatcgagctgacccagtcctccatccctcctgtctgcacgtggagacagtgccacatcacttgccggacaagtcgaacattgactactatttaatgatcaacatagaccgagggaccgacccctaagccttacctaatctatgctgcatcctagtttgactaaaggtcgggtaccagtcggtagttacgaggtggactaggtgactcggtagggactagtactttcgaccttctaccgacctagtacctaagttaacttccgagtaaccgtaaggtacgtaagtttacgttttacgaaacttaacgtttaattccgttaacggaaccttaaactaaggttaaactttaacaagttttaccgggtttacgaaaccgtaagggtaaccaacgtaacttaaacgaaactttaaacgaacgttggtacgacgtactaaccgtaccgtaattccgttataccgtttaccgtacgtttccccgtacccgtacctacgtttaacnccggttaaacc

SEQ ID NO: 142091 - DNA, 622 bp, Homo sapiens
  misc_feature: GYAE6OF02G03GS.46.67.G01.1.454.CMB.1.raw
  modified_base (250)..(250): a, c, t, g, unknown or other
  misc_feature (250)..(250): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatcctcctgtctgcaaccgtggagacagtctcaccatcacttgccgggcaagtcgaacattcgactactattaatgtatcaanatagaccgaggaccgcccctaagtcctacctaactctatgctcgctatcctagtttgcgtaaaggtcgggtccagtcggtaggttcacggtgactaggtagagtcgtagggacagtatttcactctacacctagtactagtaatctagactaaacgtagtaaacgttattttacgtacttaaacttttagttactacgttacaaacgtaattaaacttacttaaagtttcgtttaccggaaccgtaaggaacctacgtaacctaaaacgtaaactttaaaacgaacgttagtaccgtcgtacgtaccgtaacttacgtcgttacgttacctttagacctttcccgtccccgtacacgtttcctaggttaacc

SEQ ID NO: 142092 - DNA, 617 bp, Homo sapiens
  misc_feature: GYAE6OF02GU4ZA.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgactacctatttaaattggtatcaacatagaccagggacggcccctaagctcctaatctatgctgcatccagttttcaaagtcggggtcccatcgaggttcagtggcagtggatctgggacagtatttcactctcacctatcagtaatctgactaacgtgaagtattttcggactaacttattactgttacaactagtaaacttacaattcgttttaccggaccgtaaaggggtactaaccgtaacgttaaccaaaaacgtttaaaccgtaaacgttgttacgggaccgttcgtaacccaacccgtaacttccgtttacggttcctttaccgtaacttttcccgttaccccggtacccttaacgtcctttacggtaactttaacccg

SEQ ID NO: 142093 - DNA, 675 bp, Homo sapiens
  misc_feature: GYAE6OF02HPPM9.46.67.G01.1.454.CMB.1.raw
  modified_base (377)..(377): a, c, t, g, unknown or other
  misc_feature (377)..(377): n is a, c, g, or t
  modified_base (384)..(384): a, c, t, g, unknown or other
  misc_feature (384)..(384): n is a, c, g, or t
tcagactagcagtacacgaccggtgctcgatttagagtatacatattggggtttgggggagtctcggtcaggacacagcatggacatgagggtcccccgctcagctcctggggctcctgctactctggctccgaggtgccagatgtgacatcgagctgacccagtctccatcctccctgtctgccaacggtgggagacagtgtcaccatcacttcggccgggacaaggtcggaactattacgactacttaatttaaagttggtatacaacataagacgagggaccggaccctaagctacctaatctatgcctgcatcctagtttgacgtaaaggtcgggtaccatcggtacggttcaagtggacgaggtgagttcgngggaacngtattcactctacactatcgaataatcgtagtactaacggtagtaagttacgtttacgacttaactttagttacgttacgtaactaaattaagtaaattaaccttaaagtttacggttttaccggaaccggtaaagggtaacccaacgtaacttaaaaccgttaaaaacgttaaacggtaaacgttacggttacgtacgtaacaccgtaaccgttaccttacgttaccggtttacctttaccgttaccttacccgttaccccggtaccctacgttaccttaggttaaaccg

SEQ ID NO: 142094 - DNA, 622 bp, Homo sapiens
  misc_feature: GYAE6OF02I8TEG.46.67.G01.1.454.CMB.1.raw
  modified_base (211)..(211): a, c, t, g, unknown or other
  misc_feature (211)..(211): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttcttcgtggggctgggtccgcagctccgagggagggctggaatacattggaagtgtctctcatagtggagttcctattacagtccgtctctcaagacgtcgagtcaccatactctctggacacgtccagcaatctacgttttcccagtaacgtatgtacgtttctcgtacgacccgtccgtacgtcgaacgtacgggtcttttaacttacgttggttggacgacgtacggacgtcttagttacgtgttagtttttaggagtttaggtttactttaccgactacccgtaagtacgttccgggtacggggtctacccggacccggttcgggaccgtaagggtaacttaccggtacggtccgtacccggttccttccgttacgtcccctaacccgg

SEQ ID NO: 142095 - DNA, 766 bp, Homo sapiens
  misc_feature: GYAE6OF02JH5HM.46.67.G01.1.454.CMB.1.raw
  modified_base (152)..(152): a, c, t, g, unknown or other
  misc_feature (152)..(152): n is a, c, g, or t
  modified_base (358)..(358): a, c, t, g, unknown or other
  misc_feature (358)..(358): n is a, c, g, or t
  modified_base (365)..(365): a, c, t, g, unknown or other
  misc_feature (365)..(365): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctnacctgcgctgtctctggtgcctccatcagtagtggttcttcgtgggcttgggtccggcagctccgagggaagggctggaatacagttgggaagtgtctcgtcagtagtggaggtttccattcgagttccgtctctcaagtagtcggattcaaccatcgtctcgtcgggaccacggttaccagtacaacttctagtttttaccccgngaaaggntcggtaagtttcctggtcacccggccgcttggaaaccgcggggttccttttaaatccggttgtacgtcggaaggtacggtaccgggtacttaatttacgtggtttaagtttttacggggacgtttagggttttacgtttaccgtaacgtaacccgttaaggtcgttaacgggtaaccggggtccgtttaccgtacccccgggtacgggttaccggaaggggtaaaccgtttacggtaaccggtttcccggtaaacccggttccgttaccgttaaccggtcccccgttacgaaccccgggtaaaccgggttcccctaggtttaaccccgggttccccgttttacccccgtcgggtacccccaacccccgttcccgtttacccgtaaccggccgttaaccccg

SEQ ID NO: 142096 - DNA, 525 bp, Homo sapiens
  misc_feature: GYAE6OF02HDA98.46.67.G01.1.454.CMB.1.raw
  modified_base (417)..(417): a, c, t, g, unknown or other
  misc_feature (417)..(417): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacgcccctaagctcctaatctatgctgcatccagtttgcaaaggtcgggtcccatcgaggttcaggtggcagtgatcgtgggacagtatttcactctcaccatcagtactctgcaacgtgaagtatttgactaacttattactagtacaanagtaattactaattgtttacggaccgaagggacaacgaactaactaaattaaacgtaacgtagtgactgaccaactatctgtcttcacttcctccgactactctgtac

SEQ ID NO: 142097 - DNA, 648 bp, Homo sapiens
  misc_feature: GYAE6OF02GBUR4.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccggtggagacagtgtcaccatccacttgccgggcaagtcggaacattgactacctatttaaatgtatcaacatagacagggacgcccctaagctacctatctatgctgcatcctagtttcgacaagtggggtcccagtcggtaggttcgagtcggcaggtggatcgtaggacagtattcacgtactcacctatactagtaacttctgtacgtaacggtagtaaagtagttttacgacttaaactttagtttacgttacgttactaacgtaaacgttaaattaacctaaagtttcgttttaccggaaccgtaaacgggtacctaaccggtaaacttaaaccgtaaaacttaaaaccgtaacgttacgtacggtaccgtacgtaacccgtaacctacgtttacgttccgtttacctttaccgtacgtttaccccgtttacccaccgtactttacccgtaggttaacc

SEQ ID NO: 142098 - DNA, 794 bp, Homo sapiens
  misc_feature: GYAE6OF02JMU4C.46.67.G01.1.454.CMB.1.raw
  modified_base (151)..(151): a, c, t, g, unknown or other
  misc_feature (151)..(151): n is a, c, g, or t
  modified_base (280)..(280): a, c, t, g, unknown or other
  misc_feature (280)..(280): n is a, c, g, or t
tcagactagcagtacacgaccggtgctcgatttagagtatacatattgggtttggggaccgtccgtgtgcaagaacatgaagcacctgtggtttgtcctcctgctggtggcagctcccagagtcgggtcctgtcctggtgcaactgcaggnggtcggcccacgacgtggtcgaggtcccttcgggacgacccctggtcccctcgaccgtggcccgcttgtccttcgtgggtcgacccttccatcgagttagtcggtttctcgtggggcttggggtcccgnagtcctaccccgaggggacgggcgtacggaatacgtagttcggaagttcggtctaccgtctacgttaggtacgggtacgttaccgttagtttaccgtacggttcccggttcctacgttacgaaacggtcggttaccgtacgttaccgaacccgttaagttactccgtttacgtaacggggaccctaaccggttaccaacggtactaacgtaccgttaccgtttttacccgaggtaaaccgtgttacgtagtttcgaggttaccgaccggttccgtatcggaaccggtaccgggttacgttttaccgtaaccgttggtaccgtaccgtaaggtacggaccgttataacgtttagtacgttagttttacgggtaagttcgtttaacgttacgaccttaaccgtagtacgtaccgggttacgggtcttacccggtacccgggtagggtacccgaagggttaaccgtcggttcccggttaccgtacccgttccgttacccgtaggttccccctaccgg

SEQ ID NO: 142099 - DNA, 561 bp, Homo sapiens
  misc_feature: GYAE6OF02G75SJ.46.67.G01.1.454.CMB.1.raw
  modified_base (353)..(353): a, c, t, g, unknown or other
  misc_feature (353)..(353): n is a, c, g, or t
  modified_base (422)..(422): a, c, t, g, unknown or other
  misc_feature (422)..(422): n is a, c, g, or t
  modified_base (507)..(507): a, c, t, g, unknown or other
  misc_feature (507)..(507): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccgtgggagacagtgtcaccatcacttgccgggcaagtcggaacattgacacctatttaaattggtatcaacatagaccagggaccgcccctaagctcctaatctatgctgcactccagtttgacgaaagtcgggtccagtcgtaggttcagtggcagtgatcgtgganagtattcactctcaccatcataatctacgactaacgtagaagtatttagtaacttattactgtactaanagtaattactaatttacgtttcggacgtaagggacaacgtactaataaacttaaacgtaactagtacgtcgtagcctaacccgtnttacctgttccttacgtacgttcccttcccggtacctagtcctacgtattaccg

SEQ ID NO: 142100 - DNA, 714 bp, Homo sapiens
  misc_feature: GYAE6OF02IS4TT.46.67.G01.1.454.CMB.1.raw
  modified_base (171)..(171): a, c, t, g, unknown or other
  misc_feature (171)..(171): n is a, c, g, or t
  modified_base (247)..(247): a, c, t, g, unknown or other
  misc_feature (247)..(247): n is a, c, g, or t
  modified_base (285)..(285): a, c, t, g, unknown or other
  misc_feature (285)..(285): n is a, c, g, or t
  modified_base (358)..(358): a, c, t, g, unknown or other
  misc_feature (358)..(358): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttcttcgtgggctgggtccgcagctccgagggagggctggaatcagttggaagtgtctntcatggtggacggtttcctagttacaggtccgtctctnaagaggtcgtagtaccacctatactctacgtcggactaccgtccaagctaactctacgttttcccagtaaagntacggtagttcttggtacgacccgcgtcgtacggaacgtccggggtttacttttattacgtgtacggcgtaacggtacggtaccggtactttaagtttacgttggttaacggtttttgggaaggtttggttttacgtttaaccggaccttaacccgttaggtacgtccggggtaccggggtcctcccggaacccggttggggacccgtaaggggtaactacggttcgggacctacccggtctttacccgtaccgtcccgttaacccgaacccgtaaccgggtccctaacggttcccggtccccgtttccccgtacggtccctacccccttcccgtaaccggaacgccgtaccccgg

SEQ ID NO: 142101 - DNA, 699 bp, Homo sapiens
  misc_feature: GYAE6OF02HXL49.46.67.G01.1.454.CMB.1.raw
  modified_base (227)..(227): a, c, t, g, unknown or other
  misc_feature (227)..(227): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtcctccatccctccctgtcctgccaaccggtgggacacagtgtccaccatccacttcggcccggganaaggtccggaaactagttgaacctaccttaattttaaagttggtatacaacatagaccagggaccgcccctaagcctacctaatctatcgctgctatcctagtttgacgtaaaggtcgggtcccagtcggtaagttcgaggttggacgtaggtggagtcgtgggactaggtactttcaccttctaccaccgtatactaagttaactcgtacggaacctaacggtagaacgtttagtttacgaactaactttacttacgtagtaacctaagtaacgttaacttaagtaacgtttcggtttacccggaacggtaaacgggtaaccgtaaacgttaaaccgttaaacttaaaacgttaaacggtaacgttacgggtaccgtacgttacggtaaccctaacctaacgttccgttacgtttacccttacgttaaccttccccgttaaccccgttacctaacttccgttagttacccg

SEQ ID NO: 142102 - DNA, 689 bp, Homo sapiens
  misc_feature: GYAE6OF02IKRT8.46.67.G01.1.454.CMB.1.raw
  modified_base (358)..(358): a, c, t, g, unknown or other
  misc_feature (358)..(358): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgagggagggctggaatacagttggaagttgtctctcataggtggtaggttcctattaccagttccgtctctacgaagacgtcgagtccacctatactctcgtggaccacgtccaagctaactcttacgtttcccgagaagnttcgtacgttctggtccgacccggtccgtcgtacgacgtaccggggttcgttttaattaccgtggtcgacggtaaggacggtacggtcttagtttagtacggttagtttttagggaggttttggtttaacttccgtaacctaccgttacggtacgtccgggtaccggggtcctacccgggtacccgggtcgggaccgtaacgggtaacgtacgttcggtaccgtaccggttccttaccgttaccgtccctaccgaccggtaccgggtaccctacgttcccggttcccttaccccgtcggtccctaccccgttcctaccgacgccgtacccg

SEQ ID NO: 142103 - DNA, 519 bp, Homo sapiens
  misc_feature: GYAE6OF02I1QZY.46.67.G01.1.454.CMB.1.raw
  modified_base (229)..(229): a, c, t, g, unknown or other
  misc_feature (229)..(229): n is a, c, g, or t
  modified_base (385)..(385): a, c, t, g, unknown or other
  misc_feature (385)..(385): n is a, c, g, or t
  modified_base (395)..(395): a, c, t, g, unknown or other
  misc_feature (395)..(395): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaccgtgggagacagtgtcaccatcacttcgccgggcaagtcggaaacnttgacacctatttaaattggtatcaacatagacagggacgcccctaagctacctaatctatgctgcatccagtttcgactaaagtcgggtccagtcgagttcagtggacagtagactgtgggacagtattcactctcacatcatatctgacacgtnaagtatttanactacttattatgtactaacataattacagttagtttcgacgaagggtacacgaactaacaaaagttaaacgtaatgtagtacagacactatctgttactctatcctaccgactagtctagtac

SEQ ID NO: 142104 - DNA, 775 bp, Homo sapiens
  misc_feature: GYAE6OF02JZ3Z4.46.67.G01.1.454.CMB.1.raw
  modified_base (213)..(213): a, c, t, g, unknown or other
  misc_feature (213)..(213): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggacgaccctgtccctcacctgcgctgtctctggtcncctccatcagtagttggtttcttcgtggggcttggggtccgcagtctcccgaggggaaggggtcctaggaactacgtagttaggaagttcggtcctcgttcgaagttacggttgggtaacgggttccctagttacacgttccgttacttcgtaccgaagtacgttcggacgtccaaccgtattacgtccgttcgttacgggacctaccgttccgtaacgacctaaactttccgttaacgttttttccccagggtaaacgtaacgtttcgtaaacgttttccgttacggttaccggaccccgtacccggtctaccggtaaccggtaccgggggttcctttttaaactcggtcggttggaccggtaaggtaccggtaccgggtactttacgtttaagtttcggtttaaggtttttcgggtacgtttagggttttaccgtttacgaaccgttaccgttagacgttccggggaccgggtcttcccgggtaacccggtgggcctaaggggtaacctttcggtcggttacccgccgttttacccgtacgttaccggtccctaacccgg

SEQ ID NO: 142105 - DNA, 711 bp, Homo sapiens
  misc_feature: GYAE6OF02GTRYA.46.67.G01.1.454.CMB.1.raw
  modified_base (190)..(190): a, c, t, g, unknown or other
  misc_feature (190)..(190): n is a, c, g, or t
tcagactagcagtacacgaccggtgctcgatttagagtatacatattgggtttggggagtctcggtcaggacacagcgatggacatgagggtcccgctcagctccgtgggctcctgctactctggctcgagtgccagatgtggacatcgagctgacccagtctccatcctcctgtctgcaaccgtggganacagtgtccacgtatcacttggccggcaaggtcgaacattgactacctatttaacttggtaatacaacagttacgaccaaggggtaccgtacccccgtaaggtacctaccgttaaacgtcgtaatcggtcctacgcaactcctaggtttagactaaaggtcgggtaccctagtcggtacggtcctaggtcgacgtagtaggtatcggtagggacctaaggttacgtttaccacgttaccgtactacctacgtcctaaacggttactacgttacgaccgtaaccgttaggtaaacgttacgttttaggaccttaacgttactttaacggttacgtttaaccgtaacgtaacgttaactttaactaacggtttacgtttaccgggaacgtaaccggtaacgtaaccgttaattaaccgttaaacgttaaaccgtaacgttacgtacgacccttaggaccctaacgtacttccgtaacgttacttaccggtattcccgtacccgtacgtaccgttacgcgttac

SEQ ID NO: 142106 - DNA, 580 bp, Homo sapiens
  misc_feature: GYAE6OF02GPBVZ.46.67.G01.1.454.CMB.1.raw
  modified_base (361)..(361): a, c, t, g, unknown or other
  misc_feature (361)..(361): n is a, c, g, or t
  modified_base (389)..(389): a, c, t, g, unknown or other
  misc_feature (389)..(389): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatgtatcaacatagaccagggacgccctaagctactaatctatgctgcatcctagtttgacaaaggtcgggtaccatcggagttcagtggctagtgatcgtggacagtacttcactcncacatacagtatctgacagtagaagttntttacgactaacttattactgtactaacgtagtaatttacaagttcgtttaccggacgtaaacgggtaccaacgtaacttaaacaaacttaaaacgaacgttagtaccggtactaggaccctaaactactttaccgtagtttaccttaccgtactttccccgttaccccgtactacgttactagttaaccg

SEQ ID NO: 142107 - DNA, 623 bp, Homo sapiens
  misc_feature: GYAE6OF02HFYHB.46.67.G01.1.454.CMB.1.raw
  modified_base (192)..(192): a, c, t, g, unknown or other
  misc_feature (192)..(192): n is a, c, g, or t
  modified_base (215)..(215): a, c, t, g, unknown or other
  misc_feature (215)..(215): n is a, c, g, or t
  modified_base (249)..(249): a, c, t, g, unknown or other
  misc_feature (249)..(249): n is a, c, g, or t
  modified_base (254)..(254): a, c, t, g, unknown or other
  misc_feature (254)..(254): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtctccatccctccctgtctgcaacgtgganacagtgcacatcacttggccggnaagtcggaacattgacaccttatttaaagtgtanacaanatagacagggaccgacctaagctacctaatctatcgctcgacactcctagttacacgtaaaggttcgggtacccaagtccgtagttcgagtcgctaggtgactcgtagggactagtacttacgactactcgaacctatacgtataatcgtagacgtagtacgtaagttacgtttacgtactaaatttacttacggttacagttaacaagtaaacttaactaagtttacgttttaccgggaaactaacggggtaacctactaaacgttaaaactaaacgttaaacgtaaccgttagtacgtaccgtacgacctaaccgtatacttaccgtactttacaccgttcctacccgtacctacttcgagttaacc

SEQ ID NO: 142108 - DNA, 626 bp, Homo sapiens
  misc_feature: GYAE6OF02F6LTU.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttgccggcaagtcgaacattgacaccttatttaattgtatcaacatagacgagggaccgcccctaagctactatctatgctgctatcctagtttcgacgtaaaggtcggggtacccagtcgtaggttcaggtcggcgtaggtggtatcgtagggactagtacttacactctacactatactagttaactcgtacgactaacgtagtaagttagttttacgaacttaaactttacttacttacgtactaaactaacgttaaattaacgtaacgtttcggtttaccgaccgtaacgggtactaacgtaacttaaacgtaaaagttaaacgacgttaggtacgtacgttcgaccgtaaccgtattaccgttacttaccgttactaccgttcccttacccgtacctacgttcctagttacg

SEQ ID NO: 142109 - DNA, 841 bp, Homo sapiens
  misc_feature: GYAE6OF02FPAMP.46.67.G01.1.454.CMB.1.raw
tcagactagcagtacacgaccggtgctcgatttagagtatacatattgggtttgggggagtctcggtcaggacacagcatgggacatggacgggtcccgctcagcctccgtggggctcctgctactcgtggctccggaggtcgccagatgtgacatcgagtctcgaccctagtcctccactccctcccttgtctacgaccgtaaccgggtgggaacgactaggttcgtaccaacctactcctacgttcggggcccgggtaactaacgggttaccggaaacttacgttacggaacccttaaccttttaaattttaaaacggttggttaactaaccaaaactaagttaaccggaaccggaacgggggtaccccggtaaccccctaaacggtcccttaacccgttaaacttaccttaacggttcggtaccgttacggaccttaccgttacccgttaaggttttacgaaaccggttaaacgggggttcccggggttaccctaaggttacgggttacggttacgtagggtcggacgtagggtcggtacgtcggtacgggaactagtttacttacacttcctacactatacgtaagttactacgtacgaacgtaacggtagtaagtttacgtttacgtaaccttaacttactttacgttacgtaacaaacgttaagtaacttaacgttaagtttacggtttaccggaacgtaacggtacctaaacgtaacttaaacgtaaaacgtaaccgtaagttcggtacgtacgtacgaccgtaactacgttaccgttacgtttaccttacgttaccgttcccgttacccgtactaccgttacgtacgttaccg

SEQ ID NO: 142110 - DNA, 605 bp, Homo sapiens
  misc_feature: GYAE6OF02H49YO.46.67.G01.1.454.CMB.1.raw
  modified_base (191)..(191): a, c, t, g, unknown or other
  misc_feature (191)..(191): n is a, c, g, or t
  modified_base (227)..(227): a, c, t, g, unknown or other
  misc_feature (227)..(227): n is a, c, g, or t
  modified_base (253)..(253): a, c, t, g, unknown or other
  misc_feature (253)..(253): n is a, c, g, or t
  modified_base (348)..(348): a, c, t, g, unknown or other
  misc_feature (348)..(348): n is a, c, g, or t
  modified_base (401)..(401): a, c, t, g, unknown or other
  misc_feature (401)..(401): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctccatcctccctgtctgcaaccgtggganacagtgtcaccatcacttgccgggcaagtcggaacnttgactacttatttaattgtatcaanatagaccagggacgccctaagctctaatctatgctgcatcctagtttgactaaaggtcgggtacccagtcgtaggttcaggtggcaggtgatcgngggacagtactttcactctacacatcagtatcgtgactaacggtagtaagttnttttagactaacttttattactcgtaacaaacgtaagtaaattaacgtaatttcggtttaccggaaccgtaaggggaacctaaccgtaacttaaactaaaacgtttaaaacgaacgttgtacggtacttacggtaccctaacctacgttacttacgttaccttacttacgttcccttacccgtacctacttaccgtagttaacc

SEQ ID NO: 142111 - DNA, 686 bp, Homo sapiens
  misc_feature: GYAE6OF02H9K4F.46.67.G01.1.454.CMB.1.raw
  modified_base (419)..(419): a, c, t, g, unknown or other
  misc_feature (419)..(419): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggcctttcggagacccctgtccctcaccctgcgctgtctctggtgcctccatcagttagtggttttcttcgtggggcttggggtccgcagcctcccgagggagggctaggatacagttggaagtgtctctcagtagtggtaggttcctattacagtccgtctctcaagagtcgagtcacctatactctcgtggacacgtccagcaatctacgttttccagaagatgtagttctagtcgaccgccgctagaccgtaggtacttttagttacgtgtcgcgagacggacggtnttaagttagtgttagtttttagggagtttgggtttacttaccggaaccttaccgtaggtacgtacggggtacggggtaccttccggtaccccgggtagggggaccctaagggggtaacttccgttacgggttacccgtacccggttccctttacccgttaccgcccgttacccgaacccggtaacgggtcccctaacggttcccggttccccgttcccccggtggtacccctacccccgttcccgtaccgtaaccggacgtaccccg

SEQ ID NO: 142112 - DNA, 742 bp, Homo sapiens
  misc_feature: GYAE6OF02H08AY.46.67.G01.1.454.CMB.1.raw
  modified_base (213)..(213): a, c, t, g, unknown or other
  misc_feature (213)..(213): n is a, c, g, or t
  modified_base (252)..(252): a, c, t, g, unknown or other
  misc_feature (252)..(252): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcgggagaccctgtccctcacctgcgctgtctctggtcncctccatcagtgttggtttcttcgtggggctgggtccgnagcctccgaggggaagggcgtaggaatactagtggagtgtctctctagtaggtggtacggtttctaattacgacgttccgtctctacgaagtacgtcgtatccaaccattactcctgtcgactacgtccagactaatcttaccgttttccagtaacgtagttagtacgtttgtacggtccgacccggtccgtacgtacggtaaccggttacgggttaccgttttaacgttacggtggttacggtaacgggacggtaacggtacgggtacttaaagttttagttacgggttttagttttttgggtagttttaacgggttttaaccgtttaccgtacccggttaaccgttaggtacgggttacccggggtaccggggtaccgttccccggggtaaccccgggtacgggggaacgtaaccggggtaacttaccgggttaccggttaccccgtaccggttcccgttaccggtttaccccgcccgttaaccccgg

SEQ ID NO: 142113 - DNA, 613 bp, Homo sapiens
  misc_feature: GYAE6OF02HGCAR.46.67.G01.1.454.CMB.1.raw
  modified_base (191)..(191): a, c, t, g, unknown or other
  misc_feature (191)..(191): n is a, c, g, or t
  modified_base (308)..(308): a, c, t, g, unknown or other
  misc_feature (308)..(308): n is a, c, g, or t
  modified_base (375)..(375): a, c, t, g, unknown or other
  misc_feature (375)..(375): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtggganacagtgtcaccatcacgttcgccgggacaggtcggaactattgacaccttatttaaattggtatacaacatagaccagggaccgccctaagctctaatctatgctgcatccagtttncaagtgggtccatcgagttcagtgcagtgatctgggactagtattcactctcgactatcaataactntacgactacgtagtaagtatttgacttaacttacttactacgtacaactagtaactttaactagtttacggtttaccggaccgtaaacgggtaacctaacggttaactaaaccgttaaaacgttaaaccgtaaacgttcgttaccgggtactacgggtaccaaccgttacttacgttaccgtttcgttaaccttaccgttaccgttcccccgtacgtacctttaccggtattaaccgg

SEQ ID NO: 142114 - DNA, 582 bp, Homo sapiens
  misc_feature: GYAE6OF02IMZ39.46.67.G01.1.454.CMB.1.raw
  modified_base (250)..(250): a, c, t, g, unknown or other
  misc_feature (250)..(250): n is a, c, g, or t
  modified_base (336)..(336): a, c, t, g, unknown or other
  misc_feature (336)..(336): n is a, c, g, or t
  modified_base (493)..(493): a, c, t, g, unknown or other
  misc_feature (493)..(493): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctggggtccgcagcctccgagggagggctggaatacattggaagtgtctntcatagtggaggttcctattacagtccgtctctcaagagtcgagtcaccatatctctggacacgtccagcaaatctagttttcccngaagatgtagttctgtcgaccgccgtcgtcgacgtacgggtcttttaattacgtgtcgcgagagtacggtcttatactgttattttggagttggttattcgactacctagacgtcggacgggctccgacccgtgggccgaggaactacgtcgtaccncgtccttccttacgcctaccgtaccgaacggtcccagtaccgttcccttccccgtcgtaccctacccttccctaccgacgacgtacccg

SEQ ID NO: 142115 - DNA, 760 bp, Homo sapiens
  misc_feature: GYAE6OF02JJN7C.46.67.G01.1.454.CMB.1.raw
  modified_base (196)..(196): a, c, t, g, unknown or other
  misc_feature (196)..(196): n is a, c, g, or t
  modified_base (749)..(749): a, c, t, g, unknown or other
  misc_feature (749)..(749): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgacacggtggacgacgngtcgtccacctactctacgttcggtcgggacaacggtaccggaactagttacgaacctaacctttaagtttaaagttggtaactaccaaacgtataacggaaccgacgggacccgtaccctaagccttacctaagtctagtcgctcgactacgtccgtaggtttcgaacgtaacgggttccgggtacctagtacggttacggttcaagggtcggacgtacgggtacggtaagtccggtacgggacctaagttccttttaccgaccgtttacctaaccgaaccttacgttacgtaacggtttaccttcggtaccgtaacgtaaacggttagttaaacgtttacgttttaacgaactttaaacttttacgtttaacgtacgtaaactaaacgtaagttaaaacctttacgttaaacggttttcggttaaacccggaacggtaaacggtacttaaacgtaacttaaaccgttaaaagttaacgacgtgttacgacgttacgacctaacgtacgttcgtattacctaccgttaccgttccgttcccacgttaacgtnttaccgtaacg

SEQ ID NO: 142116 - DNA, 683 bp, Homo sapiens
  misc_feature: GYAE6OF02GEDYA.46.67.G01.1.454.CMB.1.raw
  modified_base (171)..(171): a, c, t, g, unknown or other
  misc_feature (171)..(171): n is a, c, g, or t
  modified_base (208)..(208): a, c, t, g, unknown or other
  misc_feature (208)..(208): n is a, c, g, or t
  modified_base (350)..(350): a, c, t, g, unknown or other
  misc_feature (350)..(350): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtncctccatcagtagtggtttctcgtgggctgggtccgnagcctcccgaggggaagggctaggaatacgagttgggaagttgtctctcagtagtggaggttcctattacgagtccgtctctcagagtcgagtcaccatatctcgtaggaccacgtccagacaattctacgttttccagaantgtagttctgtcgaccgcgcgtacgacgtacgggttactttttacttacgttcgtacggaccggtaaggaacggtaccggtactttaagtttacgttagtttaagttttttagggaaggttttggtttaagtttccgaacttaacccgttagtacgttaccggggtaccggggtccttacccggacccggtaggggtacccgaagggtaacgttaccgtcggtcctaacccggttccttaccgtacgtcccgtacctaacccggaaccggtaccctacgtcccggtttccccttccccggcgtccctacccctccgaacccgtagcctacccg

SEQ ID NO: 142117 - DNA, 690 bp, Homo sapiens
  misc_feature: GYAE6OF02IQBBX.46.67.G01.1.454.CMB.1.raw
  modified_base (195)..(195): a, c, t, g, unknown or other
  misc_feature (195)..(195): n is a, c, g, or t
  modified_base (251)..(251): a, c, t, g, unknown or other
  misc_feature (251)..(251): n is a, c, g, or t
  modified_base (255)..(255): a, c, t, g, unknown or other
  misc_feature (255)..(255): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtctccatccctccctgtctgccaaccggtgganacagtcgtcacatcacttgccgggacaagtcggaacattgacactatttaatgtancaanatagacgagggacgacccctaagctacctaatctatgctgactactcctagtttacgacgtaaacgggttcgggtaccctaagtcggtacggtttacgaaggttcggactaggtggtacgttacggagggaacctaaggttacttttaccgaactccttaccaaccgtaattccgtaagttaaactccgttaacggactaaacggttaacgtaaagtttattttcggaaccttaaagttttaacttacgttaacgtactaaacgtagtaaactttaacgtaagtttcgtttaacggaccgtaaagggaactaaccggtaactaaagttaaaaccgttaaagaaccgttaggtacgtacttaacgacctaacggttacttcggttaccttcttaaccgttacgttccccttccggtactaccggttacaggttaac

SEQ ID NO: 142118 - DNA, 634 bp, Homo sapiens
  misc_feature: GYAE6OF02GAG1D.46.67.G01.1.454.CMB.1.raw
  modified_base (212)..(212): a, c, t, g, unknown or other
  misc_feature (212)..(212): n is a, c, g, or t
  modified_base (340)..(340): a, c, t, g, unknown or other
  misc_feature (340)..(340): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactgggtgaggccttcggagaccctgtccctcacctgcgctgtctctggtncctcatcagtagtggtttctcgtggggcttggggtccgcagccgtcccgaggggaacggggctaggaatacgagttaggaagtgtctctcatagtggtaggttcctatacacgtccgtctctacaagngtcgagtcactatactctcgtcgactacgtcagtacaatctacgttttcccgagtaagtagtgtacgtttcgtcgtacgacccgtccgtacgtacggaaccgtacgggttaccgttttacgtacgttggttagacgaggtacggtacgtacttaagttagttagttagttttcgggtaaggttaggtttacttacgtacctacgttaaggcgtacgggacggggtcctaccggtcccggtcggggaccgtaggtacgttacgtcggttccaccgttctaccttacgcctacccg

SEQ ID NO: 142119 - DNA, 894 bp, Homo sapiens
  misc_feature: GYAE6OF02GB3JE.46.67.G01.1.454.CMB.1.raw
  modified_base (175)..(175): a, c, t, g, unknown or other
  misc_feature (175)..(175): n is a, c, g, or t
  modified_base (217)..(217): a, c, t, g, unknown or other
  misc_feature (217)..(217): n is a, c, g, or t
tcagactagcagtacacgaccggtgctcgatttagagtatacatattgggtttgtcctcctgctggtggcagctcccagatgggtcctgtccctggtgcaactgcaggagtcggcccacgactgggtcgaggccttcgggacgaccctgtccctcacctgcgctgtctctggtcncctccatcagtagtcggtttcttcgtggggtctggggtccgnacggtcctacccgaggggacgggctagggaactacgtagtttgggaagttcggttcctactacgtaagttaggttcgggtacgggtttaccttaagtttaccgaacggtttcccgttcgttaccgttacgtaaacggtacggttaccggtaacgttccgtaacccgtaattaacgttccgttacgttacgggaacctaccggttaccgacgtacaaacgttcgttaacgttttccccgagtaacggtacttacgtacggtttactggtaccgtaccggccgtacgttacggaaccgtacgggttaccgttttaacgttacgtcggtacggtacggtaacggtacgggtaccggttacgttaacgtttacgttaggtttaacggtttttcgggttaacgggtttacggttttacggtttaccggttaacccgtaccgttaacggtacggttaccgggttaccggggtacccggttacccggtacccgggtacggggttacccggtaacgggttaaaccggttaccgttacgggtccgttaacccggttaccgtttaccgtaccgttacccgtaccgtaacccggtaaccggtacccgtaacggttcccgtttacccgttcccccgtacgggtaccccttaccccgttacccgtacccgtaaccggtacccgtacccgg

SEQ ID NO: 142120 - DNA, 782 bp, Homo sapiens
  misc_feature: GYAE6OF02G1YEC.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtcgcctccatcagtagttggtttcttcgtggggctgggtccgcagcctccgagggagggctaggaatacagttggaagtgtctctcatagtggtaggttcctattacacgtccgtctctacaagacgtcgacgtcacctatactctcgtacggactaccgtacagactaacttccgtaacgtttttcccgaaggtaaacgtacgttaggtaacgttttcgtcggttaccggaaccccggtcccggtccggtaccgggtaaaccgtaccggggttaccgtttttaacgttaccgttagggttcggtacggtaacggtacggtaaccgggttactttaaagtttacggtttagggtttaacggtttttttaggggtaagggtttttagggttttaacgtttaccggttaacccttaaacccgtaaggttaaccggtaccgggggttaccgggggtaccgttacccggggtaaccccgggtcgggggtaacccggtaacggggtaacgtttaccggttacgggttacccgtacccgggtttccgtttaccccgtttaccggtaccccgtaacccgg

SEQ ID NO: 142121 - DNA, 610 bp, Homo sapiens
  misc_feature: GYAE6OF02FQTR3.46.67.G01.1.454.CMB.1.raw
  modified_base (193)..(193): a, c, t, g, unknown or other
  misc_feature (193)..(193): n is a, c, g, or t
  modified_base (260)..(260): a, c, t, g, unknown or other
  misc_feature (260)..(260): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgtcaccatccacttgccgggcaaggtcggaacattgacaccttatttaaattggtatcaacntaagaccagggaccggcccctaagctacctaatctatgctgcatccagtttgacgaaaggtgggtaccctatcggtaggttcagttggcgagtgatcgtgggactagtatttacactcgtccacatcaagttatctagctaacgtagtaagttatttgaactaactttattactagtacaaactaagtaactttactaagtttcgttttaccgggaccgaaacgggtacctaaccgtaacgtaaactaaaattaaacggtaaacttcgtaggtactacgtacccaacgttacgttcgttacgttcttaccgtacttacccgtttccccggaactacgttaccttagtaac

SEQ ID NO: 142122 - DNA, 603 bp, Homo sapiens
  misc_feature: GYAE6OF02IK7MY.46.67.G01.1.454.CMB.1.raw
  modified_base (191)..(191): a, c, t, g, unknown or other
  misc_feature (191)..(191): n is a, c, g, or t
  modified_base (217)..(217): a, c, t, g, unknown or other
  misc_feature (217)..(217): n is a, c, g, or t
  modified_base (342)..(342): a, c, t, g, unknown or other
  misc_feature (342)..(342): n is a, c, g, or t
  modified_base (384)..(384): a, c, t, g, unknown or other
  misc_feature (384)..(384): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtggganacagtgtcaccatcacttgccggganaagtcggaacattgacacctatttaaatgatcaacatagaccaggacggcccctaagctcctaatctatgctgcatccaagtttgacaaagtcggggtcccatcgaggttcagtgcagtgatcgnggacagtattcactctcacctatccaagtatctgcaaacgtnaagtattttcgactaacttattacttagtactaacaagtaacttaactaattgtttaccggaccgaaagggtaacaacggtaacttaaacctaaaagtttaaaaccgaaacttcgttacgggctttacggacccgtaaaccttacttacggttaccgttacgttttaacccacgtttaccctttacccccggaccttaacgttaccgttaagttaaccg

SEQ ID NO: 142123 - DNA, 656 bp, Homo sapiens
  misc_feature: GYAE6OF02G59RB.46.67.G01.1.454.CMB.1.raw
  modified_base (254)..(254): a, c, t, g, unknown or other
  misc_feature (254)..(254): n is a, c, g, or t
  modified_base (336)..(336): a, c, t, g, unknown or other
  misc_feature (336)..(336): n is a, c, g, or t
  modified_base (422)..(422): a, c, t, g, unknown or other
  misc_feature (422)..(422): n is a, c, g, or t
  modified_base (619)..(619): a, c, t, g, unknown or other
  misc_feature (619)..(619): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtcccctcacctgccgctgtctctggtcgcctcatcagtagttggtttcttcgtggggctgggtccgcngcctccgaggggagggctaggaatacattggaagtgtctctcagtagtggtaggttcctattacacgttccgtctctcaagngtacgagtccaccatatcctctggacacgtcagcaactctacgttttcccagtaacgatagtagtttcgtgttcggaccgcccggnttcggacgtacgggttacgttttataccttggttacgacggtacgaaggacggtacctttattacgtgtttagttttttgggaggttttaggtttactttaccgtacccttaacccgttaggtacgttccggggacggggttccgtcccggtaaccccgggttggggacccggtaaggtaacgtacgtcggttaccncccggtttacgtaccccgttagcccccgttaacccgg

SEQ ID NO: 142124 - DNA, 636 bp, Homo sapiens
  misc_feature: GYAE6OF02FN2UE.46.67.G01.1.454.CMB.1.raw
  modified_base (193)..(193): a, c, t, g, unknown or other
  misc_feature (193)..(193): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccgtggganacagtgtcaccatccacttgccgggcaagtcggaacattgacacctaatttaaatgtatcaacatagacagggacgcccctaagcctctaatctatgctgcatcctagtttgactaaaggtcgggtaccctagtccgaggttcaggtgctaggtgatcgagggactagtattcactctcgactatactaagtaactctacgacgaacgtagaacgttagtttacgacttaaacttactttactacgtactaaacgtagtaaactttaacgtaagtttacgttttaccggaacgtaacggggtaacctaacggtaaacctttaaacgtaaaacgtttaaacggtaacgttaggtaccggtacttacggaccgtaacctaaccttacgttacgttaccttacgtaccgtttcccgtacccggtacctacgttccgtagttaaccg

SEQ ID NO: 142125 - DNA, 575 bp, Homo sapiens
  misc_feature: GYAE6OF02FM9XR.46.67.G01.1.454.CMB.1.raw
  modified_base (293)..(293): a, c, t, g, unknown or other
  misc_feature (293)..(293): n is a, c, g, or t
  modified_base (339)..(339): a, c, t, g, unknown or other
  misc_feature (339)..(339): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagaccctgtccctcacctgcgctgtctctggtgcctccatcagtagtggtttcttctggggctgggtccggcagctcccgaggggaaggggctgggaatacagttggaagtgtctctcatagtggaggttcctattacagtccgtctctcaagngtcgagtcaccatatctctggacacgtccagcaatcagttttcccngaagatgagttctgtgaccgccgctgacacgggcttttatactgtgcgagagacggctattatgtattttggagttggttatttcgactaccctagactcggacggggtctcgaccccgtggggccgaggggaagtacgtcggttcaccgttctaccttacgccctccaccgaacgggcccacgtccggttaccttcccccgtcggccctaccccttcctaccgacgtagtacccg

SEQ ID NO: 142126 - DNA, 768 bp, Homo sapiens
  misc_feature: GYAE6OF02G69V5.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgagggccttcggagaccctgtccctcacctgcgctgtctctggtgcctccatcagtagtggtttcttcgtggggctgggtcccggcacgctcccgaggggaaggggctggaatacagttggaagtgtctctcataggtggtacggttcctattacagtccgtctctacaagagtcgagtcaccatatctcgtggacacgtccagcaatctacgtttcccagaagatagtagttctggtcgaccgtccgcgtgacgaccgggttacttttacgttacgtggtcgacggaaggacggtaccgtacgttagttaacgttggttaagtttttagggtaggtttagggttttacgtttaccggtaaccgttaaccccgttaagggtaacccggttacggggtaacccggggggtccggttaccccgggtaacccccggttacggggggaccccggtaacggggtaaaccggttaccgggttcggttacccggtacccgttaccgttacccgttaccgtccccgttacccgaacccggtaacccgggtacccccgttacggttaccccggttccccgtttacccccccggttccgggtacccccgttacccccgttacccgacccgtaaccgggtcctaacccccgg

SEQ ID NO: 142127 - DNA, 633 bp, Homo sapiens
  misc_feature: GYAE6OF02GE7K6.46.67.G01.1.454.CMB.1.raw
  modified_base (353)..(353): a, c, t, g, unknown or other
  misc_feature (353)..(353): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagttagtggtttcttcgtgggctgggtccggcagctccgagggagggctaggaatacagttggaagttgtctctcagtagtggtaggttcctattacagtccgttctctcgaagagtcgagtcacctatatctcgtggacacgtccagtacaattcctacgttttcccagtaanatgtagttctgtcgaccgtcgcgtcgacgacgggttactttacttacgtgttgcggagagacggtattattgtgttagttttggtagtttgttactttcgacctaccttagacgtcgggcgggtcctccgtacccgtggggaccagggttacgtcgtacggtcctacgttccttccgttacctcctacccgaaccggaacggtaccccgtacggttcccggttacccctttcccccggtcgtacccctacccctcccgtaccggtaacgcccgtaccccg

SEQ ID NO: 142128 - DNA, 572 bp, Homo sapiens
  misc_feature: GYAE6OF02FT661.46.67.G01.1.454.CMB.1.raw
  modified_base (192)..(192): a, c, t, g, unknown or other
  misc_feature (192)..(192): n is a, c, g, or t
  modified_base (309)..(309): a, c, t, g, unknown or other
  misc_feature (309)..(309): n is a, c, g, or t
  modified_base (430)..(430): a, c, t, g, unknown or other
  misc_feature (430)..(430): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatccacttgccgggacaaggtccgaacattgacaccttatttaaatggtatcaacatagaccagggaccgcccctaagctactaatctatgctgcatcctagtttnacaaggtcgggtcccagtcgagttcagtggctagtgatcgtgggactagtattcactctcacctatacagtactctagtactagtagtaagtatttgactaacttacttactcgtactaanagtaattactaagttcgtttacggacgtaacggtactaacgtaactaacgtaaacgttaaacgtaagtgtacgtactacgacctaactactcttacgttcttactaccgttacccttcccgtacctacgttacctagtaacg

SEQ ID NO: 142129 - DNA, 594 bp, Homo sapiens
  misc_feature: GYAE6OF02HW1AQ.46.67.G01.1.454.CMB.1.raw
  modified_base (196)..(196): a, c, t, g, unknown or other
  misc_feature (196)..(196): n is a, c, g, or t
tcagactagcagtacacgaccggtgctcgatttagagtatacataattggggtttaggggagtctcggtcaggacacagcatggacaatgagggtccccgctcagctcctggggctcctgctactctggctccgaggtgccagatgtgacatcgagctgacccagtctccatcctccctgtctgcaaccgtggganacagtgtcaccatcacttggccgggcaagtcggaacattgacctacctaatttaaattggtatacaacatacgaccagggacgccctaagctcctaatctaatcgctgacacgtcctaggttttcgactaaaggttcggggtacccagtcggaggttcgagtggacaggtaggatcgtagggactagtacttacactctcaacctatcaagttaactctagacgtaaacggtagtaagttattttacgactaaccttattactagtacaactagtaatactaagttcgtttaccgacgtaacggactacgtaactaacgtaaacttaaacgaacgtgtagacgtcgactacctacttcgtgttaccttctaccgttccttacccacctattctagtac

SEQ ID NO: 142130 - DNA, 524 bp, Homo sapiens
  misc_feature: GYAE6OF02FQ3II.46.67.G01.1.454.CMB.1.raw
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttgccgggcaagtcggaacattgacacctattaaatgtatcaacatagacagggacgcccctaagctctaatctatgctgcatcctagtttcgactaaaggtcggggtacccagtcgtaggttcaggtggcagtggatcgtggacagtacttcactctcaccatcagtatctgacaacgtagtaagtatttcgactacttattactgtacactataattactaattgtttcgacgtaggacacgtactaacaaataaacgaatagtagctgactacactctagtcttatacttcctaccgactacttctagtac

SEQ ID NO: 142131 - DNA, 756 bp, Homo sapiens
  misc_feature: GYAE6OF02IS9QR.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagttggtttcttcgtggggcttgggtcccggcacgcgtcccgaggggaaggggctaggaatacagttggaagtgtctctcataggtggagttcctattaccagtccgtctctcaagacgtcgagtccaaccattattcctcgtcgggacctacgtccagactaactcttacgttttccagtaagtatgtagttctggtccgaccgtccgtcgtgtaccgacgggtttacttttacgttacgtcgtacgacggaaggacggaacggttcttaaagttagttacggttttaggtttttcgggaggttttaggtttacgtttaccgtaacccgttaacccgttaggtaaccgttccggggaccggggtaccgtaccccgggtaccccgggttacggggaccgaacggggtaacttacccgggttcggttaccgtacccggtttcccttacccggttaccgtaccccgttacccggtaaccccgggaacccgggttacccctacgggtttccccggttcccctttcccccggtccggtccccctacccccgtttacccaaccgtacggaccgtccccg

SEQ ID NO: 142132 - DNA, 547 bp, Homo sapiens
  misc_feature: GYAE6OF02GJPHD.46.67.G01.1.454.CMB.1.raw
  modified_base (340)..(340): a, c, t, g, unknown or other
  misc_feature (340)..(340): n is a, c, g, or t
  modified_base (368)..(368): a, c, t, g, unknown or other
  misc_feature (368)..(368): n is a, c, g, or t
  modified_base (426)..(426): a, c, t, g, unknown or other
  misc_feature (426)..(426): n is a, c, g, or t
tcagactagcagtacacgaccggtgctcgatttagagtatacatattgggtttggggagtctcgggtcaggacacagcatggacatgagggtccccgctcagctcctggggctcctgctactctggctccgaggtgccagatgtggacatcgagctgacccagtctccatcctcctgtctgcaaccgtgggagacagtgtcaccatcacttgccgggcaagtcggaacattgacactattaatggtatcaacatagacctagggacgcccctaaagcctcctaactacctaatgctgctatccagtttcgctaaagtggggtcccatcgaggttcagtgnagtgatctgggacaggtatttcacgtcncaccactacagtaatctgcaacgtgaagtagtttagactaacttattactagtacaanagtaattactaatgtttacgactaaggacacgtactacgtaaataacgaacgtgtacgactaggactacgtaactcgtacgtacgttcgacttccgttacccaccgtacttccgtgtaacc

SEQ ID NO: 142133 - DNA, 613 bp, Homo sapiens
  misc_feature: GYAE6OF02FU3E9.46.67.G01.1.454.CMB.1.raw
  modified_base (221)..(221): a, c, t, g, unknown or other
  misc_feature (221)..(221): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatccctccctgtctgcaaccggtgggagacagtgtcaccatcacttggccgggnaagtcggaacattgacacctatttaaatggtatcaacatagaccagggacggcccctaagctcctaatctatgctgcatccagttttcgacaaaggtggggtacccagtccggtaggttcagtgggcaggtggattcgtaggggacagtactttccactcctacgaccagtacctaagtaacttactgacctaaacggtgtaaagtattttacgactaacttattaacttagtcaaacaagtaattaactaattggttttaccggaccgtaagggtacctaacgaacttaactaaacgttaaaacgtaactagtacggtctacggtactaacctagttacctacgttacctttacgtacttaccgttacccgtacctacgttcctagtaacc

SEQ ID NO: 142134 - DNA, 667 bp, Homo sapiens
  misc_feature: GYAE6OF02GRCPZ.46.67.G01.1.454.CMB.1.raw
  modified_base (537)..(537): a, c, t, g, unknown or other
  misc_feature (537)..(537): n is a, c, g, or t
tcagactagcagtacacgaccggtgctcgatttagagtatacatattgggtttgggggacctcctgtgcaagaacatgaagcacctgtggtttgtcctccctgctggtggcagcctcccagatgggtcctgtccctggtgcaactgcaggaggtccgggcccacgacgtgggtgacggtccttcggacgaccctgtcccctcacctgcgtctgtcctcgtggtcgtcctccatcgagttagttcggttttcgttcggtcgggggtcgttcggggtccgcgacgcccgtcccggaagggggacgggtccgtaggaatacgtagttagggaagttcgtctctctagtaggtggtacggttacctagttacgacgttccgtctactcgaagtcgtacgactacacctatactctcgacggactaccgtcagactaactcgttaccgttttacccaggaacgtgtagttacgttctggtccggacccgccgtcgtacggacgtacgggttctttaactgtggtcgacggagacgtacgttnttagttagttcggtttagttttaggagtttaggtttcttacgaacctacgtagcgtcggtaccgggctcccggtaccggtcgggacgaggtactcgtacggtcgtacccgttcgtctaccgccgtacccg

SEQ ID NO: 142135 - DNA, 587 bp, Homo sapiens
  misc_feature: GYAE6OF02F6RMK.46.67.G01.1.454.CMB.1.raw
  modified_base (216)..(216): a, c, t, g, unknown or other
  misc_feature (216)..(216): n is a, c, g, or t
  modified_base (344)..(344): a, c, t, g, unknown or other
  misc_feature (344)..(344): n is a, c, g, or t
  modified_base (346)..(346): a, c, t, g, unknown or other
  misc_feature (346)..(346): n is a, c, g, or t
  modified_base (549)..(549): a, c, t, g, unknown or other
  misc_feature (549)..(549): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggagacagtgtcaccatcacttgccggnaagtcgacattgacacctatttaaatggtatcaacatagacagggacgacccctagctcctaatctatgctagcatccagtttgacgtaagtcggggtccctagtacggtagttacgagtggctaggngntcgtagggacagtagttcactctaccactatactagtaactctgacaacgtgaagttatttacgattaacgttattacgtagtacctaaacgtaagtaaacgtttactaagtttaccggttttacggacgtaaacgggtactaacggtaactaaactaaacgttaaacgacgtagttacgactagaccgtaacacttacgttnttacttacacgttcccttcccgactactactacgtacg

SEQ ID NO: 142136 - DNA, 574 bp, Homo sapiens
  misc_feature: GYAE6OF02JH5BZ.46.67.G01.1.454.CMB.1.raw
  modified_base (191)..(191): a, c, t, g, unknown or other
  misc_feature (191)..(191): n is a, c, g, or t
  modified_base (215)..(215): a, c, t, g, unknown or other
  misc_feature (215)..(215): n is a, c, g, or t
  modified_base (250)..(250): a, c, t, g, unknown or other
  misc_feature (250)..(250): n is a, c, g, or t
  modified_base (366)..(366): a, c, t, g, unknown or other
  misc_feature (366)..(366): n is a, c, g, or t
  modified_base (394)..(394): a, c, t, g, unknown or other
  misc_feature (394)..(394): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtggganacagtgtcaccatcacttgccggnaagtcgaacattagacactatttaatgtatcaacntagacaggacgccctaagctactaatctatcgactgacatccagtttcgactaaaggtcgggtaccagtcgtagttcagtcgctagtcgatcgtagggcagtattcactctcaccntacagtaactgtagacaacgtataagtntttagacaacgtttatctagtaactaacagttaactttacagtttcggttaccgacgtaacggacctaacgtactaaaccgtaaagttaaacgaacgttcgtacgtacttacgacctaaccttatctacgtacctttacaaccgttcctttaccccgaacctagttaccgtagttaaccg

SEQ ID NO: 142137 - DNA, 616 bp, Homo sapiens
  misc_feature: GYAE6OF02IHKFA.46.67.G01.1.454.CMB.1.raw
  modified_base (200)..(200): a, c, t, g, unknown or other
  misc_feature (200)..(200): n is a, c, g, or t
  modified_base (219)..(219): a, c, t, g, unknown or other
  misc_feature (219)..(219): n is a, c, g, or t
  modified_base (258)..(258): a, c, t, g, unknown or other
  misc_feature (258)..(258): n is a, c, g, or t
  modified_base (290)..(290): a, c, t, g, unknown or other
  misc_feature (290)..(290): n is a, c, g, or t
  modified_base (359)..(359): a, c, t, g, unknown or other
  misc_feature (359)..(359): n is a, c, g, or t
  modified_base (364)..(364): a, c, t, g, unknown or other
  misc_feature (364)..(364): n is a, c, g, or t
  modified_base (463)..(463): a, c, t, g, unknown or other
  misc_feature (463)..(463): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctagacccagtctccactcctccctgtctagcaacggtggagacagtntcaccatcactcgaccggnaacgtcggaacatcgactactaatttaaatgtatacaanatagacgaggacgacctagctactaatctatnactgactatcctggtttaacacgtaaacggtcgggtacccagtacgtagttcagtggcaggtgctaggnggaanagttattcgaacttcgaacacatgtaagtatacgtagaacgtaacgaggtaattacgttagactaagttacttagtacgttacaactaagtaacttaanaagtttcggtttaccggaacgtaacggaccgtaacgtaaaccttaacgtaaaacttaaacgaacgttaacgtcgacttacggtaaccctaagttaccttaggttacctttacgacttacccgtccgttacctaacggtcttacgtaacttacg

SEQ ID NO: 142138 - DNA, 533 bp, Homo sapiens
  misc_feature: GYAE6OF02HX92Z.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcgaacattgacactatttaaatgtatcaacatagaccagggacggcccctaagctcctaatctatgctgcatccagtttgcaaagtggggtcccatcgaggttcagtggcagtggatctgggacagatttcacttctcaccatctagtaatctgacaacgtgaagtattttgctaacttattactagtcaactagtaattactaattgtttacgaccgtaaggaactacgaactaactaaacttaaacgaactagtagtactgacaacgtactctcgttccttactactccttacccgcctacttctagtac

SEQ ID NO: 142139 - DNA, 602 bp, Homo sapiens
  misc_feature: GYAE6OF02HNWDI.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacacctatttaaatgtatcaacatagaccaggacgccctaagctctaatctatgctgcatccagtttgacaagtcgggtccatcgaggttcagtgcagtgatcgtgggacagattcactctcaccatcagtatcgtgacaacgtgtaaagtattttagactaactttagttacttagtacaaacgtaagtaaacttactaaagttcggttttaccgacgtaaacgggaactaaccgtaacttaaacgaaaaacttaaaccggtaaaacttggtacggtaccttaggaaccctaaccgtacttcgttaacgttaccgtttaccctaacgttttcccctacccggtacccttaacgttaccgttacgtaaccg

SEQ ID NO: 142140 - DNA, 584 bp, Homo sapiens
  misc_feature: GYAE6OF02FH02M.46.67.G01.1.454.CMB.1.raw
  modified_base (181)..(181): a, c, t, g, unknown or other
  misc_feature (181)..(181): n is a, c, g, or t
  modified_base (236)..(236): a, c, t, g, unknown or other
  misc_feature (236)..(236): n is a, c, g, or t
  modified_base (250)..(250): a, c, t, g, unknown or other
  misc_feature (250)..(250): n is a, c, g, or t
  modified_base (373)..(373): a, c, t, g, unknown or other
  misc_feature (373)..(373): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccagactggtgaggcccttcggganaccctgtccctcacctgcgctgtctctggtgcctcatcagtagttggtttctcgnggggctgggtccgnagcctccgagggagggctggaatacgattggaagtgtctctcatagtggaggttctattacagtccgtctctcaagagtcgagtcacatactctctggacacgtcagcaatctagttttcccngaacgtatgacgtttctgtacgaccgccgcgttgaccgtacgggttactttacgtacgttgtcgcgtagacgacggtactagttatagttagttttggagtttgttacttcgactaccgtagacgtccgggacgggtcctaccggtacccggtcgggaccgtaagggtaactacgtcggtccacccggttctaccgttacgccctaacccg

SEQ ID NO: 142141 - DNA, 585 bp, Homo sapiens
  misc_feature: GYAE6OF02HLSC9.46.67.G01.1.454.CMB.1.raw
  modified_base (193)..(193): a, c, t, g, unknown or other
  misc_feature (193)..(193): n is a, c, g, or t
  modified_base (219)..(219): a, c, t, g, unknown or other
  misc_feature (219)..(219): n is a, c, g, or t
  modified_base (230)..(230): a, c, t, g, unknown or other
  misc_feature (230)..(230): n is a, c, g, or t
  modified_base (257)..(257): a, c, t, g, unknown or other
  misc_feature (257)..(257): n is a, c, g, or t
  modified_base (536)..(536): a, c, t, g, unknown or other
  misc_feature (536)..(536): n is a, c, g, or t
  modified_base (571)..(571): a, c, t, g, unknown or other
  misc_feature (571)..(571): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgtcaccatcacttggccgganaagtcggaacnttgactacttatttaaattgtatcaanatacgaccaggaccgcccctagctacctatctatgctgctactccagtttgacgtaaggttcgggtcccagttccggagttacagtggactaggtggatcggtaggacgtacgtacttctactctcacctatacgtaagttactcgtacgaactaacggtagtaacgttatttcgaactaactttagtacttacgtaacaactagtaattaactaattcgtttacggacgtaaggaccacgtaactaacgtaaagttaaacgacgtgagtctacgtacncgtaacttgtcgttaccttctacttcccgttaccnccttagtctagtac

SEQ ID NO: 142142 - DNA, 683 bp, Homo sapiens
  misc_feature: GYAE6OF02GLDFS.46.67.G01.1.454.CMB.1.raw
  modified_base (296)..(296): a, c, t, g, unknown or other
  misc_feature (296)..(296): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcgcctccatcagtagtggtttcttcgtggggctgggtccggcagctcccgaggggagggctggaatacagttggaagtgtctctcagttaggtggtaggttccttattacagtccgtctctcaagnggtcgagtccaccatatctctacggacacgtccagcaatctacgttttcccagaagatgtagttcgtggtcgacccgccgtctcggacgtacggggtacttttattacgtgtagcggagagtacggtacttattagtagttagtttttggaggtttggtttacttccgtacgtacccgttagtacgtccgggacggggtccgttcccggaccccggtggggcccgtaaggggtaacgttaccgttcggttaccgtaccgttccgttacccgttaccgtccctacccgaacccggtaacgggccccgttaacgttccccggtttcccccgtttcccccgtaccggtcccctacccccgttacccgtacccgtaccgtacccgtacccg

SEQ ID NO: 142143 - DNA, 582 bp, Homo sapiens
  misc_feature: GYAE6OF02HPPWW.46.67.G01.1.454.CMB.1.raw
  modified_base (211)..(211): a, c, t, g, unknown or other
  misc_feature (211)..(211): n is a, c, g, or t
  modified_base (345)..(345): a, c, t, g, unknown or other
  misc_feature (345)..(345): n is a, c, g, or t
  modified_base (354)..(354): a, c, t, g, unknown or other
  misc_feature (354)..(354): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagaccctgtccctcacctgcgctgtctctggtgcctccatcagtagtggtttcttctggggctgggtccggnagctccgagggaaggggctaggaatacagttggaagtgtctctcagtagtggaggttcctaattacagtccgtctctcaagagtcgagtcaccatatctctggacacgtcagcaatctacgttttcccagaagntgtagttcnggtcgaccgcgctgacgacgggtctttatactggtgcgagagacgctattagtgttattttggagttggttattcgaactacctagtactcggacggggtctccgacccgtgggaccgtagggtaactacgtcgggtaccaccgtcgtccgttacgccctaccgacgtaaccgggccctagtcccggttaccttccccgtcgccctacccctccacctagactacccg

SEQ ID NO: 142144 - DNA, 766 bp, Homo sapiens
  misc_feature: GYAE6OF02G19SM.46.67.G01.1.454.CMB.1.raw
  modified_base (206)..(206): a, c, t, g, unknown or other
  misc_feature (206)..(206): n is a, c, g, or t
tcagactagcagtacacgaccggtgctcgatttagagtatacatattgggtttgtcctcctgctggtggcagctcccagatgggtcctgtccctggtgcaactgcaggagtcggcccacgactggtgaggccttcggagaccctgtccctcacctgcgctgtctctggtgcctcatcagtagtggtttctcgtgggctgggtccgnagctccgagggagggctggaatacagttggaagtgtctctcagtaggtggtacggtttcctaagttacacggttccgtctctacgaaaggacgtacgtaacgtccaacctattactccgtcgtacggaacctaccggtccagaccaacttctaacgttttccccaggtaacgattaggtacgttaccgtggtaccgacccggtccgtacgtacgaccggtacggggttacgttttaacttacgtggtacggacggtaaggacggtacggtacttaagtttaagttacggtttagttttagggtagttttagggtttaactttaccggaaccttaacccgttaggtaacgttccgggggaacggggtcccgtaccggtaccccgggtcgggggaacccgtaacggggtaacttaccggtacgggttacccgtaccggttcccttaccgttaccgtccctaacccgtacccggaaccgggtccctaccggttcccggttaccccttaccccccggtacggtacccctacccccgttaccgtacccgtaacgaccgtaccccg

SEQ ID NO: 142145 - DNA, 507 bp, Homo sapiens
  misc_feature: GYAE6OF02HUOCI.46.67.G01.1.454.CMB.1.raw
  modified_base (216)..(216): a, c, t, g, unknown or other
  misc_feature (216)..(216): n is a, c, g, or t
  modified_base (477)..(477): a, c, t, g, unknown or other
  misc_feature (477)..(477): n is a, c, g, or t
  modified_base (481)..(481): a, c, t, g, unknown or other
  misc_feature (481)..(481): n is a, c, g, or t
  modified_base (488)..(488): a, c, t, g, unknown or other
  misc_feature (488)..(488): n is a, c, g, or t
  modified_base (496)..(496): a, c, t, g, unknown or other
  misc_feature (496)..(496): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcacatcacttgccgggnaagtcggaacattgacactatttaaattggtatcaacatagaccagggacggcccctaagctctaatctatgctgcatccagtttgcaaagtgggtcccatcgaggttcagtggcagtggatcgtgggacaggatttcactctacaccatcagtaatctagacaacgtgaatattttagtaactttatactgtacaacagtaattacattacgtttcgacgtaaggcacgtactaacaaattaacgatgtgactgacactntctntcttacnctcctccnccatctgatcg

SEQ ID NO: 142146 - DNA, 539 bp, Homo sapiens
  misc_feature: GYAE6OF02ISVM1.46.67.G01.1.454.CMB.1.raw
  modified_base (191)..(191): a, c, t, g, unknown or other
  misc_feature (191)..(191): n is a, c, g, or t
  modified_base (346)..(346): a, c, t, g, unknown or other
  misc_feature (346)..(346): n is a, c, g, or t
  modified_base (486)..(486): a, c, t, g, unknown or other
  misc_feature (486)..(486): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgganacagtgtcaccatcacttgccgggcaagtcggaacattgacactatttaaatggtatcaacatagaccagggacggcccctaagctctaatctatgctgcatccagtttgcaaagtcgggtccagtcgaggttcagtgcagtgatcgtggacagnttcatctcacatcaagtactctgactaacgtgaacgtattttgactaacttattactagtacaacagtaattacatttcgtttcgactaagggacaacgtaactaacgaaattaaacgatagtagctacgactaaccgtnttcgtacttccgttactaacttcccgttacccgaccttacttacgtagtaacc

SEQ ID NO: 142147 - DNA, 602 bp, Homo sapiens
  misc_feature: GYAE6OF02F14VU.46.67.G01.1.454.CMB.1.raw
  modified_base (226)..(226): a, c, t, g, unknown or other
  misc_feature (226)..(226): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtggagacagtgtcaccatcacttgccgggcaagtcggaacnttgacacctatttaaatggtatcaacatagaccgagggaccggacccctaagcctacctaatctatgcctgcatcctagtttgactaaaggtcgggtacccagtcgaggttcagtggcgagtgtagtcgtgggacagtactttcacttctacacctatacagttaactctacgtactaaacgtgtaagttattttagacttaacttattactagtacaagtaacttaacttaactaagtttacggttacggaccgtaagggtactaacgtaacttaaacgtaaaattaaaccgaacgttacggtgtaccgtacgaccgtaacctacgttacttcgttcttacgtacttaccgttacccgctacgttcctagtaccg

SEQ ID NO: 142148 - DNA, 582 bp, Homo sapiens
  misc_feature: GYAE6OF02GW3L4.46.67.G01.1.454.CMB.1.raw
  modified_base (319)..(319): a, c, t, g, unknown or other
  misc_feature (319)..(319): n is a, c, g, or t
  modified_base (346)..(346): a, c, t, g, unknown or other
  misc_feature (346)..(346): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgaggggaaggggctgggaatacattgggaagtgtctctcataggtggtaggttcctattacagtccgtctctcaagagtcgagtcaccatatctctggacncgtcagcaatctagttttcccagaagntgtagttctgtcgaccgcgctgacgacggtctttatacgtgtgcgagagacggtctattagtgttagttttgggagttggttatttcgactaccgttagtacgtcgggacggggtctccggacccggtgggaccgagggactacgtgtacctaccgtctaccgttacgccctccgaccgtacggcccagtcccgttcccttccccgcgtccctaccctcctacctacgactacccg

SEQ ID NO: 142149 - DNA, 643 bp, Homo sapiens
  misc_feature: GYAE6OF02IRB81.46.67.G01.1.454.CMB.1.raw
  modified_base (216)..(216): a, c, t, g, unknown or other
  misc_feature (216)..(216): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccggnaagtcggaacattgaccacctaatttaaattggtatacaacatagaccgagggacgcccctaagctcctaatctatgctgcactccgtagtttcgacgaaaggtcgggtcccagtcgtagttcgagtggcagtgatcgtagggacagtatttcactctccactactactagtaactctagactaacgtagtaagttatttacgacttaaactttacgttacttagttaacctaacgtaagttaaactttaacgttaattcggttttacggaaccgtaaagggtaaccaacgtaacttaaaccgtaaaaacgttaaaccgtaaacgttggtacgtaccgtacgtaccgtaacccttaacttacgtttccgttaccgtttaccgtaaccgtttcccgtttaccccgtcctaacgtttccgttagtaacg

SEQ ID NO: 142150 - DNA, 739 bp, Homo sapiens
  misc_feature: GYAE6OF02FTK6G.46.67.G01.1.454.CMB.1.raw
  modified_base (237)..(237): a, c, t, g, unknown or other
  misc_feature (237)..(237): n is a, c, g, or t
  modified_base (262)..(262): a, c, t, g, unknown or other
  misc_feature (262)..(262): n is a, c, g, or t
  modified_base (266)..(266): a, c, t, g, unknown or other
  misc_feature (266)..(266): n is a, c, g, or t
tcagactagcagtacacgaccggtgctcgatttagagtatacatattgggtttgggggagtctcggtcaggacacagcatggacatggagggtccccgctcagctcctggggctcctgctactctggctccggaggtgccagatgtgacatcgagctgacccagtctccatcctcctgtctgcaaccggtgggagacaggtgtacaccatcacttggccgggacaaggtcggaactnttgactaccttatttaaagttgtancaanatacgaccgagggaccgtcccctaagcctactaacgtctatgctcgctactccgtagtttgaacgaaaggtcggggtaccctagttcggtaacggttcgagggtcggacgtaggttcgggtaacgttccggtaggggtacgtaacgttacgtttacaacgttcctaccgtaacctagtactaagttaactacgttggaacctaacggtagtaaacgttagttttacgtaccttaaactttacgtttaaccgtacgttaaccgtaaacgtaaagttaaacttaacgtttaacgtttacggttttaacccggaacgttaaacggggaacctaaccggtaaacttaaaccgttaaaaacgttaaaccggtaacgttcgacgggtaccgtaacgtacccgtaaccttacgttccgttacgttacgttaccttaccgttacccgttaccccgaccgttacttaccggttactaaccgg

SEQ ID NO: 142151 - DNA, 800 bp, Homo sapiens
  misc_feature: GYAE6OF02JZ0EF.46.67.G01.1.454.CMB.1.raw
  modified_base (606)..(606): a, c, t, g, unknown or other
  misc_feature (606)..(606): n is a, c, g, or t
  modified_base (768)..(768): a, c, t, g, unknown or other
  misc_feature (768)..(768): n is a, c, g, or t
tcagactagcagtacacgaccggtgctcgatttagagtatacatattgggtttgggggacctcctgtgcaagaacatgaagcacctgtggtttgtcctcctgctggtggcagcctcccagagtcgggtcctgtccctggtgcaactgcgaggagtccgggcccacgactggtgacggtccgttcggacgacccttcgtccctacaccgtgccgtcttggtcctcgtggtccgccctacctagtcgtaagttggttcggttttccttacggtggggtccgttcgggggtcccggactacggtcccgttacccgggaagggggtaacgggtctaacggtaacttacgtaaggtttagggaacgtttgtaccttgtactacgttagggtgggtacgtttacctaacgttacgtacgttccgttcgtacttacgaaaggtacgttcgtaacgtaccaccgtattacgtaccgttcgtaacgacctaccgttacgacgtaaccgttacgttaccgtttaacgttttcccgaaggtaagttaacgtacggtttacgttacgtcgtaaccggtaccccgtgccggtaacgtaccgggttaggtttaccgtttntacggtgtacggtacgagtacgtacgttactaaggttcgttaaggtttacgttgtaagttcgtttaacgtaccgtaccctaacggtagtacggtaccgggtaccgtaccgtacccggaacggtcggtaaccggtaaggttaccgtcgttacgtaccccggtntttaacccgtacggttaccgcccgtaacccgg

SEQ ID NO: 142152 - DNA, 632 bp, Homo sapiens
  misc_feature: GYAE6OF02FG4K4.46.67.G01.1.454.CMB.1.raw
  modified_base (404)..(404): a, c, t, g, unknown or other
  misc_feature (404)..(404): n is a, c, g, or t
tcagactagcagtacacgaccggtgctcgatttagagtatacatattgggtttgtcctcctgctggtggcagctcccagatgggtcctgtccctggtgcaactgcaggagtcggcccacgactggtgaggccttcggagaccctgtccctcacctgcgctgtctctggtgcctccatcagtagtggtttcttcgtggggctgggtccggcagctcccgagggagggctggaatacagttggaagtgtctctcagtagtggaggttcctattacagtccgtctctcaagagtcgagtcaccatatctctgacacgtccagcaatctacgttttcccagaagtatgtagttctgtcgaccgcgcgtgaccgacgggtcgttttattacgtgtcgcgagagacggtntagttatgtagttttggtagttaggttatttacgacctaccgttagacgtcggacggggtcctccggtaccccggtcggggaccgagggtaacgttacgttcggtccgacccgttcctaccgttacgtccctaccaacccggaaccgggtacccctacggttcccggttcccgttcccccgtcgggtaccctacccccgttaccctacccgtaacgtccggtaccccg

SEQ ID NO: 142153 - DNA, 544 bp, Homo sapiens
  misc_feature: GYAE6OF02FQ9HE.46.67.G01.1.454.CMB.1.raw
  modified_base (343)..(343): a, c, t, g, unknown or other
  misc_feature (343)..(343): n is a, c, g, or t
  modified_base (421)..(421): a, c, t, g, unknown or other
  misc_feature (421)..(421): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgaccaagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtgggtcccatcgagttcagtggcagtggatcgngggacagattcactctcaccatcagtaactctgcaacgtgtaagtattttgacctaaacttattacttgtactaacanaattaactaattggttttacgaccgtaagggtacctaacgactaaactaaaattaaacgaactgtagtctacgacaaccattcctagttacttactcttaccttcccgactacttactgtaac

SEQ ID NO: 142154 - DNA, 696 bp, Homo sapiens
  misc_feature: GYAE6OF02HM5AB.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctnacctgcgctgtctctggtgcctcatcagtagtgtttctctggggctgggtccgcagctccgagggagggctggaatcgattggaagtgtctctcatgtggaggttcctattacagtccgtctctcagagtcgagtcaacgatactctcgtggacacgtccagtacaatctaacgttttcccaggaatatgtagtttctacggtcgacccgtcccgtgtacgaaccgtacgggggttctttttaagtaccgtgggttcgtacggtaaggacgtaccggtactttaaagtttacgttaggtttaggttttttacgggaaggttttagggttttaaccgttttaccggtaaccctaacccggttaaggtacgttacccggggtaccgggggttcccttacccggtacccccggggttgggggtaccccgaaaggggttaaccttacggttccgggtaacccgtacccggtttaccgtttacccgtttacggacccccttaccccggg

SEQ ID NO: 142155 - DNA, 783 bp, Homo sapiens
  misc_feature: GYAE6OF02HFGGG.46.67.G01.1.454.CMB.1.raw
  modified_base (466)..(466): a, c, t, g, unknown or other
  misc_feature (466)..(466): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgagggccttcggagaccctgtccctcacctgcgctgtctctggtcgcctccatcagtagttggtttcttcgtggggtcttcgggtccggcagcctcccgaggggaaggggctaggaatacagttgggaagtgtctctacatggtggtacggttcctattacacgttccgtctctcgaacgagtactacggtcaccattatactgtacggactaccgtccagcaactcgtacttttcccgtacgaagtagtcgtagttacgttgtcggaccgcccgtacgtacgaacgtacgggtacgtttttacttacgttggttacggcgaaggaacgtaaccgggtnttaactttggttaacgttggtttttacgggtagttttagggtttaacttttaccggaacccgttaccgttaacggtaaccggtcgggtaacccgggggtccgttaccccgtaccccggggttccgggaaccgggtacggtaaactttacccgggttcgttaaccccgttccgttcccgttacccgttaccgaccgtacccccgttaaaccggggacccggaacccgttaacgttcccccggtttcccccgtttacccccgggtaccccgttacctacccccgttacccggttaacccaacggtccccggttaacccg

SEQ ID NO: 142156 - DNA, 736 bp, Homo sapiens
  misc_feature: GYAE6OF02IRPVY.46.67.G01.1.454.CMB.1.raw
  modified_base (303)..(303): a, c, t, g, unknown or other
  misc_feature (303)..(303): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgagggccttcggagaccctgtccctcacctgcgctgtctctggtgcctccatcagtagtggtttcttcgtggggctgggtccggcagctcccgaggggaagggctaggaatacagttgggaagtggtctcgtctataggtggacggtttcctattaccagttccgtctctcaaagngtcgagtcaccatactctctaggacacgtccagacctaaagtctacgtttttcccagaacgtatcgaagtttcctaggcgtacccgccgtcgtgacgacgggttctttaacttacgtggtcgacgtaggtacggtaccggtacttaagtttacgtaggtttagtttttagggtacggtttacggtttagttttacccgaaccgttaccccgttaaggtaacgtaccggggtaccgggggtaccgttacccgggtaaccccggttggggaccccgtaaggggtaacttaccggtacggggtacctaaccggttcctaccgttacgtaccccgtaccgaaccccggtaaccgggtaccctaaccggttccccgggttaacccttcccccggttacggtccctaccccgtttccccgacgtaaccggacgtccccg

SEQ ID NO: 142157 - DNA, 737 bp, Homo sapiens
  misc_feature: GYAE6OF02FYX18.46.67.G01.1.454.CMB.1.raw
  modified_base (228)..(228): a, c, t, g, unknown or other
  misc_feature (228)..(228): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaaggtcgaacnttgacacctattaatgtatacaacatagaccgagggaccgacccctaagctacctaatctatgctgctatcctagtttgacgtaaaggtcgggtaccctagtcggtaggttctaggtggactaggtggactcggtagggactagtatttccgacttcctaccaacctactacgtaacgtttaacgtcctacggtaaccgtaaacggttacgtaaaggttatttttacggaactttaaacgttttactttaaccgttcgtaacctaaacgttaaacgttaaaacgtttaaccttaaaggttttcgggtttttaacccgggaaccggttaaaacgggtaacccgtaaaccgttaaaccgttaaaccgttaaaaaagtttaaacccggtaaacgttagggttaaccgttaccgtacgtaacccgtaaccgtacgtttacccgttacgtttaccgtttacccgttaccgtttccccttaccccgtaaccgtttactttaccgtacgttaaccg

SEQ ID NO: 142158 - DNA, 648 bp, Homo sapiens
  misc_feature: GYAE6OF02HRRVC.46.67.G01.1.454.CMB.1.raw
  modified_base (223)..(223): a, c, t, g, unknown or other
  misc_feature (223)..(223): n is a, c, g, or t
  modified_base (380)..(380): a, c, t, g, unknown or other
  misc_feature (380)..(380): n is a, c, g, or t
  modified_base (452)..(452): a, c, t, g, unknown or other
  misc_feature (452)..(452): n is a, c, g, or t
tcagactagcagtacacgaccggtgctcgatttagagtatacatatttggggtttggggagtctccggtcaggacacagcatggacatgagggtccccgctcagctcctggggctcctgctactctggctcgaggtgccagatgtgacatcgagctgacccagtctccatcctccctgtctgcaaccggtgggagacagtagtcaccagtctacgttgccggnaagtcggaactcttagactacctaatttaaacgtgtatacaacatacgacagggaccgacctaacgctaccgtaatctagtgctgctataccgtagtttacgaacgtaagtcgggacccagtcgagttacagtcggctagtggtactcgtagggacngttacttcactctacacgatactaagtactcgtagactaagtacgtaaatacgtttacgattaaacgtttanacgttataccgaaactagaaacttactaagttttcgtacggtaaccgtaacgggaactacgtaaacgttaaaccgaaaacgtttaaaacggaccgttaggttcgaaccgttaggaacccgactttaacgtccgttaacgtttacctcgtttaaccttccccggttacccgtaacccgtatttaccgagtttaaccg

SEQ ID NO: 142159 - DNA, 699 bp, Homo sapiens
  misc_feature: GYAE6OF02GXY15.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccgcagcctcccgagggaagggctaggaatacagttggaagtgtctctcagtagtggtaggttcctattacagttccgtctctacaagtagtcgagtcacctattactctcgtggacctaccgtcgagctaacgtctacgtttttccctagtaagtagttagtacgttcgtggttcgacccggtccgtcgtacggacgtaccgggttcgttttaacgttaccgtgtacggtcggaaggtacggtaccgggtattaatttagttgtttagttttagggagtttaggttactttacggaacctaccgtagtagtccgggtacgggtcctacccggacccggtcgggaccgtaagggtaacctacggtccgttaccgtaccgtccgttaccgttacgtaccccgttacccgaccggaacccggtaccctacggttccccgttcccgttccccgtccggtccctaccccgttacccgtaccgtacgacccgtacccg

SEQ ID NO: 142160 - DNA, 602 bp, Homo sapiens
  misc_feature: GYAE6OF02HGFTW.46.67.G01.1.454.CMB.1.raw
  modified_base (336)..(336): a, c, t, g, unknown or other
  misc_feature (336)..(336): n is a, c, g, or t
  modified_base (340)..(340): a, c, t, g, unknown or other
  misc_feature (340)..(340): n is a, c, g, or t
  modified_base (365)..(365): a, c, t, g, unknown or other
  misc_feature (365)..(365): n is a, c, g, or t
  modified_base (387)..(387): a, c, t, g, unknown or other
  misc_feature (387)..(387): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccgcagctcccgagggagggctggaatacagttggaagtgtctctcagtagtggaggttcctattacagtccgtctctcaagagtcgagtcaccatatctctggacacgtccagcaatctacgttttcccngaantgtagttctgtcgaccgcgctgacncgggtctttatactgtgcgagngacgtctattatgttattttggagttggtttatttcgtactacccgtagtacgtcgggacggggtctccggacccgtggggaccgagggtaacttacgtcggtccgtaccgttcctaccgttacgcccttaccgacccgtaacgggtcccctacgttcccggtaccctttccccgtcggtccctacccccgttccgtaccctaacgccgtacccg

SEQ ID NO: 142161 - DNA, 755 bp, Homo sapiens
  misc_feature: GYAE6OF02IW52I.46.67.G01.1.454.CMB.1.raw
  modified_base (214)..(214): a, c, t, g, unknown or other
  misc_feature (214)..(214): n is a, c, g, or t
  modified_base (255)..(255): a, c, t, g, unknown or other
  misc_feature (255)..(255): n is a, c, g, or t
  modified_base (548)..(548): a, c, t, g, unknown or other
  misc_feature (548)..(548): n is a, c, g, or t
tcagactagcagtacacgaccggtgctcgatttagagtatacatattgggtttggggacctcctgtgcaagaacatgaagcacctgtggtttgtcctcctgctggtggcagctcccagatgggtcctgtccctggtgcaactgcaggagtcgggcccacgactggtgaggccttcggacgccctgtccctcacctggcgctgtcctcgtggtcnccctccatctagtcgtggtttctcgtggggctcgggtccgnacgcctcccgaggggagggctaggaactacgagttaggacgtcgtctctcgagtaggtcggtaggttccttagttaccgtacgttccgtcctacgtaccgtaaggtcgtccgtacgttccaccgtattactcgttccgtacggtacgtaccgttaccaacgtaccgtaacgttcccgtaacgttttccccaggtaaactgtacgtacgtttccttggtaccgacccggtccgtacgtacggtacgtaccgggttacgttttagtacgtgttcggacgtacgacggtaaccgtnttaaacgttcgttacggtttacgtttttaggggacggttttaggtttaccgtttacgtaacccgttaccgtagttacgggtaccgggtacggggttaccgtaccccggtaccgggttaccggggtacctaaccggggttaacgttaccggtttcgggtacccgttaccccgttcccggtacccgtttaccggccctttaaccccggg

SEQ ID NO: 142162 - DNA, 586 bp, Homo sapiens
  misc_feature: GYAE6OF02JCJ0E.46.67.G01.1.454.CMB.1.raw
  modified_base (192)..(192): a, c, t, g, unknown or other
  misc_feature (192)..(192): n is a, c, g, or t
  modified_base (413)..(413): a, c, t, g, unknown or other
  misc_feature (413)..(413): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggcaagtcggaacattgacacctatttaaatggtatcaacatagaccagggaccgcccctaagcctcctaatctatgctgcatccagttgcaagtgggtcccatcgaggttcagtgcagtggatcgtgggactagtatttcactctcaccatcagtactctagactaacgtgaagtagtttcgactaacttacttactntacaacagttaattaactagttcgtttaccgggaccgtaacgggaaccgtaacgtaacttaaacgtaaaacttaaacggtaaccgtaggtacggtactacggactaaccgtacttacgttccgttcctttacctacgtttacccttcccgaccctaccgtttcctcgttaacc

SEQ ID NO: 142163 - DNA, 611 bp, Homo sapiens
  misc_feature: GYAE6OF02FR38N.46.67.G01.1.454.CMB.1.raw
  modified_base (226)..(226): a, c, t, g, unknown or other
  misc_feature (226)..(226): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtgggagacagtgtcaccatcacttgccggcaagtcggaacntgacacctattaatgtatcaacatagaccagggaccggcccctaagctacctatctatgctgcatcctagtttgactaaggtcgggtacccagtccggtaggttccaggttcggctaggtcgtaactcgtaggggactaggtctttacgacttcctacctacctatacgtaagttaactcgtacgaccgtaaacggtggtaaagttattttcggaacttaaccgttattacttcgtactaactagtaatttactaagttcgtttaccggacgtaacgggtacacgtaactaaactaaagttaaccgtaatggtacgtactacgaccctacacgtttacctcgttacttaccgacttcccgtaccccgtactactccgttgtaacc

SEQ ID NO: 142164 - DNA, 550 bp, Homo sapiens
  misc_feature: GYAE6OF02JNEQ5.46.67.G01.1.454.CMB.1.raw
  modified_base (96)..(96): a, c, t, g, unknown or other
  misc_feature (96)..(96): n is a, c, g, or t
  modified_base (190)..(190): a, c, t, g, unknown or other
  misc_feature (190)..(190): n is a, c, g, or t
  modified_base (193)..(193): a, c, t, g, unknown or other
  misc_feature (193)..(193): n is a, c, g, or t
  modified_base (224)..(224): a, c, t, g, unknown or other
  misc_feature (224)..(224): n is a, c, g, or t
  modified_base (387)..(387): a, c, t, g, unknown or other
  misc_feature (387)..(387): n is a, c, g, or t
  modified_base (409)..(409): a, c, t, g, unknown or other
  misc_feature (409)..(409): n is a, c, g, or t
tcagactagcagtacacgaccggtgctcgatttagagtatacatattgggtttggggagtctcggtcaggacacagcatggacatgaggtccccgntcagctcctggggctcctgctactctggctccgagtgccagatgtgacatcgagctgacccagtctccatcctccctgtctgcaaccgtggganacngtgtcaccatcacttgccggcaagtcgaacnttgactactattaatgtatcaacatagacagggacgccctaagcctactaatctatgactcgcatcctagtttagactaagtcgggccctagtccgtagttcagtgcgagtgtatcgtaggacagtatttcacgtctcacctagtacagtatctgaacacgtntaatattttagacttagtactntacaactagtaattacgtatgtttacgacgtaaggtactacgtaactaataaacttaacgtaatagtcgtactacgtactaacgtataccgttagtacctacgtacctccgttaccgacctacgttacgtacgtattaccg

SEQ ID NO: 142165 - DNA, 600 bp, Homo sapiens
  misc_feature: GYAE6OF02HT480.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcacatcacttgcctggcaagtcggaacattgacactatttaaattgtatcaacatagaccagggacgcccctaagctctaatctatgctgcatcctagtttcgactaaaggtcggggtacccagtcggtaggttcaggttggctaggtggatcgtagggacagtatttcacttctacaccatcagtaatcgtgactaacgtgaagtatttgactaactttattacgtatacaaactagtaaactttaactaatttcggttttaccggaccgtaaacgggacctaacggtaaccttaaacaaaactttaaaacggacgttagtacggtcttacggaacctacctaattacccttggtttaccttaccgtaacgttcccttacccggtacctacttcgtaacg

SEQ ID NO: 142166 - DNA, 769 bp, Homo sapiens
  misc_feature: GYAE6OF02IIHET.46.67.G01.1.454.CMB.1.raw
  modified_base (325)..(325): a, c, t, g, unknown or other
  misc_feature (325)..(325): n is a, c, g, or t
  modified_base (335)..(335): a, c, t, g, unknown or other
  misc_feature (335)..(335): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtggacggccttcggacgaccctgtccctcacctgccgctgtctcgtggtcgccctccatcaggttagttcggttttccttcgtgggggtccgttggggtcccggcgacgccgtccggaaggggaaggggcgtaggaatacagttacggaagtcgtcctntacgattagngggtaggttccttagttaccacggttccgtcgtctcgaagtacgtcgagtcacctatactctcgtcggactaccgtcacgactaacttcttacgttttccctaggtaaacgtacgtagtacggtttacgtcggtaccgacggtcccgtacgtaccggtaccggttacgggttacgttttacgtttaacgttggttcggtaacggaggtaaccggtacggtacgttaactttagttaggtttaagtttttagggtcggtttaggttttacgtttaccggtaacccgttaacccgtaaggtaccggtacggggtcccggggttaccctacccggggtccccgggttaccggggtaacccggtaagggtaacccgttacggtacccggttaccgtacccggttaccctaccggtttcccgtacccccgtaaccccgg

SEQ ID NO: 142167 - DNA, 582 bp, Homo sapiens
  misc_feature: GYAE6OF02H4ITL.46.67.G01.1.454.CMB.1.raw
  modified_base (295)..(295): a, c, t, g, unknown or other
  misc_feature (295)..(295): n is a, c, g, or t
  modified_base (547)..(547): a, c, t, g, unknown or other
  misc_feature (547)..(547): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgcaaccgtgggacgacagtgtcaccatcacttcggccgggcaagtcggaacattgaccaccttatttaaattggtatcaacatagaccagggacgcccctaagctcctaatctancgctgactactcctagtttgacgtaaggtcgggtcccagtcgtaggttcaggtcgacgaggtgatcgtagggactagtattcactcacactatactagtactctgactaagtagaagttattgaacttaagttacttactagtacaactagttaattactaagtttcgttaccggacgtaacggactaacgtaactaaactaaactaaacgtaacgtgtacgtctacgaccacgtacttcgtacgttacctntaccttcccgtacccgtacctattccgtattaccg

SEQ ID NO: 142168 - DNA, 919 bp, Homo sapiens
  misc_feature: GYAE6OF02GO6RG.46.67.G01.1.454.CMB.1.raw
tcagactagcagtacacgaccggtgctcgatttagagtatacatattgggtttgtcctcctgctggtggcagctccagatgggtcctgtccctggtgcaactgcagggagtcgggcccagactggtgagggtccttcgggagaccctgtccctcacctgcgctgtctcgtggtcgcctccatcgagtagttggtttcttcgtggggtctgggccggctagcctcccggaaggggacgggtctagggaatacgagttagggaagttcgtctcgtctaagttacggttgggaacggtttaccgtaattaaccgtaggttccccggttccttacgttaccgaaaggtacgttacggtaacggtcccaaaccctagttaactccgttacgtacgggtaacccgtaccggttacccgaacgaccgtaaacgttacccgtttaaccggtttttacccccgtaaggtaaaacgtacgttacggtaaagtttccggtttacggtacggtaccccggtcccggtacgttacgggtaaccggtacgggggtttacttttttaacgtttacggttacgttacggaacgggtacggtaaaccgggtacggtacgttttaaacgtttaacggtttacgtttaagtttttacgggtaagggttttaccgggttttaatttaccgggtaaccttacccgttaaggtacgttacggggttaccgggggacctttacccgggacccggtacggggtacccggtaaacggggtaacgttccggtacgggttaccccgtaccggtttaccgtaccgtttaccggtcccctaacccggaacccgggttaaccgggtacccctacggtttcccggttaccccctttcccggtaccgggtcccttaaccccgtcccgtaacccgtacggccgttaaccccg

SEQ ID NO: 142169 - DNA, 761 bp, Homo sapiens
  misc_feature: GYAE6OF02HKD41.46.67.G01.1.454.CMB.1.raw
  modified_base (253)..(253): a, c, t, g, unknown or other
  misc_feature (253)..(253): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtgggagacagtgtcaccatcacttgccgggcaagtcggaacattgacacctatttaaatggtatcaanatagaccaggaccggccctaagctacctaatctatgctgcaatccgtagtttgacgtaaaacggtcggggtacccctagttccggtaaggttacgtacggtacggtaccggaggttacggggtagttaccgtacggggtaagaacggtacgtttaccgtaaccgttacccttactaccccaactttccgaaacgtttaaaccgtccgtttacggtacctaaacggttacggttaagttaacgtttttcgtaactaaccgttttaaactttaacgttcgttaccgtaaacctaaacgttaaacgtttaacttaacgttttacggttttaaccgggtacggtaaacgggtaacccgtaaacgtaaccttaaaccgtaaaactttaaaaccggtaaacgttacggttacggtaccgtacggtacctaaccgtaccttaaccggtttcctaagttttaccctacgtttaccccgttaccccgttacccgttaaccgtttccgtagttaaccg

SEQ ID NO: 142170 - DNA, 605 bp, Homo sapiens
  misc_feature: GYAE6OF02GIIIZ.46.67.G01.1.454.CMB.1.raw
  modified_base (213)..(213): a, c, t, g, unknown or other
  misc_feature (213)..(213): n is a, c, g, or t
  modified_base (291)..(291): a, c, t, g, unknown or other
  misc_feature (291)..(291): n is a, c, g, or t
  modified_base (320)..(320): a, c, t, g, unknown or other
  misc_feature (320)..(320): n is a, c, g, or t
  modified_base (389)..(389): a, c, t, g, unknown or other
  misc_feature (389)..(389): n is a, c, g, or t
  modified_base (446)..(446): a, c, t, g, unknown or other
  misc_feature (446)..(446): n is a, c, g, or t
  modified_base (586)..(586): a, c, t, g, unknown or other
  misc_feature (586)..(586): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggacgaccctgtccctcacctgcgctgtctcgtggtncctccatcagtagtgtttctcgtgggctcgggtccgcagcctccgagggagggctggaactacgagttggaatgtctntcatggtggagttcctatacacgtccgtntctacaagagtcgagtccactatatcctgtacggactacgtcacgactaatctacgtttccgagaagtntagtagttctgtcgaccgccgtcgtacgacgtacgggttactttatacgttgtacgnggtacgagggtaccgtacttagttagttaggttagttttgggtacgtttggtttacgttacgacctaccgtagtacgtccgggtacggggtctacccgggtccggtagggccgaaggtaactcggtcgtccgacccgttntcccgttagtccctacccg

SEQ ID NO: 142171 - DNA, 553 bp, Homo sapiens
  misc_feature: GYAE6OF02HHF0A.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttggccggcaaggtcggaacattgacacctatttaaattggtatcaacatagaccagggacgcccctaagctcctaatctatgctgcatcctagtttgctaaaggtcgggtcccagtcgaggttcgaggtggcaggtggatcgtagggacaggtattcgactctacacatacagtatctgcgaagtgtaagtatttagtaacttatactgtacactaagtaatataacttgttacgacgtaaggtacaacgtaataactaaattaaacgactaggtcgacgtcgactaaccgtatcgttacgtcttactacgttccttacccgaccgttactcgttacgattacg

SEQ ID NO: 142172 - DNA, 606 bp, Homo sapiens
  misc_feature: GYAE6OF02HOHSF.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactgggtgaggccttcggagaccctgtccctcacctgcgctgtctctggtgcctccatcagtagtgtttcttctggggctgggtccggcagctccagggaaggggctggaatacattggagtgtctctcatagtggaggttccttattacagtccgtctctcaagagtcgagtcacatatctctggacacgtccagacaattctacgttttccctagaaagtatgtagtttctgtacgacccgccgactgaacgtacgggtcttttaattacgtgtcgacgagacggacgtcttattatgttagttttggagttgtttatttacgacctacctagtacgtcgggacgggggtccttaccggaccccggtacgggggccgtaacgggaacgttccgtacggggttcccacccggtttccgttacccgttacgccccgttaaccccg

SEQ ID NO: 142173 - DNA, 634 bp, Homo sapiens
  misc_feature: GYAE6OF02IH4KS.46.67.G01.1.454.CMB.1.raw
  modified_base (344)..(344): a, c, t, g, unknown or other
  misc_feature (344)..(344): n is a, c, g, or t
  modified_base (603)..(603): a, c, t, g, unknown or other
  misc_feature (603)..(603): n is a, c, g, or t
tcagactagcagtacacgaccggtgctcgatttagagtatacatattgggtttgtcctcctgctggtggcagctcccagatgggtcctgtccctggtgcaactgcaggagtcggcccacgactggtgaggccttcggagaccctgtccctcacctgcgctgtctctggtgcctccatcagtagtggtttcttcgtgggctgggtccgcagcctccgagggagggctggaatacagttggaagtgtctctcatagtggaggttcctattacagttccgtctctcaagtagtcgagtcacccatactctctggacaccgtcagctaatctacgttttccctggaanagtgtacgttcgtgtacgaccgccgctaggaccgtacgggttacgttttacttacgttgtgacgtaggacgacggtacttattagtgttagttttaggaggtttggtttacgtttcgaacctcctagacgttcgggaccggggtctccggtacccggtggggaccgtagggtaacttacgtcggtccgtaccgtccgttaccgtacgtccctaccgaaccggaaccggtacccctacgttcccgttcccgttaccccgnggtaccctaccctaccctaccgacgctcccg

SEQ ID NO: 142174 - DNA, 654 bp, Homo sapiens
  misc_feature: GYAE6OF02GWPB3.46.67.G01.1.454.CMB.1.raw
  modified_base (173)..(173): a, c, t, g, unknown or other
  misc_feature (173)..(173): n is a, c, g, or t
  modified_base (357)..(357): a, c, t, g, unknown or other
  misc_feature (357)..(357): n is a, c, g, or t
  modified_base (435)..(435): a, c, t, g, unknown or other
  misc_feature (435)..(435): n is a, c, g, or t
  modified_base (452)..(452): a, c, t, g, unknown or other
  misc_feature (452)..(452): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggacgaccctgtccctcacctgcgctgtctcgtggtncctcatcagtagtggtttcttcgtggggctgggtccggcagcctccgagggaaggggctaggaatacagttgggaagttcggtctctacagttaggtggtaggttcctattaccaggtccgtctctcaagagtcgatccaccatactctcgtggaccacgtccagcaactctacgttttcccgngaagatgtagttctagtcgaccgcgctcgacgacgggtcttttactacgtggtcgcgagacggtacggtcttaagttntagttagtttttagggnggttttaggtttatttaccggactacccgttagtacgtacccgggacggggtcctcccgggtacccgttcggggaccgtaggggtactacggttcggtccgtaccgtccgttacctcgtccctacgtaccggaaccgggtccctacgtcccggttccgttcccccgtacggcccctaccctccgtaaccgagtacgtacccg

SEQ ID NO: 142175 - DNA, 564 bp, Homo sapiens
  misc_feature: GYAE6OF02GJIKV.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccagtcgaggttcagtggcagtgatcgtgggactagtatttcactctacaccatcagtatctgcaacgtgaagtattttcgactaactttattactgtaccaactaagaacttactaaattcgttttacgaccgtaaggactacgtaactaactaaaattaaaccgaacgtgtacggacttaggacctaaccgtattaccgtgttccttactacttccgtttaccccgacctacgttcctagtaacg

SEQ ID NO: 142176 - DNA, 563 bp, Homo sapiens
  misc_feature: GYAE6OF02IEJUG.46.67.G01.1.454.CMB.1.raw
  modified_base (193)..(193): a, c, t, g, unknown or other
  misc_feature (193)..(193): n is a, c, g, or t
  modified_base (218)..(218): a, c, t, g, unknown or other
  misc_feature (218)..(218): n is a, c, g, or t
  modified_base (313)..(313): a, c, t, g, unknown or other
  misc_feature (313)..(313): n is a, c, g, or t
  modified_base (372)..(372): a, c, t, g, unknown or other
  misc_feature (372)..(372): n is a, c, g, or t
  modified_base (526)..(526): a, c, t, g, unknown or other
  misc_feature (526)..(526): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccgtggganacagtgtcaccatcacttggccggnaagtcggaacattgacacttattaaatggtatcaacatagaccgtagggaccgtacccctaagcctactaatctatgactgcaactcctagtttnacgtaaaggttcgggccagtcgtaggttcagtggactaggttagatcgagggacaagtnttcacttcacactatctaagtatcgtagacgtaatgaattatttacgtactaacgtttatactatacaaatagtaattactagttcgttacggaactaacggactaacgtaactaaataaacgtaaacgactgacgtacacgacaactacgttntccgtatacgttactccgtcctacgtctacgtatacg

SEQ ID NO: 142177 - DNA, 536 bp, Homo sapiens
  misc_feature: GYAE6OF02JI2KV.46.67.G01.1.454.CMB.1.raw
  modified_base (494)..(494): a, c, t, g, unknown or other
  misc_feature (494)..(494): n is a, c, g, or t
  modified_base (515)..(515): a, c, t, g, unknown or other
  misc_feature (515)..(515): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggagacagtgtcaccatcacttgccgggcaagtcggaacattgacacctattaaattggtatcaacatagaccagggacggcccctaagctacctaatctatgctgcatccagtttgacaaggtcgggtacccagtcgtaggttcagtggacagtgatcgtggactagtatttcactctacacatcgagtaatctgacaacgtgaagtatttagactaacttattactgtacaacgtagtaacttacaagttacgtttaccggacctaaggactacgtaactaacgtaaacttaacgaactgtacgntcgacactatctgtacttacncttcctccactactctagtac

SEQ ID NO: 142178 - DNA, 534 bp, Homo sapiens
  misc_feature: GYAE6OF02I2Z9A.46.67.G01.1.454.CMB.1.raw
  modified_base (378)..(378): a, c, t, g, unknown or other
  misc_feature (378)..(378): n is a, c, g, or t
  modified_base (394)..(394): a, c, t, g, unknown or other
  misc_feature (394)..(394): n is a, c, g, or t
  modified_base (398)..(398): a, c, t, g, unknown or other
  misc_feature (398)..(398): n is a, c, g, or t
  modified_base (415)..(415): a, c, t, g, unknown or other
  misc_feature (415)..(415): n is a, c, g, or t
  modified_base (512)..(512): a, c, t, g, unknown or other
  misc_feature (512)..(512): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattcgacaccttaatttaaattggtaatcaacatagaccaggacgccctaagctctaatctatgctgcatcctagtttgacgtaaagtcggggtcccagttcgaggttcaggtcggctagtggatcgttgggacagtattcgactctcacntacatatctgctagtnagtntttgacttaacttattntagtacaactagtaacttataagtttgttacggacgtaaggacctacgactaaacaaagttaacaacgtgtaggctagacactatcgtagttcttancttcctcccgtatcttctgtac

SEQ ID NO: 142179 - DNA, 678 bp, Homo sapiens
  misc_feature: GYAE6OF02IBP8Z.46.67.G01.1.454.CMB.1.raw
tcagactagcagtacacgaccggtgctcgatttagagtatacatattggggtttgggggagtctcggtcaggacacagcatggacatgagggtccccgctcagctcctggggctcctgctactctggctccgaggtgccagatgtgacatcgagctgacccagtctccatcctccctgtctgccaaccggtgggagacagtgtccaccatcacttggccgggcaagtcggaacattcgactaccttaatttaattggtatcaacatagaccgaagggaccggaccccctaagctacctaatctatgctgcactccgtagtttgacgtaaaggtcggggtacccagttcggtaggttcaggtggacgaggtggactcgtagggactagtatttcacttctacacctattacgtaagtaactcgtacgactaacggtagtaaagttacttttagaaccttaaactttatttaccgtacttaacctaaacgtaagttaaactttaacgtaacgttttcggggtttaaccgaacccgtaagggaaccctaacgtaaccttaaaacgtaaaactttaaaccggaacgtttggacggtacttacgacccgtaacctagtttacctcgtttccgttaaccgttacctttacccgttaccccgtacctacgttacgtagttaaccg

SEQ ID NO: 142180 - DNA, 606 bp, Homo sapiens
  misc_feature: GYAE6OF02H4HE5.46.67.G01.1.454.CMB.1.raw
  modified_base (369)..(369): a, c, t, g, unknown or other
  misc_feature (369)..(369): n is a, c, g, or t
  modified_base (431)..(431): a, c, t, g, unknown or other
  misc_feature (431)..(431): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctccatcctcctgtctgcaacgtggagacagtgtcacatcacttggccgggcaaggtcggaacattgactactaatttaaatggtatcaacatacgaccgaggacggccctaaagcctactaatctatgctgctatccgtagtttagactaaaggtcgggtccaagtcggagttcaggtgcagtggatcgtgggacagtattcaactntcacagtctacgtatctgaacctagtagtaacgtagttttacgacttaaactttacttaacngttaactaaactagtaaactttaacaaagtttcggttttaccgaacggtaaacgggtaacctaacgtaaccttaaagtaaaaccttaaaacggtaaccttggtaacgcgttacgactaacgactttacgtcgttaccttactacgttccctacccgtaccttagtctaagtaacg

SEQ ID NO: 142181 - DNA, 550 bp, Homo sapiens
  misc_feature: GYAE6OF02HYYVV.46.67.G01.1.454.CMB.1.raw
  modified_base (308)..(308): a, c, t, g, unknown or other
  misc_feature (308)..(308): n is a, c, g, or t
  modified_base (336)..(336): a, c, t, g, unknown or other
  misc_feature (336)..(336): n is a, c, g, or t
  modified_base (339)..(339): a, c, t, g, unknown or other
  misc_feature (339)..(339): n is a, c, g, or t
  modified_base (347)..(347): a, c, t, g, unknown or other
  misc_feature (347)..(347): n is a, c, g, or t
  modified_base (357)..(357): a, c, t, g, unknown or other
  misc_feature (357)..(357): n is a, c, g, or t
  modified_base (486)..(486): a, c, t, g, unknown or other
  misc_feature (486)..(486): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccggcagctcccgagggaaggggctggaatacattggaagtgtctctcattagtggaggttcctaattacagtccgtctctcaagagtcgagtcaccatatctntggacacgtccagcaatcagttttcccnganatgagttntgtgaccgcnctgacacgggtctttagttactgtgcgagagacgctattatgtattttggagttggttatttcgacacctagatcgacggggtctcgacccgtagggccgagggaactcgtggtcaccgtctccgtacncctccaccgaagggccctaagtccgtccttcccccgtgcctacccctaccctcctagacgtacc

SEQ ID NO: 142182 - DNA, 626 bp, Homo sapiens
  misc_feature: GYAE6OF02GQGPI.46.67.G01.1.454.CMB.1.raw
  modified_base (192)..(192): a, c, t, g, unknown or other
  misc_feature (192)..(192): n is a, c, g, or t
  modified_base (216)..(216): a, c, t, g, unknown or other
  misc_feature (216)..(216): n is a, c, g, or t
  modified_base (285)..(285): a, c, t, g, unknown or other
  misc_feature (285)..(285): n is a, c, g, or t
  modified_base (340)..(340): a, c, t, g, unknown or other
  misc_feature (340)..(340): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcacatcacttggccggnaagtcggaacattgacactatttaaatggtatcaacatagacagggacgcccctaagctcctaatctangctgcatcctagtttgactaaggtgggtcccagtcgagttcagtggcagtgatgnggacagtattcactctcacctatactagtaactcgtacgctaacgtgaaagttattttagacttaacgtttattaccgtagttacaaacgtaagtaactttaactaagtttcggtttaccggaaccgtaacgggtaacctaacgtaaccttaaactaaaacgttaaacgtacgttacggtggtaccttacggtacctaaacccgtagttaccgtttaacggttaccctttacgtaacccgttttacccgtttaccccgaccggtttaaccttccgttagttaaccc

SEQ ID NO: 142183 - DNA, 811 bp, Homo sapiens
  misc_feature: GYAE6OF02IBQLM.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctccagatgggtcctgtcctggtgcaactgcaggacggtccgggcccacggtactgggtgacggtccttacggacgaccctcgtccctcacctgccgctcgtctcgtggctcctacagtcgagtggttcggtttctcggtgggggccgttcgggggtcccgacgacggtcccgttaccgggaagggggaacgggggtctacgggaaagttacgtaaggttagggtaagttcggttccgtctaacgtaggttaggtcgggttaacgtttaccttaagttaaccgacggttcccgtcttacctaacgaaacggtggttaccgtaacgtaccgaacctaattcttaccgtacgtacggtaacctaccggtaccaagtacctaacgtaccgttaccgttttaccgaagtaagcgtttaacggtcgttcgtggtaccggacccgcgttacgtacggtaccggtaccgggtttacgttttaactacgttgtaaccgggtacgaggtaccggtaacggtctttaaactttaagttggtttaacggttttaggtacggttagttttaaccgtccgtaaccgtaaccgtaagggtaccgtaccggggtacgggtccgtaccggtaaccccgggtcgggaacggtaacggttaaccgttacgttacgggtacccttaccgttacctcccggttaacaccccgtacccgg

SEQ ID NO: 142184 - DNA, 796 bp, Homo sapiens
  misc_feature: GYAE6OF02G7DDW.46.67.G01.1.454.CMB.1.raw
  modified_base (224)..(224): a, c, t, g, unknown or other
  misc_feature (224)..(224): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctccatcctcctgtctgcaaccgtggagacagtgtcaccatcacttggccggcaagtcgaacntgacacttattaaatggtatcaacatacgaccgagggaccgacccctaagcctacctaaatctaatcgtactgactacttaccgtagtttacgaccgtaaagggttccggggtacccctaagttccgggttaagggtttaccgagggttaggggtaccgtaagggttacgggtacgttaccggttacgggggtaaacttaacggttaacgttttaccaaccgtttacccgttacctaaaccccgtaagttaaccgtaaacgtttaacttccgttaacgggtaaccgtaaaacgggttagtaaaggtttacttttacggaacctttaaaaccgttttactttaaccgttacggtaaacctaaacgtaaagttaaacgtttaacgtaaagttttacgggtttaacccggaaaccggtaaagggtaaccctaaacggttaaaccttaaaaccgttaaaacgttaaaaccgtaacgttaggtaacggttaccgtacgtaaccctacgtaactttccgttacgttaaccttaccgtactttccccgttacccgtaccgtaacttcgttacgtaaccg

SEQ ID NO: 142185 - DNA, 693 bp, Homo sapiens
  misc_feature: GYAE6OF02GJQ7C.46.67.G01.1.454.CMB.1.raw
  modified_base (282)..(282): a, c, t, g, unknown or other
  misc_feature (282)..(282): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcgcctgcgctgtctctggtgcctccatcagtagtggtttcttcgtggggctgggtccggcagctcccgaggggagggctggaatacagttggaagtgtctctcatagtggaggttcctattacagtccgtntctcaagtagtcgagtcacatatctctcggactacgtcagcatctacgttttccagaagtatagtagttctgtcgaccgccgtctcggacgtacggggtacttttacgttacgttggtcgacgggtacgacggtacgggtacttaacgtttagttaggtttaagttttttacgggtaggttttacgggttttacttttacccgggttaaacctaaccccttaaggtaccggttaccggggaccgggggtccgtacccggtaccccgggtacgggacccggtaaggggtaacttacggtcgttccgtaccgttccgtccgttacgcccgtaccaccggaaccggtccctacggttccggttacccgttcccgtccggaccctaccccgttccgacccgtacgccgtaccccg

SEQ ID NO: 142186 - DNA, 663 bp, Homo sapiens
  misc_feature: GYAE6OF02IZZDU.46.67.G01.1.454.CMB.1.raw
  modified_base (178)..(178): a, c, t, g, unknown or other
  misc_feature (178)..(178): n is a, c, g, or t
  modified_base (295)..(295): a, c, t, g, unknown or other
  misc_feature (295)..(295): n is a, c, g, or t
  modified_base (521)..(521): a, c, t, g, unknown or other
  misc_feature (521)..(521): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcggccacgactggtgaggccttcgganaccctgtccctcacctgcgctgtctcgtggtcgcctcatctagtgttgtttctcgtgggtcgtgggtccgcacgcgtccgagggaaggctaggaatacgagttggagtgtctcgtanagtaggtggtacgttcctagtacgtcgtccgttctcgtactaaggtacgtcgacgtaccacctataactcctcgtacggacctaccggtacgacgtacctaagttccgtttacggttttccctaaggtaacggtattacggtagtttcgtcggtaccgccggtaccgtcgtacgacgttacgggttacgttttactgttacggtcgtacgtaagcggtacccgttnttagttacttgttagttttggagtttagttacttcgtacctacgtagtacgtcggtaccggtactcccgtccgggtaggccggtaaggtactaccggttacggacccgtccgttacgtacccgttacgaccccgttaaccgg

SEQ ID NO: 142187 - DNA, 625 bp, Homo sapiens
  misc_feature: GYAE6OF02HZA4D.46.67.G01.1.454.CMB.1.raw
tcagactagcagtacacgaccggtgctcgatttagagtatacatattgggtttgggggagtctcggtcaggacacagcatggacatgagggtccccgctcagctcctgggggctcctgctactctggctccgaggtgccagatgtgacatcgagctgacccagtctccactcctccctgtctgccaaccggtgggagacagtgtcaccatcacttcggccgggcaaggtcggaactattgactaccttaatttaaattggtatacaacatagaccgagggaccggcccctaagctacctaatctatgctagcatcctagtttgacgtaaaggtcgggtacccagtcggaggttcagtggacaggtggatcgtagggacagtattccactctacacctatacagtatcgtagactaacgtagaagttattttagacttaactttacttacttgtaacaactaagttaattactaagttacgttttaccggaccgtaaggggacctaaaccgtaacttaaacgtaaaaacgttaaacgaaacgttggtacggtagtacgaacctaactattaccgacgtttaccttaccgtacttacccgttaccccgtacctactcgttagtaacc

SEQ ID NO: 142188 - DNA, 677 bp, Homo sapiens
  misc_feature: GYAE6OF02G79KM.46.67.G01.1.454.CMB.1.raw
  modified_base (442)..(442): a, c, t, g, unknown or other
  misc_feature (442)..(442): n is a, c, g, or t
  modified_base (581)..(581): a, c, t, g, unknown or other
  misc_feature (581)..(581): n is a, c, g, or t
  modified_base (636)..(636): a, c, t, g, unknown or other
  misc_feature (636)..(636): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagacccctgtccctcacctgcgctgtctctggtgcctccatcagtagtggtttcttcgtggggctggggtccggcagcctcccgaggggaagggctaggaatacagttggaagtgttctctcagtaggtggtaggttcctaattacacgtccgtctctcaagagtcgagttccaccatatctcgtggacaccgtccagcaatctacgttttcccaggaagtatgtagttctgtcgaccgccgtctcgaacgtacgggttactttagttactgtgacgtaggacgtacggtacttagttacgtnttagttttgggagtttggtttactttaccggaacctaccgttagtacgtaccgggaccggggtcctacccggtaccccggtaggggaccccgtaaggggtaactaccggttcggttccgacccgttccttcccgttacnccccgttacccaaccggtaaccggccccgtagttccccggtcccctttcccccgnggtacccctaccccttccccgaccgaccgtacctaccccgg

SEQ ID NO: 142189 - DNA, 780 bp, Homo sapiens
  misc_feature: GYAE6OF02JIH6J.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccggtggganacgagtcgtacaccatcacgttcggcccgggacaacggtcggaactagttcgacctaaccttaatttaaattcggtaactcaaacagtacgaccgaaggggaccgtacccctaagtcctacctaaatccttaagtcgtctgacctattccgtagtttagaccgtaaacgggtcgggtccctagtcggtacggttcgaggttcggcgtaggtacggtatcggtaggactagtactttcaccgttccgtacacctaacgtacgtaacgttaactcgtagtaccgtaacggtagtaaacgttattttacgaactttaaaccgtttacgtttacgttaacgtaaccctaaaacgttagttaaaaccgttttaaacgttaaccggttttaacgggtttacccgggaaacccgggttaaaagggtaaacccgtttaaacccggtaaaccttaaaacgttaaaaaacccggtttaaaccgaacggtttacgggttacgtacgtttacgacccgtaaacgttaacgtttcgtacgtttaaccgtttacgtaccgtttccccgtaacccgtacctttaacgttcggttaacctaacg

SEQ ID NO: 142190 - DNA, 583 bp, Homo sapiens
  misc_feature: GYAE6OF02FR13P.46.67.G01.1.454.CMB.1.raw
  modified_base (229)..(229): a, c, t, g, unknown or other
  misc_feature (229)..(229): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggacaagtcgaacnttgactacctattaaattggtatcaacatagaccagggacgcccctaagctcctaatctatgctgcaatctagtttgacgaaaggtcggggtccctatcggaggttcgaggttggctaggtcggatcgtagggaacagtacttcactctacacctactcagtaatctgactaacgtgtaagtatttagacttaacttattacttataccaacgtaagtaactactaacgttacgttttacggaccgtaacgggaacctacgtaactaacgtaaaacttaaacgtaactggtacgacgtcgacgtactatacgttacttacgttacacttcccgtaccgtacctactctagtacc

SEQ ID NO: 142191 - DNA, 794 bp, Homo sapiens
  misc_feature: GYAE6OF02G9T1W.46.67.G01.1.454.CMB.1.raw
  modified_base (139)..(139): a, c, t, g, unknown or other
  misc_feature (139)..(139): n is a, c, g, or t
tcagactagcagtacacgaccggtgctcgatttagagtatacatattgggtttggggggacctcctgtgcaagaacatgaagcacctgtggtttgtcctcctgctggtggcagctcccagatgggtcctgtccctggtncaactgcaggagtcgggcccacgactggtgaggccttcggagaccctgtccctcacctgcgctgtctctggtgcctccatcaggttagtggtttcttcgtggggctggggtcccggcagcctcccgaggggaacggggctggaatacagttaggaagtgtctctcagtaggtggtaggttctattacagtccgtctctcaagagtcgagtcacctatactctcgtggacacgtcacacaatctacgttttacccagtaagtatgtacgtttcgtgtcgtacccggcgtacgtacggaccggtaccggggttcgtttttaacggtttacgttcgggtacggtaccgggtaacggtacggggtaaccgggttacttttaacgttttaagtttacgggttttacggtttttttaggggtacgggtttttacgggtttttaacttttacccgggtaaacccttaaccccggtttaaggtacccggggttacgggggtacccgggggggttaccccttacccgggggtaacccccgggttagggggggtaaccccggtaacgggggtaacctttaaccgggtttaccggggttccccgtttaaccccggggtttacccgtttaccccggttttacccgggcccccctttaaacccccggg

SEQ ID NO: 142192 - DNA, 688 bp, Homo sapiens
  misc_feature: GYAE6OF02H9AH7.46.67.G01.1.454.CMB.1.raw
  modified_base (98)..(98): a, c, t, g, unknown or other
  misc_feature (98)..(98): n is a, c, g, or t
  modified_base (161)..(161): a, c, t, g, unknown or other
  misc_feature (161)..(161): n is a, c, g, or t
  modified_base (193)..(193): a, c, t, g, unknown or other
  misc_feature (193)..(193): n is a, c, g, or t
  modified_base (259)..(259): a, c, t, g, unknown or other
  misc_feature (259)..(259): n is a, c, g, or t
tcagactagcagtacacgaccggtgctcgatttagagtatacatattgggtttggggagtctcggtacaggacacagcatggacatgagggtccccgntcagctcctggggctcctgctactctggctccgaggtgccagatgtgacatcgagctgacccngtctccatcctccctgtctgcaaccgtggganactagtgcaccatcacttggccgggcaagtcggaacattgactacttatttaaattggtatacaanatagacgagggaccgccctaagctacctaatctatgctgcatctagtttgacgtaaacggttggggtacccagttaccggagtttacgaggttggacgtaaggttggaactcgtgggaactaggtactttcaacttacgtacacctatcctaagtaattcgacgtaaccgtagtaggtaattacgttttagaaccttaacgtttaattacgtacggttaaccaaataacgttaaacttaagtaaacgttttgggttttaacccggaaacgtaacggggtaaacctaccggttaaaaccttaaagttaaacgtttaaaaacggacgttacggtacgtaaccgtttaggaccctaacctaagttccggtacttttacccgttacctaacgggtttccctaccccggtaccttacggtttacaggttaaccc

SEQ ID NO: 142193 - DNA, 600 bp, Homo sapiens
  misc_feature: GYAE6OF02H5QK4.46.67.G01.1.454.CMB.1.raw
  modified_base (252)..(252): a, c, t, g, unknown or other
  misc_feature (252)..(252): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtcccctcacctgcgctgtctctggtcgcctccatcagtagtggtttctcgtggggctgggtccggnagctccgaggggaagggctggaatacgagttggaagtgtctctcagtagtggtaggttcctattacacgtccgtctctacaagagtcgagtcaccatatctctaggacacgtccagctaatcttacgtttccctagaagattgtagttctgtcgaccgccgtctagacgtacgggtactttacttacgtgtcggcgagacgacgtactagttacgtgttagtttttaggtaggttgtttactttcgaactaccgttagacgtcggacggggtctaccggtcccgtgggccggtaagggtaacgtcgttcggtaccgtacccgttccgttccttaccgccctaacccgg

SEQ ID NO: 142194 - DNA, 660 bp, Homo sapiens
  misc_feature: GYAE6OF02IUQ9H.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtccaccatcacttgccgggcaagtcggaacattgacaccttattaaattggtatcaacatagaccgagggacgcccctaagcctcctaatctatgctgcatcctaggtttagacgaaacggtcgggtacccctagtccggtaggttcgaaggtggcgtaggtggtactcggtggggactagtactttcacgtcctactaccactacgaagttactccgtgaccgtaagtagtaacgttattttcgacttaacgtttacttacttacgtactaacgtaaagttaactttacctaaagtttcggttttaccggaaccgtaaacgggtacctaaccgtaaccgttaaaactaaaacgttaaaaccggaaacttcggtacggtccgttacgaccgtaaccgttacttaccgttcgttacctttacctacgttccctttaccccgaccttaacttcgtacgtaacc

SEQ ID NO: 142195 - DNA, 652 bp, Homo sapiens
  misc_feature: GYAE6OF02JBGZI.46.67.G01.1.454.CMB.1.raw
  modified_base (159)..(159): a, c, t, g, unknown or other
  misc_feature (159)..(159): n is a, c, g, or t
  modified_base (192)..(192): a, c, t, g, unknown or other
  misc_feature (192)..(192): n is a, c, g, or t
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
  modified_base (219)..(219): a, c, t, g, unknown or other
  misc_feature (219)..(219): n is a, c, g, or t
  modified_base (258)..(258): a, c, t, g, unknown or other
  misc_feature (258)..(258): n is a, c, g, or t
  modified_base (606)..(606): a, c, t, g, unknown or other
  misc_feature (606)..(606): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccngtctccattcctccctgtctgacaaccgtgganacngtgtcaccntcacttcggccgganaacgtcggaacattagactaactatttaatggtatcaanatagaccgtagggaccgacctaagtctactaatcctatcgctacgcctactaccgtagtttacgacgtaaaggtcggggtcccagttccggtaggttaccaggtcggtacgtacggtacggtaacgttcggtagggtaccgtaagtccgttttacacgttccgtaccgaactactacgtaacgttaacttccgtaagtaacctaacggttacgtaaagttagtttactaacgttaacgtttacttaacgttaacgtactaaacgtagtacttaacgtattcgtttacgactacggtaacgtacctaataaactaacgtaaactatggtgtacacacgtaactaccgtntcttaccgttatacccgttctccgtaccgtacttactaccgttacg

SEQ ID NO: 142196 - DNA, 666 bp, Homo sapiens
  misc_feature: GYAE6OF02F6YHS.46.67.G01.1.454.CMB.1.raw
  modified_base (218)..(218): a, c, t, g, unknown or other
  misc_feature (218)..(218): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccggganaagtcggaactattgactaccttaatttaaattggtaatcaaacatagaccgagggaccggtcccctaagctacctaatctatgctgcatcctagtttgacaaaggtcgggtcccagtcgaggttcaggtggcaggtggatcgtggggactagtatttcgactctacaccgtatactaagtacttctagcgtaacgttacgtaaagttaattttacggttaaacttttaattaaccgttagttaaccaagttaagtaaacctttaaacttaacggttttacgggtttttaccgaaccggtaaacggggttacctaaccgtaaaccttaacgtaaaaacgtttaaacgtaaccgttaaggtaggtaactcgtaaccaccgtataccgtttgtccctttattacgttaccccttacccggttacctaactttaccgttagtaacttaccg

SEQ ID NO: 142197 - DNA, 773 bp, Homo sapiens
  misc_feature: GYAE6OF02F5BN8.46.67.G01.1.454.CMB.1.raw
  modified_base (227)..(227): a, c, t, g, unknown or other
  misc_feature (227)..(227): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtgggagacagtgtcaccatcacttggccgggcaagtcgaacnttgacacctatttaatgtatcaacatacgacgagggaccgacccctaagcctacctaatctatgctgctatcctaggtttgacgtaaaggtcgggttacccagttccggtaggtttcaggttcggcgtaaggtggtacgttcggtgggaaccgtagttactttacgtaccttacgtaccaaccctaagttacctaagtttaaacttcgtacggtaaccgtaaacggttaacggtaaaggtttactttttacggaaccttttaaaccgttttaacgtttaactttaacggtaacctaaaacgtaacggttaaaacttttaaacgttaacgttttacgggtttttaacccgggaacccggttaaacggggtaacctaaaccgttaaaccgttaaacgtaaaaaccgtttaaaaaccgtaaccgttaggggttaccggtaccgttaacggtaccctaaaccgttaacgtttaccgttaacgtttacccgttttacgtaacccgttttacccgttaccccggtaccttacgtttaccgtaacgttaaccg

SEQ ID NO: 142198 - DNA, 852 bp, Homo sapiens
  misc_feature: GYAE6OF02JTXY6.46.67.G01.1.454.CMB.1.raw
  modified_base (150)..(150): a, c, t, g, unknown or other
  misc_feature (150)..(150): n is a, c, g, or t
  modified_base (197)..(197): a, c, t, g, unknown or other
  misc_feature (197)..(197): n is a, c, g, or t
  modified_base (271)..(271): a, c, t, g, unknown or other
  misc_feature (271)..(271): n is a, c, g, or t
  modified_base (338)..(338): a, c, t, g, unknown or other
  misc_feature (338)..(338): n is a, c, g, or t
  modified_base (841)..(841): a, c, t, g, unknown or other
  misc_feature (841)..(841): n is a, c, g, or t
tcagactagcagtacacgaccggtgctcgatttagagtatacatattgggtttgggggacctcctgtgcaagaacatgaagcacctgtggtttgtcctcctgctggtggcagcctcccaagatgggtcctgtcctggtgcaactgcaggngtccgggccacgactggtgacggccttaggagacccctgtccccgtnacctgccgtctgtctcgtggcgcctaccatccgagttagttggttttcctcgtgggggccttggggtcccgganaggtcctcccggaggggaggggtctgggaatacgagttagggaagtggtccttctacgtagttacgnggggtacgttccttactacgtaggttcccgttacctcgttacgaacggtacggtacggtcggttaaccacccgtaagtttaactccgttcgtacgggtaacctacccggttaccacggtacctaagttcttaacccgttttcccgagtaaccgtagttgtaacggttcttagtaccgtaccggtcctaccgtcggaacgtaccgggggtttactttaacggtttccggtaggtttaccggaggtaaccgggttacggggtacgtttacccggtttaagttacgtttaaggtttaggtttttaaccgggggtttagttttacgggtttttaccgttaaaccgttaacccgtttaccccgggtaaaacgtttgggtaaccccggggttccgggggtaaccgttcccccgggttaacccggtacccgggggttcgggtaaacgtcccggggtttaattcccggggttaaccctaccccgggtttccctttaaagggtttccccccnccccggtaccg

SEQ ID NO: 142199 - DNA, 853 bp, Homo sapiens
  misc_feature: GYAE6OF02HMKZS.46.67.G01.1.454.CMB.1.raw
tcagactagcagtacacgaccggtgctcgatttagagtatacatattgggtttgggtgacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctcgtggtcgcctccatcagtagttggtttcttcgtgggtctgggtccgcagcctccgaggggaagggctaggaactacgagttaggaagtcgtctctctaagtaggtcgggtaacgtttcctaagtttacgacgttccgttactctacgaaaggtagtaccgagttaccaacctaattactctacgtacggaacctacggtaccaacggtacctaaacttccgtttaaccgttttttacccgaaggtaaacgtacgtttacggttaacgttttccgttagggttaccggtaaccccggtcccggtaacgttacggggaaacccggttaccgggggtttaaccgttttttaaacgttacccgtttacgggtttacgggacgggtaaacggtaacgggtaccggttactttaagtttaacgtttaggttttacggttttttaggggtaagttttacgggtttttaactttccgggtaaaccctaaccccgttaaggttaccggttacccggggtaccgggggttacccgttaaccccggggtacccccggttacgggggggaacccgtaaacggggggtaacctttaacccgggttcgggtaaccccgttaaccccggttcccgtttaccccggttacccggtacccccgg

SEQ ID NO: 142200 - DNA, 892 bp, Homo sapiens
  misc_feature: GYAE6OF02I4UPJ.46.67.G01.1.454.CMB.1.raw
  modified_base (190)..(190): a, c, t, g, unknown or other
  misc_feature (190)..(190): n is a, c, g, or t
tcagactagcagtacacgaccggtgctcgatttagagtatacatattgggtttggggatctcggtcaggacacagcatggacatgagggtccccgctcagctcctggggctcctgctactctggctccgaggtgccagatgtgacatcgagctgacccagtctccatcctccctgtctgcaaccgtgganacagtcgtaccacctagtcacttggccgggtacaaggtcggaactagttacgaccaaccttaattttaaagttggaacttcgaaacagtaacggaccgaagggtacccggacccccgtaacgccttaaccgtaagtcttaacgtgtaccttacgacctacttacccgtaggttttagaccgtaaaaggtccgggggtaccctagttcggtaacggttccgtaaggtacggtcgaggttcggaagttacccggtaggggaaacgtacggttaacctttacgtaacttccgtaccgaacccgttagtttacccgtaaagttaaccgtaccgttacggtaccgtaaaccggttggtaaaacggtttacgttttaaccggtaacctttaaaaccttcgtttaaacccgttacgttaacccgtaaaacgttaacgtttaaacgttttaaacccgtaaggttttaccggggttttaaaccggaacccggttaaacgggggtaacccgttaaacccggtaaacctttaaaaaccgggtaaaaccgtttaaaaccgtaaaaccgggttcggtttaacggacccgtttacgaaaccccgggttaaccttaccggttttaaccctccggttttaaaccctttccggtaaacccgttttccccggttaaccccgtaacccttttaacgggtaccccctttaaacgtaacccgg

SEQ ID NO: 142201 - DNA, 731 bp, Homo sapiens
  misc_feature: GYAE6OF02FGAE2.46.67.G01.1.454.CMB.1.raw
  modified_base (643)..(643): a, c, t, g, unknown or other
  misc_feature (643)..(643): n is a, c, g, or t
tcagactagcagtacacgaccggtgctcgatttagagtatacatattgggtttggggagtctcggtcaggacacagcatggacatgacgggtccccgctcagctccgtggggctcctgcctactctggcctccgaggtcgccagtatgtacgactactcgacgcctacgacccctagttcctcctactcccttcccgtgtccgtacgaccgtaccgggtggaacacgtacgttcgaccactactccgtacgtcggaccgtacgaacggtaccgattcgttacaaccttaccgttaatttaacgtgtacacaatcgaccgacggacggtaccctaccgtaatccctaactactctagtcgcgtacaccgttactacggttgtaccggtacggtaaccggtccggtaaccagggttcgtaacgttcgacggtcgaggtacggtcgacgttacggacggtaactacggttactccgactcaccgacttgaacctatccgtacgaactacgtaattaacgttacgttattaccgtaaaccttataccgttactacgaacgttaacttaacttaacgttacggttcgttaaccgggtccgaaacggtacctaaaccggtaactaacttaaacggtaaattacccgggngtacccgtaagccctaacgacccgttactacgttacccgttaccttaccacccgtttcctacccgtccttagtacctacgttacctcg

SEQ ID NO: 142202 - DNA, 653 bp, Homo sapiens
  misc_feature: GYAE6OF02F27MO.46.67.G01.1.454.CMB.1.raw
  modified_base (229)..(229): a, c, t, g, unknown or other
  misc_feature (229)..(229): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccggtgggagacagtgtcaccatcacttgccgggcaagtcgaacnttgacaccttaatttaacgtggtatcaacatagaccgagggaccgaccctaagctacctatctagtgctgcatcctagtttcgacgtaaacggtcggggtacccagtcggtaggttcaggtgcgtaggtggatcgtagggacagtacttacactctacaccatcaagtatcgtagactaacggtagtaagttacgttttcgaactttaaaccttactttaactacgttacaaacttaagttaaacttaacgttaacgtttcggtttacccggaccggtaaacggtaaccctaaccggtaaccttaaaaccgtaaaacgttaaaacggtaacgttacgggtacgtaccgtacgacccgtaacctagttaccttagttaccttacgtaccttacccgttacccgacctacgttaccgtagtaaccg

SEQ ID NO: 142203 - DNA, 629 bp, Homo sapiens
  misc_feature: GYAE6OF02FK8YV.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctaatttaaattgtatcaacatagaccagggacgcccctaagctcctaatctatcgctgcatccagtttgcaaaggtgggtcccatcgaggttcaggtcggcaggtggatcgtagggacagtattcactctcacctatcagtatctgacaacgtagtagtattttcgacttaacgtttattaacgttcgtaacgtaaataacgtaaactttacgtaaacgtttcggttttaccgggaaccctaaggggtaacctaccggtaacttaaactaaaaacgtttaaaaccgtaacgttagtacggtactacggtacctaacctacttaccgttacgttaccgttttacaccgtttaccccgtttaccccgtacctaacgtttaccgtacgttaaaccg

SEQ ID NO: 142204 - DNA, 709 bp, Homo sapiens
  misc_feature: GYAE6OF02IA22B.46.67.G01.1.454.CMB.1.raw
  modified_base (396)..(396): a, c, t, g, unknown or other
  misc_feature (396)..(396): n is a, c, g, or t
  modified_base (439)..(439): a, c, t, g, unknown or other
  misc_feature (439)..(439): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtccgggcccacgactggtgaggccttcggacgaccctgtccctcacctgcgctgtctcgtggtcgcctccatctagttaggttcggttttctcgtggggcgttggggtacccggcacgccgtacccgaggggtaacggggctaggaatacgagtttaggaagttcgtctcgtacgagttaggtcggtacggttttcctaagttaacgtacgttccgtctcgtacgaagacgtcgtagtcactagtntctcgtaggactacgtcagtacaacttctcgtttccgagtaanagttaggtactttacgcggttacggacccgtccgtctacggacggtccggggttaacgtttttacgttacgtggtacgacgaggtaccgggtaacgtctttagttagttcggttttaagggttttgtaacgggtttgttttaacgtttacccgaacccttacggtacgtacgtccggggtaccgggtccttacccggccgggttacgggacgtaacggtacttaccggtcgtaccgtaccgttcccgtacgttacccgtcctaaccccgg

SEQ ID NO: 142205 - DNA, 684 bp, Homo sapiens
  misc_feature: GYAE6OF02J0JI5.46.67.G01.1.454.CMB.1.raw
  modified_base (188)..(188): a, c, t, g, unknown or other
  misc_feature (188)..(188): n is a, c, g, or t
  modified_base (191)..(191): a, c, t, g, unknown or other
  misc_feature (191)..(191): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcacgtgganacngtgtcaccatcacttcgccgggcaagtcggaacattggaccacttatttaatgtatacaacatacgaccagggaccggtaccctaagctacctaatctatcgctgacactaccgagtttcgacaaacggtcgggtacccacgtcgtacggttacaggtacggccgtaaggtcgggtaagtccgtaggggtaacctaggtaacgtttacctaacgttcctaccgtaacctagtacctaacgtaactacgtacggacgtaaccggtaagtaaagttacgttttaacgtacttaaacgtttataccgttacgttaactaaacctaaggtaactttaacgttaacgttacggttttaccggaccgtaagggtaaccctacgtaacttaaaccgtaaagttaaaccggttaataacggtacgtaccgtaagtaccgtaaccgtattaccgtcgttaacgttctacgttacccgttcctaccgtattacctagttaacg

SEQ ID NO: 142206 - DNA, 694 bp, Homo sapiens
  misc_feature: GYAE6OF02GPPLF.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtgggctgggtccggcagcctcccgagggaagggctggaatacattggaagtgtctctcatagtggaggttcctaattacagtccgtctctcaagagtcgagtcaccatatctcgtggacacgtccagcaatctacgttttcccagaacgatgtagttctggtacgacccgccgtactgaccgacggggttcttttaacttacgtgtcggacgacgaggacggtacttaactttagtgttagtttttgggagtttaggttactttcgactacccgttagtacgtaccgggtacggggtccgtacccggtacccggtcggggacccgtacggggtaaacgttaccgtcggtaccgtacccgttccgttacccgttaaccgtccccgtacccgaacccggtaaccggggaccccttacggttaccccggttccccgtttaccccccggtaccggtaccccgtaccccccttacccgtaccccgtaacggacccgtaccccgg

SEQ ID NO: 142207 - DNA, 680 bp, Homo sapiens
  misc_feature: GYAE6OF02IIPSE.46.67.G01.1.454.CMB.1.raw
  modified_base (211)..(211): a, c, t, g, unknown or other
  misc_feature (211)..(211): n is a, c, g, or t
  modified_base (309)..(309): a, c, t, g, unknown or other
  misc_feature (309)..(309): n is a, c, g, or t
  modified_base (411)..(411): a, c, t, g, unknown or other
  misc_feature (411)..(411): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagttagtggtttcttcgtggggctgggtccgnagctccgagggagggctaggatacattggaagtgtctctcatagtggagttcctattacagtccgtctctcaagagtcgagtcaaccattatcttcgnggacacgtcagctaatcgtagttttccagaagatgtacgttctgtcgaccgcgcgtagacgtacgggtacttttataccgtggtcgacgagacggtacggtnttaattagttgttaagtttttgggagtttagggtttactttaccgaacttaacccgtagtacgtaccggggtaaccggggccttacccgggtaccccggtgggggacccgtaaggggtaacttacggtccggtaccgtacccgtttcgtaccctttaccggcccttacccgaacccggtaacgggtaccctacggttacccgggttacccttttccccccggaggtcccctacccccgttacccgtaacccgtacggtaccgtaccccg

SEQ ID NO: 142208 - DNA, 529 bp, Homo sapiens
  misc_feature: GYAE6OF02H0S00.46.67.G01.1.454.CMB.1.raw
  modified_base (390)..(390): a, c, t, g, unknown or other
  misc_feature (390)..(390): n is a, c, g, or t
  modified_base (416)..(416): a, c, t, g, unknown or other
  misc_feature (416)..(416): n is a, c, g, or t
  modified_base (421)..(421): a, c, t, g, unknown or other
  misc_feature (421)..(421): n is a, c, g, or t
  modified_base (454)..(454): a, c, t, g, unknown or other
  misc_feature (454)..(454): n is a, c, g, or t
  modified_base (494)..(494): a, c, t, g, unknown or other
  misc_feature (494)..(494): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctccatcctccctgtctgcaaccggtgggagacagtgtcaccatcacttgccgggcaagtcggaacatgaccactattaatgtatacacatagaccagggaccgccctaagctcctaatctatgctagcactcctagtttgacgtaaacggtcgggtacccagtcggtaggttacaggtggcgtaggtggatcgtagggacagtacttcactctcactatcatactctnacgtaagtgagttatttgataacttntactntacaactataatacagttgttacgacgagacanactaagtaaactaaactagtgtgtactgaccactactctntactacgtacttccgtaccctactactcgtagtac

SEQ ID NO: 142209 - DNA, 540 bp, Homo sapiens
  misc_feature: GYAE6OF02HSYXO.46.67.G01.1.454.CMB.1.raw
  modified_base (383)..(383): a, c, t, g, unknown or other
  misc_feature (383)..(383): n is a, c, g, or t
  modified_base (423)..(423): a, c, t, g, unknown or other
  misc_feature (423)..(423): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctccatcctccctgtctgcaaccgtgggagacagtgtcaccatcacttgctgggcaagtcggaacattgacactaatttaaattggtatcaacatagaccagggaccgcccctaagctacctaatctatgctgcatcctagtttgacgaaaggtcgggtcccagtcgaggttcagtggctagtgatcgtggactagtatttcactctcacatcagtatctancaacgtgtaagtactttagataacttattactagactaanaatattaactattagtttacgacgtaaaggctaacgactaaacaaacttaaacgtactgtagtctacgactacctagtccttagtccttacacgttcctaccgtactactcgtaacg

SEQ ID NO: 142210 - DNA, 643 bp, Homo sapiens
  misc_feature: GYAE6OF02HXZTD.46.67.G01.1.454.CMB.1.raw
  modified_base (388)..(388): a, c, t, g, unknown or other
  misc_feature (388)..(388): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctccatcctccctgtctgcaaccggtgggagacagtgtccacatcacttggccggacaagtcggaacattgacacttatttaaattggtatacaacataagaccgagggaccggacccctaagctacctaatctatgctgcatctagtttgacgaaggtcgggtccagtcgaggttcgagtgcgagtggatcgtagggactagtattcactctcaccatcaagtaanctagacgtaacgtagtaagtagtttacgaccttaaactttattacttagtaacctaaactaagttaaattaacgttaacgtttggttttacccggaaccgtaaagggtaacctaacggtaaaccttaaaacgttaaaacgtttaaaacggtaaccgtaggttaccggtaccgtactacccgtaacctacgttaccgttagtttacccgttactacctttacccgttccccgtaacctacgtttacgtacttaacg

SEQ ID NO: 142211 - DNA, 629 bp, Homo sapiens
  misc_feature: GYAE6OF02FQT2O.46.67.G01.1.454.CMB.1.raw
  modified_base (191)..(191): a, c, t, g, unknown or other
  misc_feature (191)..(191): n is a, c, g, or t
tcagactagcagtacacgaccggtgctcgatttagagtatacatattgggtttgggggagtctcggtcaggacacagcatggacatgagggtccccgctcagctcctggggctcctgctactctggctcgaggtgccagatgtgacatcgagctgacccagtctccatcctcctgtctgcaaccgtggganacagtgcacatcacttgccgggcaagtcgaacattgacactatttaatgtatcaacatagaccgagggaccgcccctaagctacctaatctatcgctgcatcctagtttgacgtaaggtcggggtacccagtcggtaggttcaggtcggcgtagtcggtatcggtgggactagtacttcgtactctacacctatacagttaactctacgacgtaacgtagtaagttgttttacgaccttaaacttacttaccgtagtaacctaaacgtagttaaacgttaactaacgtttcgttttaccggaaccgttaaacgggaactaaccgtaacttaaacgtaaaacgttaaaccgtaagttacggtcggtactacgaccgtaactacgttacttacggttaccttacgtactttaccttacccgtactacgttcctagtaacg

SEQ ID NO: 142212 - DNA, 741 bp, Homo sapiens
  misc_feature: GYAE6OF02J19L9.46.67.G01.1.454.CMB.1.raw
  modified_base (193)..(193): a, c, t, g, unknown or other
  misc_feature (193)..(193): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgtcaccatcacttggcccgggctaaggtccggaacatttcggacctaaccttattttaaaacgttggtatacaacatacggaccgacgggaccgacccctaagctcctaatctatgctgcatccgtagtttcacgtaacggtcgggaccctagtcggtaggttcgagtcggcgtaggtggactcggtgggaactacgtactttccaaccgttccgtacctacctagtacgtaacgttaactcctacggtaaccgtaacggtagtaacgtttagtttacgtaacttaacgttttacgttaccgtcgttaaacccgaaagttaacgttaaacttaaacgttacgtttaacggttttacccgggacccggtaaagggtaaacccgaaacggttaaaccttaaaccgttaaaaccgttaaaaccggtttaacgtacgggtttacgacctttagtacccgtaacttacgttaccgtttaacgttcccgtttaaccgttacccgtttacccgttaccccgttacctaccgttttacgttacgttaaccg

SEQ ID NO: 142213 - DNA, 657 bp, Homo sapiens
  misc_feature: GYAE6OF02HB32M.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccggtgggagacagtgtcaccatcacttgccgggacaagtcggaacatgactactatttaatgtatcaacatagaccagggaccgtcccctaagcctactatctatcgctcgcacttaccgtaggtttcgaacgtaacggtcgggtaccagtcggtagttcgagtgctaggtgtagtcgaggactagtacttacgactctaccactatacgtaattactcgtacgaacgtacgtagtaatttagtttacaacttaactttattacgttagtaacctaaacgtaagttaaacttaacgttaacgtttcgggtttaaccggaaccgtaacgggtaacctaaaccgttaactaaacgtttaaaaaccgttaaacgtaacgttcgggtaacgttcgtaacgtaccgtacttaacgttcgttacgttaccctttactacccgtttaccctacccgtactttacgtacctaagttaccg

SEQ ID NO: 142214 - DNA, 589 bp, Homo sapiens
  misc_feature: GYAE6OF02ILH6Z.46.67.G01.1.454.CMB.1.raw
  modified_base (210)..(210): a, c, t, g, unknown or other
  misc_feature (210)..(210): n is a, c, g, or t
  modified_base (247)..(247): a, c, t, g, unknown or other
  misc_feature (247)..(247): n is a, c, g, or t
  modified_base (283)..(283): a, c, t, g, unknown or other
  misc_feature (283)..(283): n is a, c, g, or t
  modified_base (332)..(332): a, c, t, g, unknown or other
  misc_feature (332)..(332): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtgggctgggtccggnagctccgagggagggctggatacattggaagtgtctntcatagtggagttctattacagttcgtctctcaagngtcgagtcaccatatctctggacacgtccagccaatctacgttttcccngaacgtatgtagttctgtcgaccgccgcgtcgacgtacgggtcttttaattaccgtggttgcgtaagacggtacggtcttagtttagtgttagtttttagggagtttggtttacgtttcgacctacccgtagtacgtcggaccggggtctaccgacccgtgggaccgagggtaactcgtggtacctacgtccgttacctagcctccacgacggtccacgtccgtccttcccgtcggcctccctccaccagccgtccg

SEQ ID NO: 142215 - DNA, 769 bp, Homo sapiens
  misc_feature: GYAE6OF02IL75E.46.67.G01.1.454.CMB.1.raw
  modified_base (316)..(316): a, c, t, g, unknown or other
  misc_feature (316)..(316): n is a, c, g, or t
  modified_base (340)..(340): a, c, t, g, unknown or other
  misc_feature (340)..(340): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactgggtgagggcctttcgggagacccctgtccctcacctgcgctgtctctggtgcctccatcagtagtggtttcttcgtggggctgggtccgcagctccagggagggctggaatacagttggaagtgtctctcaatgtggaggttcctattacagtccgtcttctcaagagtcgagtcaccatatctctggacncgtccagacaatctagttttcccngtaagatgtagttctgtcgaccgcgcgtacgacgtaccgggtacgttttaagttacgtggttcgacgtaaggtacggtaaccggtcgtttaaacgtttagttacggtttaggggggttttttaggtaaggtttagggttttacgttttaccggtaaccgttaaccccgttaaggtaacgttacccggggtacccgggggtaccgttcccgggtaacccccgggttacggggggaacccggtaacggggggttaaaccttaccgggtttacgggtaccccgtacccggtttaccccttacccgtttaaccggtccccgttaacccgaacccgggtaaaccgggtacccccttaacggtttccccggttccccgtttacccccgtacggtcccctaacccccgttcccgtaacccgtacggacgtacccgg

SEQ ID NO: 142216 - DNA, 527 bp, Homo sapiens
  misc_feature: GYAE6OF02G598D.46.67.G01.1.454.CMB.1.raw
  modified_base (217)..(217): a, c, t, g, unknown or other
  misc_feature (217)..(217): n is a, c, g, or t
  modified_base (378)..(378): a, c, t, g, unknown or other
  misc_feature (378)..(378): n is a, c, g, or t
  modified_base (387)..(387): a, c, t, g, unknown or other
  misc_feature (387)..(387): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggnaagtcggaacattgacacctattaaattgtatcaacatagaccagggacgcccctaagctcctaatctatgctgcatccagtttgcaaagtgggtcccatcgagtcagtggcagtgatcgtggacagattcgactctcaccatcaagtatctgacaacgtnaagtatttnactaacttattatgacaactagtaaactatattcgtttcggacctaaggactaacgaactaactaaagtaaacaagttgtagctcgactaccattcgtacttccttcgacgtttcctcccggactacgttacctagtaac

SEQ ID NO: 142217 - DNA, 715 bp, Homo sapiens
  misc_feature: GYAE6OF02FVPBT.46.67.G01.1.454.CMB.1.raw
  modified_base (362)..(362): a, c, t, g, unknown or other
  misc_feature (362)..(362): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcgcctccatcagtagttggtttcttcgtggggcttggggtccggcacgcctccccgaggggaaggggctagggaatacagttgggaagtcgtctctcattaggtggaggttcctattacagtccgttctctacagagtcgagtcaccagtatctctcggacacgtaccagcaattctagttttcccaggaanatgtagttcgtagtcgacccgccgcgtcgaccgtacgggttacgttttagttacgttgtcgacgtaggacgacggtacttagtttacgttacgttaggtttttaggtacggttggttttaacgtttccgaacctacccgttagggtaccgtacggggtaccggggtacctacccggtaccccggggtaggggacccgtaagggtaaaccgttccgttacgggtacccttaccggtccctttacccggttactccccggttaccaacccggtaccgggtaccctaccgggttcccggttaccccgtttcccccgtcggcccttacccccgtcccgaccgtacgaccgtaccccg

SEQ ID NO: 142218 - DNA, 722 bp, Homo sapiens
  misc_feature: GYAE6OF02F59GY.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatccacttcggcccgggacaaggtaccggaaacagttcgaacctaacccttaatttaaaacttggtataccaaactatacgaaccgtaggggaccggaccccctaagcctacctaatctatgctgcatcctaggttgacgaacggtcgggtccctatcggtaggttcagtggctaggtggatcgtagggactaggtattaccacttctacctaaccattccaagttaactcgtacgaccgtaaaccgtagtaaagttacttttacgaaccttaaacgtttacgttaacttacggtaactaaacgtaagttaaactttaacgttaagttttacgggttttacccggtaaccgtaaaacgggtaaccgtaaaccggtaaacccttaaaacgaaaaaccgtttaaaaccggaaccgttaagggtcgggtacctaacgtacccgtaaactacgttaccttaacggttacccttacgttacccgttcccttacccggtaaccctactttcccgttataacccg

SEQ ID NO: 142219 - DNA, 649 bp, Homo sapiens
  misc_feature: GYAE6OF02HRHDC.46.67.G01.1.454.CMB.1.raw
  modified_base (194)..(194): a, c, t, g, unknown or other
  misc_feature (194)..(194): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtctccatcctccctgtctgcaaccggtggganacagtgtcaccatcacttggccgggcaaggtcggaacattgacacttatttaaatggtatacaacatagaccgagggaccgacccctaagcctacctaatctatgctgcatcctagtttgacgtaaggtcgggtcccagtcgtaggttacaggtcggacgtaggtgattcggtagggaactagtatttcgactctaccacctagtacctaagtaacttccgtagaacgtaacgtaggtaaagttattttacgacttaactttattaccgttagtaacctaaacgtagtaaaactttactaaggttttacgtttaccgggaaccggtaaacgggtacctaacgtaacttaaacgtaaaaacttaaacggtaacgttggtaccggtacgtacgaccgtaactacttaccgttgttaccgttcctacttcccgtacccgtacctattccgtagtaccg

SEQ ID NO: 142220 - DNA, 582 bp, Homo sapiens
  misc_feature: GYAE6OF02FIIMD.46.67.G01.1.454.CMB.1.raw
  modified_base (211)..(211): a, c, t, g, unknown or other
  misc_feature (211)..(211): n is a, c, g, or t
  modified_base (447)..(447): a, c, t, g, unknown or other
  misc_feature (447)..(447): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctccatcagtagttggtttcttcgtggggctggggtccgcagcctcccgagggagggctggaatacattggaagtgtctctcatgtggtaggttcctattacgagtccgtctctcaagtagtcgagtccaccatactctctggacaccgtccagcaatctacgttttcccagaagtatgagttctgtacgaccgccgcgtgacgcgggttactttatctgtgcgtagacgtacgnttacttagtgttagttttggtagtttgttacgtttacgacctacgtagacgtcggtacgggtcctccggaccccggtgggaccgtaacgggtacttaccgtcggtccgtaccgttctcccgttacgccctacccg

SEQ ID NO: 142221 - DNA, 523 bp, Homo sapiens
  misc_feature: GYAE6OF02IJK6K.46.67.G01.1.454.CMB.1.raw
  modified_base (192)..(192): a, c, t, g, unknown or other
  misc_feature (192)..(192): n is a, c, g, or t
  modified_base (217)..(217): a, c, t, g, unknown or other
  misc_feature (217)..(217): n is a, c, g, or t
  modified_base (325)..(325): a, c, t, g, unknown or other
  misc_feature (325)..(325): n is a, c, g, or t
  modified_base (501)..(501): a, c, t, g, unknown or other
  misc_feature (501)..(501): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccgggnaagtcggaacattgacactaatttaaatggtatcaacatagaccaggacggcccctaagctcctaatctatgctgcatccagtttgcaaagtgggtcccatcgagttnagtggcagtgatctgggacagattcactctcaccatcagtaatctgctaacgtgaagtatttgactaacgttattaactgtacaaactaagtaatttaacaaattgttttacgggacctaaagggtaccaacgtaactaacaaaattaaacgaactgtagctgacacatctgtctnacttcttaccgctatctagtac

SEQ ID NO: 142222 - DNA, 742 bp, Homo sapiens
  misc_feature: GYAE6OF02J0GR9.46.67.G01.1.454.CMB.1.raw
  modified_base (188)..(188): a, c, t, g, unknown or other
  misc_feature (188)..(188): n is a, c, g, or t
  modified_base (211)..(211): a, c, t, g, unknown or other
  misc_feature (211)..(211): n is a, c, g, or t
  modified_base (222)..(222): a, c, t, g, unknown or other
  misc_feature (222)..(222): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcacgtgganacagtgtcacatcacttgccggnaagtcggaacnttcgactaccttatttaaatgtatcaacatacgacgaggaccggaccctaagctactaactctatgctgcactctagtttcgacgtaaacggttcgggtacctaggtccggtaggttacgacggtcggtaccgtaggttcggtacgtacggtagggtaactagttacgtttacctaacgttccgttacctacccgtaactacgttaacgttaacgttcgttacggaaccgttaacggtagtaaacggtttacttttacggtaccttaacgtttaacgtttacgttacgtactaaacgttaaagttaacgttaaacttaacgtttacgttttaccggaacggttaaacgggtaacctaaccggtaacttaaaaccgtaaaacgttaaaccggttaaacgttacggttacgtacgttaccggtaacctaacccgttaacgttccgttaacgtttaccgtttacccgttaaccgtttaccccggtttacccctaccgttaaccgttaccgttacgttaaccgg

SEQ ID NO: 142223 - DNA, 720 bp, Homo sapiens
  misc_feature: GYAE6OF02J0B4Q.46.67.G01.1.454.CMB.1.raw
  modified_base (214)..(214): a, c, t, g, unknown or other
  misc_feature (214)..(214): n is a, c, g, or t
  modified_base (636)..(636): a, c, t, g, unknown or other
  misc_feature (636)..(636): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagaccctgtccctcacctgcgctgtctctggtgcctccagtcagttagtggtttcttcgtggggctggggtccgnacgcctcccgaggggaagggctaggaatacgattgggaattgtctctcagtagtggaggttcctattacacgtccgtactccttacagacgtcgagtacaccgatactctcgtgaccacgtcccaagcaactccgtacgtttttcccaggtaacgtatcggtagtttcctggttacgacccggtccgtctacggaacggtaccgggttacgttttactttacgtggttacgacggtaaggacggtaccgggactttagtttacgttaggttagttttttacgggaggtttcggttttaacgtttcgtaaccgtacccgttaggttaaccgtcgggaaccggggtcgtacccgggtacccgttacggggaccgtaacggggtaacgtcgttccggttaccgtacccgtaccgttccgttaccncccgtaccgaccgtaaccgggaccttacggttccggtacccttccccgtacgtcccgtacccctcctaccgacgtctaccccgg

SEQ ID NO: 142224 - DNA, 719 bp, Homo sapiens
  misc_feature: GYAE6OF02ISIIB.46.67.G01.1.454.CMB.1.raw
  modified_base (257)..(257): a, c, t, g, unknown or other
  misc_feature (257)..(257): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcgcctcatcagtagtggtttcttcgtgggctgggtccggcacgtctcccgagggacgggtctggaatacgagttggaagtgtctctnagttaggtggtacggttcctattacgagtccgtctcgtctaagcgtcgagtacacctattactctcgtgactaccgtccaagcaatcgtacgttttcccagtaagtactgtacgttctagtcgccgcgtctcgtacgacggtacttttacgtacgtggtcgacgtagacgtaggtacttaagtttagtagtttagttttaggtagttacggtttaagtttccgaaccgttaccgttaggtacgttaccggggacggggtcctaccgggtaccccggttggggaacccggtaagggtaaccgttacgtacggggttacccaaccggttccttaccggttaaccgtcccgttaccctaaccggtaaccgggttaccctacggttacccggttccccgtttaccccgggtccggttacccgtaacccccgttcccggtaaccccgttaacgacccggttaacccg

SEQ ID NO: 142225 - DNA, 595 bp, Homo sapiens
  misc_feature: GYAE6OF02F0DVP.46.67.G01.1.454.CMB.1.raw
  modified_base (344)..(344): a, c, t, g, unknown or other
  misc_feature (344)..(344): n is a, c, g, or t
  modified_base (350)..(350): a, c, t, g, unknown or other
  misc_feature (350)..(350): n is a, c, g, or t
tcagactagcagtacacgaccggtgctcgatttagagtatacatattgggtttggtcctcctgctggtggcagctcccagatgggtcctgtccctcggtgcaactgcacggacgtccgggcccacgactgggtgaggccttcgggagaccctgtccctcacctgcgctgtctctggtgcctccatcagtagtggtttcttcgtggggctgggtccgcagcctcccgaggggaagggctggaatacattggaagtgtctctcatagtggtaggttcctattacacgtcctctctcaaggatcgagtcaccatactctctgacacgtcagcaatctagttttcccngaagtntgtagttctgtcgaccgccgctgacgacgggttcgtttattacgtgtgcgagacgacgtctattagtgtagttttggagtttgttactttcgactaccgtagtacgtcgggacgggtccgtccgacccggtgggaccgtaggtaacgtacgtcgtccaccgttctaccgttcgtacctacccgacgtaaccggccctacgtccgttccctcccgtcgccctacccttccctacgtacgactcccg

SEQ ID NO: 142226 - DNA, 765 bp, Homo sapiens
  misc_feature: GYAE6OF02H9GQI.46.67.G01.1.454.CMB.1.raw
  modified_base (139)..(139): a, c, t, g, unknown or other
  misc_feature (139)..(139): n is a, c, g, or t
  modified_base (195)..(195): a, c, t, g, unknown or other
  misc_feature (195)..(195): n is a, c, g, or t
  modified_base (206)..(206): a, c, t, g, unknown or other
  misc_feature (206)..(206): n is a, c, g, or t
  modified_base (249)..(249): a, c, t, g, unknown or other
  misc_feature (249)..(249): n is a, c, g, or t
tcagactagcagtacacgaccggtgctcgatttagagtatacatattgggtttgtcctcctgctggtggcagctcccagatgggtcctgtccctggtgcaactgcaggagtcggcccacgactggtgaggccttcgganaccctgtccctcacctgcgctgtctcgtgtcgcctccatcgagttgtgtttctcgngggctggtcgnagcctaccgagggacgggctaggatacgagttggaagtgtctntcgaataggtggtaccggtttctaagtttacgaggttccctacgtctacgaaaggtcggttacacggttaccaaccgtaattacctccgtagtaggacccttacggtccaacgtacgtaactacttaaccgttttcccaggaacgttagtagtaacggtttctcggtaccgaacccggtccgacgtttacggacgggtaacccggtttacgttttttaagacccgtttggtaccgggacgtaaggtacgggtaacgtaccgtttttaattaagtacggttttaagggttttacgggtaaggtttttcgggtttaaatttacccggacttaaacccggttagggtaccgtaaccggggtacggggttccctacggtaaccccgggttggggaacccgtaaagggttcaacggttcggaccgtactacccgtccgtaagccccttaacgacccggtaagccctcggttacccgttcccgtcccgtcaccgttccccgttaccgtccaaggtcctaccg

SEQ ID NO: 142227 - DNA, 612 bp, Homo sapiens
  misc_feature: GYAE6OF02GFZ0G.46.67.G01.1.454.CMB.1.raw
  modified_base (217)..(217): a, c, t, g, unknown or other
  misc_feature (217)..(217): n is a, c, g, or t
  modified_base (227)..(227): a, c, t, g, unknown or other
  misc_feature (227)..(227): n is a, c, g, or t
tcagactagcagtacacgaccggtgctcgatttagagtatacatattgggtttggggagtctcggtcaggacacagcatggacatgagggcccccgctcagctcctggggctcctgctactctggctccgaggtgccagatgtgacatcgagctgacccagtctccatcctccctgtctgcaaccgtgggagacagtgtcaccatcacttgccgggnaagtcggaanattgacacctatttaattgtatcacatagacagggacgccctagctctatctatgctgcactcctagtttgacaaggtcgggtacccagtcggtaggttcaggtggcgtagtggatcgtagggacagtactttcactctccacctatactaagtaatctagtacgaacgttagaagttattttagaccttaactttattacttcgtacaaacgtagtaaactttaacgtaagtttacggttttaccggaccgtaaacggggtactaaaccggtaaccttaaacgttaaaacttaaaaccgtaacgttaggtacgtactagtaccgaacctattacgtcgtttacttacctacttcccgttacccgtacctacgttacctagtaac

SEQ ID NO: 142228 - DNA, 584 bp, Homo sapiens
  misc_feature: GYAE6OF02IBPMK.46.67.G01.1.454.CMB.1.raw
  modified_base (365)..(365): a, c, t, g, unknown or other
  misc_feature (365)..(365): n is a, c, g, or t
  modified_base (384)..(384): a, c, t, g, unknown or other
  misc_feature (384)..(384): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaattggtatcaacatagaccagggacgcccctaagctcctaatctatgctgcatcctagtttgacaaggtcgggtcccatcgaggttcagtcggcaggtgatcgtagggacagtatttcactcncaccatcattaactctacncacgtagaagttgtttagactaacgtttattactatactaacagtaacttaacaacttgtttacggaccgtaagggtacacgtaacgtaacaaacgttaaacgaaactggtagtaccgtgtacctaacccgtagttacttcgttaccgtttaccctagtttccccttacccggtacccttaacgttccgttagtaacccg

SEQ ID NO: 142229 - DNA, 583 bp, Homo sapiens
  misc_feature: GYAE6OF02GOFX3.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctgggctgggtccgcagctccagggaagggctggaatacattggaagtgtctctcatagtggtaggttcctattacagtccgtctctcaagagtcgagtcacatatctctggaccacgtccagacaatctacgttttcccagtaacgatgtagttcgtagtcgaccgtcgctgacgacgggtctttattacgtgtgacgtagagacgtctattatgttagtttgagttgttattcgacacctagctcggacgggtctccgaccgtgggaccgtaagggactacgtcgtcaccggtctaccgttacgccttaccgaaccgtaacggaccctacgttcccgttacccgttccccgtcggtaccctaccccgtaccctacccaagtcctaccg

SEQ ID NO: 142230 - DNA, 856 bp, Homo sapiens
  misc_feature: GYAE6OF02HVT54.46.67.G01.1.454.CMB.1.raw
tcagactagcagtacacgaccggtgctcgatttagagtatacatattgggtttggggagtctcggtcaggacacagcatggacatgagggtccccgctcagctccgtggggctcctgctactctggctcgaggtgccagatgtgacatcgagctgacccagtcctccatccctccctgtctgaccgaaccggtgggacacgtaggtcgtacacctactctacgttcgggacccgggtactaaacggtacggaaactacgttacgaacccttaaaccttttaaagttttaaaacgttacggttaactaaacctaacgtaaacgttaaccggaacccggtaacggggaaccccggtaacccccgttaaagtccttaacccttaaattctaacgtcgtcgtacgacctacttccgttaaggtttacgaacggttaaaccgggttccgggaccctaggttacggtacgttacgacggtacggtacgtagggtcgtacgtacggtagggtaactaacgttactttaccgacttaccgtaccctaactagtacgtaaacgttaacgtacctaggtaaccgtaacggtaacgttaaacgtttacgtttaaccgttaaccttaacgtttaacttaaccgttagttaaccgtaaacgttaaacgttaaattaaccgtaacgttttaccggtttaaccggaaacggtaaacggaaccgttaaacggtaaaccgtttaaaacgtaaaaccgttaaacggtaactacgggtaccgtacgtaccgtaccgtaaccgttaccttcggttaccttaccttaccgttaacccgttaccctcccggtaaacttccgttacgttagttaacccg

SEQ ID NO: 142231 - DNA, 576 bp, Homo sapiens
  misc_feature: GYAE6OF02IXU9O.46.67.G01.1.454.CMB.1.raw
  modified_base (158)..(158): a, c, t, g, unknown or other
  misc_feature (158)..(158): n is a, c, g, or t
  modified_base (187)..(187): a, c, t, g, unknown or other
  misc_feature (187)..(187): n is a, c, g, or t
  modified_base (212)..(212): a, c, t, g, unknown or other
  misc_feature (212)..(212): n is a, c, g, or t
  modified_base (223)..(223): a, c, t, g, unknown or other
  misc_feature (223)..(223): n is a, c, g, or t
  modified_base (243)..(243): a, c, t, g, unknown or other
  misc_feature (243)..(243): n is a, c, g, or t
  modified_base (301)..(301): a, c, t, g, unknown or other
  misc_feature (301)..(301): n is a, c, g, or t
  modified_base (319)..(319): a, c, t, g, unknown or other
  misc_feature (319)..(319): n is a, c, g, or t
  modified_base (323)..(323): a, c, t, g, unknown or other
  misc_feature (323)..(323): n is a, c, g, or t
  modified_base (328)..(328): a, c, t, g, unknown or other
  misc_feature (328)..(328): n is a, c, g, or t
  modified_base (336)..(336): a, c, t, g, unknown or other
  misc_feature (336)..(336): n is a, c, g, or t
  modified_base (340)..(340): a, c, t, g, unknown or other
  misc_feature (340)..(340): n is a, c, g, or t
  modified_base (344)..(344): a, c, t, g, unknown or other
  misc_feature (344)..(344): n is a, c, g, or t
  modified_base (495)..(495): a, c, t, g, unknown or other
  misc_feature (495)..(495): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgaccngtctcatcctcctgtctgcaacgtgggancagtgtacacatcacttgaccgganaaggtcgaacntgactacttattaagtgtancaacatacgacgaggacggacccctaagtctctaatctactgctgactatcctagttnacaaggtcggtccatcgngtcngtgcngtgatcgngganagtnttcgactctacacgatacagtactctggaacagtgtaagtcttagacctaattctaacgttgactaacgtagtaacttactaaacgtcgtttacgaacgttacggacttaaacggattaaacgtaaacgttaaaccgaatcgggtacggtntaaccgtccgtaccgttaatcgtaacgttaccttacgtaaccttccccgttccggttaaccaacttttccgagttaacccg

SEQ ID NO: 142232 - DNA, 791 bp, Homo sapiens
  misc_feature: GYAE6OF02JZVOW.46.67.G01.1.454.CMB.1.raw
  modified_base (209)..(209): a, c, t, g, unknown or other
  misc_feature (209)..(209): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggcccttcggagaccctgtccctcacctgcgctgtctctggtgcctccatcagtagtggtttcttctgggctgggtccgnagctccgagggagggctaggaatacattggaagtgtactctcagtagtggaggttcctattacagttccgtctctcaagtgtcgagtcaccgatacgtctctacggacacgtccagctaattcgtacgtttcccctagtaacgtataggtaacgttccttggtaccgaaccggtcccgtacgtacgacgtaccgggggtactttttaacggttacgttcgttacggtcggaagtacggtaacggtacgttaacgttacgtagtttaaggttttacggttaggttacgggtttatttaccggtaacgttaaccccggttaaggttaccgttacggggtaaccgggggtaccgttaccgggtaccccgggttacggggtacccggtaaacggggtaacgttaacccgggtttcgggtacccgtttacccggttaccctttaacccggtttaccgcccgttttaccccgaacccggtaaaccggggttacccccctaagggttacccgggttccccttttacccccgtacgggttccccctaacccccgtttacccgttacccggaaccggttcccggtaacccg

SEQ ID NO: 142233 - DNA, 633 bp, Homo sapiens
  misc_feature: GYAE6OF02IKKCN.46.67.G01.1.454.CMB.1.raw
  modified_base (193)..(193): a, c, t, g, unknown or other
  misc_feature (193)..(193): n is a, c, g, or t
  modified_base (257)..(257): a, c, t, g, unknown or other
  misc_feature (257)..(257): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgtcaccatcacttgccgggtacaagtcggaactattgactacctattaaatgtatcaanatagaccaggacgaccccaagctactaatctatgctgcactcctagtttgacgtaaaggtcgggtaccagttcggtaggttcgagtggacgtagtggtagtgtagggactagtactttcgactctacacctatacaagttaactctagacgtaacgtagtaagttagtttacgaacttaaactttattacgttacgtaactaaacgtaacttaaacttaacgtaacggtttacggtttaccgggaaccgtaaacgggacctaaccgtaaacgttaaactaaaagttaaaaccgtaagttcgtaggtactcgaaccgtaacctagttaccgttacgttccttaccgtacttcccgttaccctactacgttctagtac

SEQ ID NO: 142234 - DNA, 555 bp, Homo sapiens
  misc_feature: GYAE6OF02FSN5T.46.67.G01.1.454.CMB.1.raw
  modified_base (334)..(334): a, c, t, g, unknown or other
  misc_feature (334)..(334): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagaccctgtccctcacctgcgctgtctctggtgcctccatcagtagtggtttcttctggggctgggtccggcagctcccaggggaagggctggaatacattggaagtgtctctcatagtgaggttcctattacagtccgtctctcaagagtcgagtcaccatatctctggacacgtccagcaatcagttttcccngaagatgagttctgtcgaccgcgctgacacgggtctttatactgtgcgagagacggctattatgtagttttggagttggttatttcgactaccctagatcggacggggctccgacccgtggggccagggactacgtggtccacgtctccttagcctccaccgacgggccctacgtccgttccttccccgtcggccctaccccgtcctccgacgcgtacccg

SEQ ID NO: 142235 - DNA, 672 bp, Homo sapiens
  misc_feature: GYAE6OF02IES7S.46.67.G01.1.454.CMB.1.raw
  modified_base (123)..(123): a, c, t, g, unknown or other
  misc_feature (123)..(123): n is a, c, g, or t
  modified_base (200)..(200): a, c, t, g, unknown or other
  misc_feature (200)..(200): n is a, c, g, or t
  modified_base (234)..(234): a, c, t, g, unknown or other
  misc_feature (234)..(234): n is a, c, g, or t
  modified_base (329)..(329): a, c, t, g, unknown or other
  misc_feature (329)..(329): n is a, c, g, or t
  modified_base (402)..(402): a, c, t, g, unknown or other
  misc_feature (402)..(402): n is a, c, g, or t
tcagactagcagtacacgaccggtgctcgatttagagtatacatattggggtttgggggagtctcggtcaggacacagcatggacatgagggtccccgctcagctcctggggctcctgctacnctggctccgaggtgccagatgtgacatcgagctagacccagtctccatccctccctgtcctgaccaaccggtggganacaggtcgtccaacctatcacgttggacccgggnaaggtccggaatattgacacttatttaaagtggatacaacatacgaccagggaccgacccctagcctacctaatctatgctgcaatccagtttanactaaaggtcgggaccctagtccgtaaggttcaaggttggcgagtggactgtagggactagtatttcacttcncactaatcaacgtatctacgacgtacgtagtaatacgtttagtacctaactttaattacgttacttactaaacgtaagttaaactaacgtaatttacggttttcccggaacgtaaaccggtacgaaccgtaaaccttaaacgtaaaccgtttaaaacgaaccggttagttacgggaccgtttaaccgccaaaccttaccggttaccttaggttaccctttaacttacgtttaccccgttacccgtacccctacttaccggtacgttaacc

SEQ ID NO: 142236 - DNA, 605 bp, Homo sapiens
  misc_feature: GYAE6OF02FHOHM.46.67.G01.1.454.CMB.1.raw
  modified_base (173)..(173): a, c, t, g, unknown or other
  misc_feature (173)..(173): n is a, c, g, or t
  modified_base (211)..(211): a, c, t, g, unknown or other
  misc_feature (211)..(211): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggcccttcggagaccctgtccctcacctgcgctgtctctggtcncctccatcagtagtggtttctcgtggggctgggtccgnagcctccgaggggagggctggaatacattgggaagtgtctctcagtaggtggaggttcctattacagtccgtctctcaagagtcgagtcaccatatctctggacacgtccagcaatcacgtttttccctgaagtatgtagttctgtgaccgcgctgacacgggtcttttatactgtcgcgagagacggctattatgtatttttggagttggttactttcgactaccctagacgtcggacgggggtctacccggaccccgtggggaccgaagggtaacgttacgttcggtacctaccggttctacccgttacgccctaccgacccgaacgggcccacgtcccggttcccgttccccgtcggaccctaccccgttccctaccgaacgtcgtacccg

SEQ ID NO: 142237 - DNA, 904 bp, Homo sapiens
  misc_feature: GYAE6OF02GX3LP.46.67.G01.1.454.CMB.1.raw
  modified_base (212)..(212): a, c, t, g, unknown or other
  misc_feature (212)..(212): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtcncctcactcagtgtggttcttcgtggggctgggtccgcagcctccgaggggagggctggaatacagttggaagtgtcttctactataggtgggtacggttttcctaatttacgacggttcccgtctttacctacgaaaggtagtaccggtaacggttaccctaacccgtaagtttaacttcccttaccgggttacggggtaaacccgtaacccggttacccgaacgggtaaaccttaaacttccccggttttaaccggtttttttacccccggaaggttaaaacgggttaagtttcgggtttaacggttttccggttttaggttacccgggtaacccccgggttaccccgggtaccgtttaaccggggaaacccgggtttacccgggggtttaaccgggtttttttaacgttttaaacccgtttgggtttaccgggaaccgggttaacggtaaccggggtaccggtttaccgttaaagtttttacggttaggtttttaaggtttttttaccgggggtagttttaacgggtttttacgttacccggtttaacccgtaaaccctttaagggaccgtcgggggtacccggggttccgttacccgggtacccggttaggggggaccctaagggttaccgtaccgttaccggtacccgttccgttacccgtttccgttacccggtcccgtacccccgg

SEQ ID NO: 142238 - DNA, 621 bp, Homo sapiens
  misc_feature: GYAE6OF02HQG0G.46.67.G01.1.454.CMB.1.raw
  modified_base (208)..(208): a, c, t, g, unknown or other
  misc_feature (208)..(208): n is a, c, g, or t
  modified_base (443)..(443): a, c, t, g, unknown or other
  misc_feature (443)..(443): n is a, c, g, or t
  modified_base (537)..(537): a, c, t, g, unknown or other
  misc_feature (537)..(537): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggccttcggagaccctgtccctcacctgcgctgtctctggtgcctcatcagtagtggtttctcgtgggctgggtccgnagctccgagggaggctggaatacagttggagtgtctctcatagtggaggttcctattacagtccgtctctacagagtcgagtcaccatatctctggacacgtccagcaactcgtacgttttcccagaacgtagtgtacgttcgtgtacgacccgcgtcgtacgacgtacgggttacttttacgtacgtgtacgcggaggaggtaccgtagtttacttagtgtttacgttttaggngtttaggttactttacgaacctaccgtagacgtccggggacggtccgccgtacccggtgggccgaggatcgttcgtcgtaccgtccttaccgtntccctaccaccggccggtacccacggttcccggttacccgtccccgtcggtcccctaccccgtcccgtaactaggacctacccg

SEQ ID NO: 142239 - DNA, 718 bp, Homo sapiens
  misc_feature: GYAE6OF02JP6HY.46.67.G01.1.454.CMB.1.raw
  modified_base (332)..(332): a, c, t, g, unknown or other
  misc_feature (332)..(332): n is a, c, g, or t
  modified_base (367)..(367): a, c, t, g, unknown or other
  misc_feature (367)..(367): n is a, c, g, or t
tcagactagcagtacacgaccggtgctcgatttagagtatacatattgggtttgggggaccgtcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatccagttagtggttttcttcgtggggctgggtccggcagctccgagggaacgggctggatacagttggagtgtctctcatagtggagttcctattacagtccgtactcactagngtcgacgtccaccgtattacgtcctcgtacggacncgttaccaggacctaacgttccgttacgtttttacccgagtaacggtaattcgttagtttcctaggtcgtaacccccggtccgtacgttacgaccggtaccgggttacgttttacttacgttggttcgacgtacggaacggtgaccgtttaagttcgttagtttagttttagggtacggtttggttttaaccgtttcgtaaccgtaaccgtttacggtacgggttaccgggtacccggggggtctacccccgggttaacccgggttagggtacccggaacgggttaacgttacggttccggttacccgtccggttacccggttacccggtttacgtcccccgttaacccgg

SEQ ID NO: 142240 - DNA, 695 bp, Homo sapiens
  misc_feature: GYAE6OF02IJXTJ.46.67.G01.1.454.CMB.1.raw
  modified_base (214)..(214): a, c, t, g, unknown or other
  misc_feature (214)..(214): n is a, c, g, or t
tcagactagcagtacacgaccggtgctcgatttagagtatacatattgggtttgtcctcctgctggtggcagctcccagatgggtccctgtcccctggtgcaactgcaggagtcgggcccacgactggtgaggccttcggagacccctgtcccctcacctgcgctgtctcgtggtgcctccatcagtagtggtttcttcgtgggctgggtccgnacgctcccgagggaggggctggaatacagttaggaagttgtcctctcgatagtggtaggttacctatttacacgtccgtctctacaagacgtacgagtccacatatctctcggactaccgtccgacgactaactcgttacgttttaccccgagtaagtagtgtagttctcgtacggacccgtccgtcgtacggacgtacgggttacgttttacttacgtgtggacggtaggtacggtacggtacttaagtttacgttaggtttagttttacgggtagtttaggttttagtttaccgtaacccgtaccgtagtaaccggtcgggtaccgggtccgtaccggcccggtacgggaccgtagggtacgttacgtacggtcctacgttccctcgtaccgtccctaccgtaccgaccggtcccgtacgttacccggttcccttccccggtccgtcccgtacccctccgtaacccacgaccgtacccg

SEQ ID NO: 142241 - DNA, 731 bp, Homo sapiens
  misc_feature: GYAE6OF02JCZHK.46.67.G01.1.454.CMB.1.raw
  modified_base (194)..(194): a, c, t, g, unknown or other
  misc_feature (194)..(194): n is a, c, g, or t
tcagactagcagtacacgaccggtgctcgatttagagtatacatattgggtttgggggagtctcggtcaggacacagcatggacatgagggtccccgctcagcctcctggggctcctgctactctggctccgaggtgccagatgtgacatcgagctgacccagtctccatcctccctgtctgcaaccgtgggancagtgcaccatcacttgccgggcaagtcgaactattgactacttatttaattggtatcaactatacgaccagggaccgcccctaagcctcctaatctatgctgactactccgtagtttacgacgtaaacggtcgggtaccctagtcgggtaggttccgaggtcggacgtaggtcggtacgtcggttacggggactaagttacgttttaccaaccgttccttacccaaccgttacttaaccgaacggtttaacttaccgttacgtacctaaacgggttaacggtaacgtttaagttttaccgtaaccttaaacctttacttaaccgttaacgttactaaaccgttaagtaacctttaacctaagttttaccgggttttaccgggaaccggtaaacgggtaaccaaacggttaaccttaaacgtaaaaacgttaaacgtaacgttacggtcggtaccgtcggacctaacctaccgttacttaccgtttaccttaccgttaccgttccttaccccggtccttaacgttacctagtaaccg

SEQ ID NO: 142242 - DNA, 890 bp, Homo sapiens
  misc_feature: GYAE6OF02I0XI0.46.67.G01.1.454.CMB.1.raw
  modified_base (137)..(137): a, c, t, g, unknown or other
  misc_feature (137)..(137): n is a, c, g, or t
  modified_base (221)..(221): a, c, t, g, unknown or other
  misc_feature (221)..(221): n is a, c, g, or t
  modified_base (622)..(622): a, c, t, g, unknown or other
  misc_feature (622)..(622): n is a, c, g, or t
  modified_base (653)..(653): a, c, t, g, unknown or other
  misc_feature (653)..(653): n is a, c, g, or t
tcagactagcagtacacgaccggtgctcgatttagagtatacatattgggtttgggggacctcctgtgcaagaacatgaagcactgtggtttgtcctcctgctggtggcagctcccagatgggtcctgtccctggtncaactgcaggagtcgggcccacgatgggtgacggtccttcgggacgtaccctgtcccctacacctgccgctcgtctcgtggtcncctcatcaggttagtcggtttcttacggtggggtcgttcggggtcccggactacggccgtacccgggaagggggaacggggtcctagggtaaactacgtagttaggtaacgttgtctcgtactaagttaaggtgggtacgtttacctaagttacgacggttcccgtacttccggtaacgaaggtccgttacgtacggttaccccaaccgtatttaacgttcccgtacggttaacggaaccccgtacggttacccaggtaaccttaaacgttccgtttaaccgttttaccccgttagggaaacgttaacgtttccggtaaggttttccgtaacggttcccggtaacccccgcggttacgtacgggtaaccgttacgggttaccgtttagttacgtacgggtnacggtacgggactaccgggtattaaggtttnttacggtttaggttttagggtacgggtttagttttaaccggtttccaaaccggttacccggttaagggtacccgtttaaccggggggaccggttacccggttttaacccgggccccccgggggttaaggggtacccgggtaaacgggttaaccggtttaccggttaacccgggtttacccgttaacccgggttttcctttaaccccggtttacccggacccccggttaaaccccggg

SEQ ID NO: 142243 - DNA, 653 bp, Homo sapiens
  misc_feature: GYAE6OF02JU47R.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggagacagtcgtcaccatcacttgccggtcaaggtcggaacattgactacctagtttaaattggtatcaacatacgtaccgagggaccggacccctaagcctacctaatcctatgctgcatcctagttcgcgaaagtcgggtaccagtcgaaggttcaggtcggctagtggatcgaggacgtaggtactttacgactccgtcaacatactaagtactcgtcgtacgtaacgtgtaactagtttgaaccttaattacttacgtagttaacaaacgtacgtaaacttactaacgtttcggtttaccggtaacgtaacgggaacccgttaacgaactttaaaccaaaacggtttaaaccgtaagtacggttaacgtcgtaagtacccgtaaccgtaacttaccgttacgttaccgtttacctaaccggttccttacccccggtaattaccttaccgttacgttaaccgg

SEQ ID NO: 142244 - DNA, 808 bp, Homo sapiens
  misc_feature: GYAE6OF02HWMWH.46.67.G01.1.454.CMB.1.raw
  modified_base (171)..(171): a, c, t, g, unknown or other
  misc_feature (171)..(171): n is a, c, g, or t
  modified_base (285)..(285): a, c, t, g, unknown or other
  misc_feature (285)..(285): n is a, c, g, or t
  modified_base (294)..(294): a, c, t, g, unknown or other
  misc_feature (294)..(294): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtccctcacctgcgctgtctctggngcctcatcagtagtggtttctcgtgggcttgggccgcagcctccgaaggggagggctggaaatcagttggaagtgtctctcagtaggtggacggttcctaattacagttccgtntctacaagngtcgagtacaccatatctctaggacacgtccagctaatcctacgttttcccaggtaaacgtatagtaagttcgtggttcgacccggtccgcgtacggacgtacgggttcgttttactacgttggtcgcggtaaggacgacggtacgttaattacttaggtttagtttttagggaaggtttacggttttaacgtttacggtaacccgttaacccgttaacggtaccggttaccgggtaccgggggtaacccgttacccgggaacccccgggtttacggggggacccggtaaagggggtaaactttaaccgggttcgggttaacccgtaaacccgggtttcccgttaccccggtttaaccgtaccccggttacccccgtaaaccccgggaaacccgggggttaccccctaaccgggtttaccccgggtttacccccgtttacccccccggttcgggtaccccccgtaaccccccgttcccccggtttaacccaaccgggttacccgtaacccccgg

SEQ ID NO: 142245 - DNA, 641 bp, Homo sapiens
  misc_feature: GYAE6OF02IOWU9.46.67.G01.1.454.CMB.1.raw
  modified_base (250)..(251): a, c, t, g, unknown or other
  misc_feature (250)..(251): n is a, c, g, or t
  modified_base (351)..(351): a, c, t, g, unknown or other
  misc_feature (351)..(351): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctatccctggtgcaactgcaggaggtccgggcccacgactgggtgaggccttcggagaccctgtccctcacctgcgctgtctctggtcgcctcatcagtgtggtttctcgtgggctgggtccgnngcctccgagggagggctggaatacagtggaagtgtctctcagtaggtggtagtttcctattacgagtccgtactctacgaagatcgagtcactatatctntacggacacgtcagtctaatcgtacttttcccagtaacgtatgtacttcgtcgtacgtacccgccgtctacgacggtacgggttctttattcgtaggtcgtacgagtaacgcggtattacttagttagtttaggttttgaggtttcggtttactttaccgaacctaccggttaagaccgttccggggaccggggttccgttacccggtaccccggttggggacccggtaaggttaaccgtcggtacgttacccgtacccgttccgttaccgttaccggacccctacccgg

SEQ ID NO: 142246 - DNA, 839 bp, Homo sapiens
  misc_feature: GYAE6OF02JX3LV.46.67.G01.1.454.CMB.1.raw
  modified_base (149)..(149): a, c, t, g, unknown or other
  misc_feature (149)..(149): n is a, c, g, or t
tcagactagcagtacacgaccggtgctcgatttagagtatacatattgggtttgggggtacctcctgtgcaagaacatgaagcacctgtggtttgtcctcctgctggtggcagctccagactgggtcctgtccctggtgcactgcaggngtcgggccacgactgggtgaggccttcggagaccctggtaccctcactggctcttgtcttcgtgggtctccctacatcctaggttacgttcgggttttccttcggtcgggggccgttcggggtacccggcacgtccgttaccccggacggggtaagggggccgtagggaaagtaccgtagttaggaagttcggtctcgtactagtacggtgggtacggttcctaacgtttacctacggttccgttactccgttacaagtacggtcggtacgttccgaacctagttaactccgtacgtaggtaaccaccggttaccgacgtacgtaactttaccggtacgttttttacccacggtaaacggtctttaacggtcggtttaccgttcggtaccggtacccggtccccggtcggttaaacgtacccggggttacgggggttacctttttaacggttacttcgggtttacggacggtaaacgggtacgggaacgtttccgttaaacgtttggtttacgttaaggtttttacgggtaggtttaacgggtttacctttaaccggaaccgttacccgtaaggttacgtccggggtacccgggttcggtaacccggtcccggttaggggaccggtaagggttacgttaacctcgggttaccgtaaccgttccgtttaccgttacggtccctaaccccgg

SEQ ID NO: 142247 - DNA, 614 bp, Homo sapiens
  misc_feature: GYAE6OF02G8UX1.46.67.G01.1.454.CMB.1.raw
  modified_base (196)..(196): a, c, t, g, unknown or other
  misc_feature (196)..(196): n is a, c, g, or t
  modified_base (223)..(223): a, c, t, g, unknown or other
  misc_feature (223)..(223): n is a, c, g, or t
  modified_base (362)..(362): a, c, t, g, unknown or other
  misc_feature (362)..(362): n is a, c, g, or t
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtcctccatccctccctgtctgcaaccggtggganacagtgcaccatcacgttggccggganaaggtcgaacattcgactaccttaatttaatgtatcaacatacgaccaggaccgacccctagctctaatctatgctcgctactccgtaggtttgacgtaaaggtcgggtacccagtcggtaggttcaggtgacgtaggngagtcgtgggacagtacgttcactctacacctatactagtaactctagactaacggtagaagttatttcgacttaacttagttactacgttaacaactagtaactaatacgttcgtttaccgaacgtaacggacctaacgtaacgtaaacttaaaacgttaaacgaacgttacgtacgtctaccgacgtaaccttacgtacgtttcgtacttacctactttacccgttcccgtacttacttcgtacgttaac

SEQ ID NO: 142248 - DNA, 657 bp, Homo sapiens
  misc_feature: GYAE6OF02JD34C.46.67.G01.1.454.CMB.1.raw
  modified_base (288)..(288): a, c, t, g, unknown or other
  misc_feature (288)..(288): n is a, c, g, or t
  modified_base (646)..(646): a, c, t, g, unknown or other
  misc_feature (646)..(646): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctcctgtctgcaaccgtgggagacagtgtcaccatcacttgccgggcaagtcggaacattgacactatttaatggtatcaacatagaccgagggaccgtccctaagctcctaatctangctgcactcctagtttgacgtaaggtcgggtacccagtacggtacgtttacgaggtcggacgtaggtggtaagttcggtacgggaatacggtacgtttacaccgttactaccgtaacctagttaccgtaagtaactcgtacggtacaacggttagtaagttacgttttacggaacttaaaccgtttaactttacgtacgttaacctaaacgtaaagttaaactttaacttaagtttcggtttaaccggaccgtaagggtaaccgtaaccgtaactaaacgttaaacgttaaacgtaacgttgacggtacgtacgaaccgtactaacgtcttacgtacgttactacctccgttacccgntactctatacg

SEQ ID NO: 142249 - DNA, 634 bp, Homo sapiens
  misc_feature: GYAE6OF02HPOHE.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccggtggganaaagtgtcaccatcacttggcccggacaaggtcggaactattcgacctaccttaatttaaattggtatcaatatacgaccagggacggcccctaagcctcctaatctatgctgctactccagtttgacgtaaggtcgggtacccagtcggtaggttcgagtggcgagtggatcgtgggactagtattcactctcactagtacagtaactctagactaacgtagtaattatttagacttaactttagttacgtagttaacctaaacgtagtttaaacttaacgtaacgtttacggtttaccggaaccgttaaacgggacctaacgtaaccttaaacgtaaacttaaaccgtacgtacgttacgtcgtaccgacgtaccgtagtaccttacgttactttcgtaacttcccgttaccgtaccctacgttacctagtacgttaccg

SEQ ID NO: 142250 - DNA, 697 bp, Homo sapiens
  misc_feature: GYAE6OF02HALBK.46.67.G01.1.454.CMB.1.raw
  modified_base (97)..(97): a, c, t, g, unknown or other
  misc_feature (97)..(97): n is a, c, g, or t
  modified_base (193)..(193): a, c, t, g, unknown or other
  misc_feature (193)..(193): n is a, c, g, or t
  modified_base (217)..(217): a, c, t, g, unknown or other
  misc_feature (217)..(217): n is a, c, g, or t
  modified_base (228)..(228): a, c, t, g, unknown or other
  misc_feature (228)..(228): n is a, c, g, or t
  modified_base (263)..(263): a, c, t, g, unknown or other
  misc_feature (263)..(263): n is a, c, g, or t
tcagactagcagtacacgaccggtgctcgatttagagtatacatattgggtttggggagtctcggtcaggacacagcatggacatgagggtccccgntcagctcctggggctcctgctactctggctccgaggtgccagatgtgacatcgagctgacccagtctccatcctccctgtctgcgaaccgtggganacagtgtcacatcacttgccgganaagtcggaacngttcgaactaccttaatttaaacgttggtatcaanatacgaccgacgggtaccggaccccgtaagtccttaccgtaaacgttctaacgtgtaccttacgctaacgtacctaggtttcgaacgaaagggttcggggtccctagtccggtaggtttaccgtaggtcggagtacgggtggtactcggtacgggaactaggtaacttttcgaaccttcgtacctaccgtacttcctaagttaactccgtaggaccgtaaacgtagtaaggttactttacgacttaactttattaccgttactacaactaagtaaacttaacgtagtttcgtttaaccgggacgtaacgggtaacctaaccgtaaccttaaacgtaaacgttaaacgtaagtcgtacgtctacgaccgttaacacgttctacgttaccttacctacgtttacccgttcccgtaccttacttccgtaacgttacg

SEQ ID NO: 142251 - DNA, 641 bp, Homo sapiens
  misc_feature: GYAE6OF02G3B7M.46.67.G01.1.454.CMB.1.raw
  modified_base (320)..(320): a, c, t, g, unknown or other
  misc_feature (320)..(320): n is a, c, g, or t
  modified_base (400)..(400): a, c, t, g, unknown or other
  misc_feature (400)..(400): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggtagtcgggcccacgactggtgaggccttcggagaccctgtccctcacctgcgctgtcgtctggtgccctccatcagtagtggtttctcgtggggctgggtccgcagctccgagggagggctggaatacgtagttggaagtgtctctcagtacgtggaggttcctaattacgnggttccgtctctacgaagtagtcgagtccaacgatatctcgtgactacgtcagtactaatcgtacgttttcccagaacgntaggtaacgtttctggtacgacccggccgtacgtacgacgtaccggttcgtttacgtacgtgttgacgtagtagacgtcttattacgttagttacttttagggagtttagttaacgtttacgaacgtacctaagtacgtaccggtacggggtcctaccggtacccgggtacgggaccgtaagggtaactaccggttcggtaccgtccgttacccgttaccgttaccggtaccctaacccgg

SEQ ID NO: 142252 - DNA, 865 bp, Homo sapiens
  misc_feature: GYAE6OF02JW4LS.46.67.G01.1.454.CMB.1.raw
  modified_base (172)..(172): a, c, t, g, unknown or other
  misc_feature (172)..(172): n is a, c, g, or t
  modified_base (212)..(212): a, c, t, g, unknown or other
  misc_feature (212)..(212): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagaccctgtccctcacctgcgctgtctctggtncctccatcagtagtgtttcttcgtggggctggggtccgcngcctccgagggagggctggatacagttggaagtcgtctctctataggtggtacggttcctattacgacgtccgtcttcctacgaagtcggtacgacgtccaaccgtatacttccgtacgttacggacctaccggtccacgtcctaaacttccttaacggtttttcccccaggtaaaacgtgttaggtacttttacgtcggtaccggacccggtcccgtccgttaggaacccggtaaccgggggtttacttttaacgttaccgttgggtcgtaccggtaaggtacggtaacccggttactttaacgtttaagttcggttttaggttttacgggtaggttttacggttttacgtttacccgtaaccgttaaaccgttacgtaacgggttaccggggtacccggggttaccgttaccccgggtacccgggttaccgggggtacccgtaaaggggtttaaccgttaccgggttaccgggttaaccccgtacccgggtttaccgttaccccgtttaaccggtacccccgttacccggaaccccgggtaccgggtaccccttaccgggttccccgggtttaaccccccctttcccccgggtacgggtacccccttaacccccggttcccctaacccggttacaacccggttacccccgg

SEQ ID NO: 142253 - DNA, 571 bp, Homo sapiens
  misc_feature: GYAE6OF02GAP2L.46.67.G01.1.454.CMB.1.raw
  modified_base (437)..(437): a, c, t, g, unknown or other
  misc_feature (437)..(437): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtgtttctctggggctgggtccgcagctccgagggagggctggaatacattggaagtgtctctcatagtggaggttcctattacagtccgtctctcaagagtcgagtcactatatctctggacacgtccagcaatctacgttttccctgaagtatgagttctgtcgaccgcgtctgacgtacgggtcgtttattacgtgtgcgagacgacggtntattatgtagttttggagttggttattcgtactaccgtagacgtcggacggggcctaccggtcccggtggggtaccgaagggtaacttacggtacggttccgtacccgttccttaccgttacgcccgtaacccg

SEQ ID NO: 142254 - DNA, 753 bp, Homo sapiens
  misc_feature: GYAE6OF02HOQKN.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctcgccaaccggtgggacgtacagtgtccacctatcacttcggccgggtacaagtcggaaacattgaacctactaactttaaagttggttactaccgtaactaaagtacgaaccgtagggaacccggtaccccgtaaggtacctaccgtaaatcctaagtcgtactgtaccaactccgtacgtttcgacgtaaacggtcgggtacccagtcggtaacgttcgtaacggtggtctaggtggtaagtcgtacggggaactagtacgttacgtacttccgtaacttacccgagtacctaaacggttaactcttacggaaccgtttaacgggagttaacgttaattttccggaaactttaaccgtttaaatttaccgaacgtttacccaaagtaacgttaaactttaaactaacggtttacgttttaccggaccgtaaagggtacctaacctaacgttaaacaaaacgtttaaacgaaacgttcggacgtagttaccgaacgtaaccctaattccgttacgttaccgttagtaacccttacccggtttaccacccggtttacttaccgtacggtttaacc

SEQ ID NO: 142255 - DNA, 595 bp, Homo sapiens
  misc_feature: GYAE6OF02G4FA6.46.67.G01.1.454.CMB.1.raw
  modified_base (211)..(211): a, c, t, g, unknown or other
  misc_feature (211)..(211): n is a, c, g, or t
  modified_base (248)..(248): a, c, t, g, unknown or other
  misc_feature (248)..(248): n is a, c, g, or t
  modified_base (326)..(326): a, c, t, g, unknown or other
  misc_feature (326)..(326): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtncctcatcagtgtggtttctcgtggggctgggtccggnagctccgagggaagggctggaatacgattggaagtgtctctcatagtggaggttcctattacagtccgtctctcaagngtcgagtcaccatatctctggacacgtccagcaatctacgttttcccagtaagtatagacgtttctggtacgcccgccgtctgaccgacgggtcgttttagttaccgtgttcggcgtacgacggacggtcttattacgtgttagtttttgggagttggtttatttacgacctaccgtagtacgtccgggacggggtcctaccggacccggtggggaccgtaagggtaactacgtcggtccgtaccgttcctccgttacgccctaacccg

SEQ ID NO: 142256 - DNA, 679 bp, Homo sapiens
  misc_feature: GYAE6OF02GJLYV.46.67.G01.1.454.CMB.1.raw
tcagactagcagtacacgaccggtgctcgatttagagtatacatattgggtttgggggagtctcggtcgaggacacagcatggacatcgagggtccccgctcagcctcctggggctcctgctactcgtggctccgaggtgccagatgtgacatcgagcctgacccagtcctccatccctcccgtgtcctgcaaccgtgggagacagtgtcaccatcacttgccgggcaaggtcggaacattgacacctatttaaattggtatcaacatagaccagggacgcccctaagctactaatctatgctgctatccgtagtttgacaaggtcgggtacccagtccgtaggttaccagggtcggctaggtggacttcgtgggactagtatttccgattcgtacacgtactctaagttactcgtacgactaacggtcgaaagttcgtttacgacgttaactttaacgttacgttacgtaacctaaacgtacgttaaacgttacgtaaccgtttaagttttccgggtttacccggaaaccggtaacgggtaaccgaaccgttaaacttaaacgttaaaacgtttaaaacggtacgttagggtacggacgttacgaacctaaccgttacgtaccgttacgtttacttaccgttaccttacccgttaccccgaccttacgtccgttaacg

SEQ ID NO: 142257 - DNA, 614 bp, Homo sapiens
  misc_feature: GYAE6OF02F1RJ7.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctcgtggtcgcctccatcagtagttggtttcttcgtggggctggggtccggcagcctccgagggaacgggctggaatacagttggaagtgtctcgtcatagtggtaggttcctattacagtccgtctctacaagcgtcgacgtcacatactctcgtgacacgtccagtacaatcgtacgttttcccagaatatgtagttcgtgtcgaccgcgcgtcgacgacggttcgtttatacgtggtcgacgaggtacgtacggcttaagttcttagttagtttttggacgttagttaattttacgttactacctaccgttagacgttcgggaccgggtcgtcccggtaacccggtcgggtaccgtaacgggtacttacggtcggtacccgtaccgtccttaccgttacctaccccgg

SEQ ID NO: 142258 - DNA, 880 bp, Homo sapiens
  misc_feature: GYAE6OF02HCOPY.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctcgcaaccggtggagacagtgtccaccatccacgttcggcccgggacaaacggtacggaaactacgtttcgaacctaacccgtttaattttaaaacgtttacgggtaacttaacctaaacctaagttaaacggaacccggaacggggaacccgggtaaccccccgttaaacggtacccttaacccgttaaacttaccgttaacttcggcctacggtacctacttacccgttaaggttttacggaaccgtaaacgggttaccgggggtacccctacgttaccgggtaagggtttccgtaaggttcgggacgtagggttacgggtagttcggtacggggaactacggttactttaccgtaccttcccgtacctaaccaacgtacgtaacggttaactcgtacaaccggtaacggtataagttagttttccgaacttaactttacgttacttcgtaacctaaagtaagttaaattacttaacggtttcgggtttaacccgaccgggtaaacgtaccgtaaacgtaaccgtttaaaaacgtaaaacgttaaaaccggttacgttaacggggtcggttaccttaaccggaaacccgttccccgttaaacgtttccggtttaaccgtttaacccgtttaccctttaacccgtttacccccggtttaccccgacgtttttaacccggtacccgtttacgttaaacccgg

SEQ ID NO: 142259 - DNA, 634 bp, Homo sapiens
  misc_feature: GYAE6OF02GENI2.46.67.G01.1.454.CMB.1.raw
  modified_base (467)..(467): a, c, t, g, unknown or other
  misc_feature (467)..(467): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtcctccatccctccctgtctgcaaccggtgggacacagtgtcaccatcacgttgccgggacaagtcgaactattacgacctaaccttaatttaattggtatacaaactatacgaccgagggaccgacccctaagcctaccgtaatactactcgtctgcctactaccgtagtttcgaactaaacgggtcgggtacccagtcggtaggttcaggttcgacgtagtggtactcggtagggactagtacgttaccacgtcctaccgacctatacgaagttaatccgttagaccgtaacgtagtaagttntttacgacttaaaccttagttacgtgtaactaactaagttaacttacgagtttcgttaccgacgtaaggtaccgataactaaataaacttaaacgtacgtggtacgactagaacccgtactattccgtattaccttactaacgttccctacccgctaatcgtatacg

SEQ ID NO: 142260 - DNA, 714 bp, Homo sapiens
  misc_feature: GYAE6OF02JM4AY.46.67.G01.1.454.CMB.1.raw
  modified_base (138)..(138): a, c, t, g, unknown or other
  misc_feature (138)..(138): n is a, c, g, or t
  modified_base (217)..(217): a, c, t, g, unknown or other
  misc_feature (217)..(217): n is a, c, g, or t
  modified_base (268)..(268): a, c, t, g, unknown or other
  misc_feature (268)..(268): n is a, c, g, or t
  modified_base (354)..(354): a, c, t, g, unknown or other
  misc_feature (354)..(354): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtncgaactgcaggagtcgggcccacgactggtgacggtccttcgggagaccctggtacccctcaccgtggccgcttgtccncgttgggcaccctccatcgagttaggttcgttctcgtgggctggggtccgnagcctccggtagggagggctggaatacgtacgtaggagtgtctctcattagtcgggtaggttctaagttacgagtccgtctacgtnaacgtagtccgtagtccaaccagttatcgacgttcggaactacgtccaacgctaactcgtaactttttacccagggaaacctagtacgtacgtttacgtagtcggtaacccgccggtactaccggaacggtaccgggttacgttttaactaagttcgtacgtaccggaaggtaaccggtacggtaacgttatttaacgttagttagtttagggttacgttagggtttaagtttttaccgacgtaaacccggttactaacgggtcgggtaaccgggtacggcccggttaacccggtccgggaacggttacgggaaattacgccggtacggtcccgttactccgtaccggtccctaacccgg

SEQ ID NO: 142261 - DNA, 597 bp, Homo sapiens
  misc_feature: GYAE6OF02GS3H5.46.67.G01.1.454.CMB.1.raw
  modified_base (231)..(231): a, c, t, g, unknown or other
  misc_feature (231)..(231): n is a, c, g, or t
  modified_base (408)..(408): a, c, t, g, unknown or other
  misc_feature (408)..(408): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttggccgggcaagtcggaacntgacactattaattgtatcaacatagaccagggaccgcccctaagctacctaatctatgctgcatcctagtttgacgaaggtcgggtcccagtcgaggttcaggtcggacaggtggatcgtgggacagtatttcactctcacctatctaagtactcgtagacgtaacgtgaaagttnttttacgacttaactttattacttcgtactaactaagtaattactaagtttacgtttacggaaccgtaacggactaacgtaactaactaaaagttaaacgaacgttggtcgtactacgaccgtaactacgtttcgtacgttaccgttactactttccccgttacccgtacctacgttcctagttaaccg

SEQ ID NO: 142262 - DNA, 554 bp, Homo sapiens
  misc_feature: GYAE6OF02FZRBD.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccggaggtgccagatgtgacatcgagctgacccagtctccatcctccctgtctgcaaccgtgggagacagtgtcaccatcacttggccgggacaaggtcggaacattgacaccttaatttaaattggtatcaacatagaccagggaccggacccctaagcctacctaatctatgctgcactcctagtttgactaaaggtcggggtcccagtcgtaggttcagtggcagtgatcgtggacagtactttcactctccacactacagtaatctagacaacgtgaagttagtttgacttaaacttattacttgtacaacgtaagtaattacgtaattcgttttacggacgtaacggaacaacgtactaactaaactaaacgaatcgagctgacactatctgttcttacacttcctacccgctactctgtac

SEQ ID NO: 142263 - DNA, 816 bp, Homo sapiens
  misc_feature: GYAE6OF02IFD8R.46.67.G01.1.454.CMB.1.raw
  modified_base (276)..(276): a, c, t, g, unknown or other
  misc_feature (276)..(276): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggcctttcggagaccctgtccctcacctgcgctgtctctggtcgcctccatcagtagtggtttctcgtgggctgggtccgcagcctccgagggacgggctaggaatacagttggaagtgtctctcagtagtggtacgttctattacngtccgtctctcaagtgtcgagtcacctattactctcgtcgactacgtccagactaattctaccgtttttcccagtaacgtagttacgtagtttcgtagtaccggacccgtcgtacgtacggtaccgtacgggtttcgttttacgttaccgtggttacggacggtaagtacgggtacccggtacttttaagttacgttaggtttaacggtttttagggacggttttacgggtttttaacgtttacccgggttaaacccttaccccgggttaaaggtaccggttaacccggggggtaccggggggttacccttaccccggggtaaccccgggttacggggggtaacccgtaaggggttaaacgttacccggttaccgggttaccccgtaccggttcccttaacccgggttaccgtacccccgttacccgtaaccgggtaacccgggtacccctaacgggttccccggttaccccgtttacccccggtcggtaccccttaccccccgttacccgtaacccgtaaccggacccgttacccccgg

SEQ ID NO: 142264 - DNA, 630 bp, Homo sapiens
  misc_feature: GYAE6OF02HAY88.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctcctgtctgcaaccggtgggagacagtcgtccaccatcacttcggccgggacaaggtcggaaactattgaactaccttaatttaaattggtatacaacatagaccgagggaccggacccctaagcctactaatctatgctgcactcctagtttgacgtaaaggtcgggtaccctagtcgtaggttcagtcggactaggtgactcgtagggactagtactttcaccttctaccaactactacgtaacgtaactcgtacgtacgtaacgtagtaagttagtttacgtactaagttaccccttatacggtaacctaagtaacgtaattaactaagtttcgtttaccgaacgtaagggtactaacgtaactaaacttaaactaaacgtaacgtcgtacgcgtacgtacgaactctacgtacttactacgtaccttaccggtacctaccgtacgtacgtatacg

SEQ ID NO: 142265 - DNA, 643 bp, Homo sapiens
  misc_feature: GYAE6OF02HKB3J.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttggccgggacaaggtacggaacattgacctacttaatttaaattgtatacaacatagacaggacgccctaagctactaatctatagctcgactatacctagtttcgacgtaaacgtcgggggtaccctaagtcggtaggttacgaggtggacgagtggattcgtagggactagtatttcacgttactcactactactaagtaacttcgagtactaacggtagtaaagtagttttagaaccgttaactttaattacgttacgtaacctaaactaaagtaaactttaactaatttacgtttacggaaccggtaagggaacaacgtaactaaaccgtaaaagttaaacgtaacgttaggtagacgtacgacgtaaccctagttactacgtacctttacgtaccttaccgttcccacttaaccgttactaggtaacc

SEQ ID NO: 142266 - DNA, 661 bp, Homo sapiens
  misc_feature: GYAE6OF02H0F8R.46.67.G01.1.454.CMB.1.raw
  modified_base (191)..(191): a, c, t, g, unknown or other
  misc_feature (191)..(191): n is a, c, g, or t
  modified_base (385)..(385): a, c, t, g, unknown or other
  misc_feature (385)..(385): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctccatcctccctgtctgcaaccgtggganacagtgtcaccatcacttgccggcaagtcggaacagttgacacttatttaatggtatacaacatagaccgagggaccgccctaagcctcctaatctatgctgctatcctagtttgacgtaaaggtcgggtaccctaagtcggtagttcaggtggacaggtggatgtcgggtacagtattcacttctccaacctntacagtttaactcgtacgacgtaacgttagtaagttacgttttacgacttaaacgtttatttaacgttctaacctaaacgtaacgttaaactttaacgtaagttttcggtttaccgggaacccgtaagggtaaccaaccgttaaactaaaaccgttaaaacgttaaaaccgtaacgttacgggtacgtacctacggtaccctaaacgttacctttacgttaccgttaccttacttaaccgttcccgtttaccccgaccttacttcgtacgtaaccg

SEQ ID NO: 142267 - DNA, 741 bp, Homo sapiens
  misc_feature: GYAE6OF02ICOHN.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtgggctgggtccgcagctccgagggagggctggaatacagttggaagtgtctctcagtagtggtacggttcctattacagtccgtctctcaagagtcgacgtcaccatactctctgacacgtcacgactaactctacgtttccgtagaacgtatagtacgttctggtacgacccgcgtctacggaacgtacgggttacgttttaacgttacgttggtcggacggaaggacggtacgggttacttaagtttacgtttaggtttacgtttttagggtacggtttaggttttaacgtttaccggtaacccgttacccgttaaggtaccgttaccggggaccggggtccgttacccggaccccggttcgggggacccgtaaaggggttaacgttaccggttaccggttacccgtacccgttaccgttacccgttacgtacccctacccgtaacccggtaaccgggtacccctacggttccccggtttccccgttacccccgttcggtcccctacccccgttaccccgtaccgtaaccggacgtaccccgg

SEQ ID NO: 142268 - DNA, 760 bp, Homo sapiens
  misc_feature: GYAE6OF02I6M03.46.67.G01.1.454.CMB.1.raw
  modified_base (193)..(193): a, c, t, g, unknown or other
  misc_feature (193)..(193): n is a, c, g, or t
  modified_base (230)..(230): a, c, t, g, unknown or other
  misc_feature (230)..(230): n is a, c, g, or t
  modified_base (348)..(348): a, c, t, g, unknown or other
  misc_feature (348)..(348): n is a, c, g, or t
tcagactagcagtacacgaccggtgctcgatttagagtatacatattgggtttggggagtctcggtcaggacacagcatggacatgagggtccccgctcagcctcctggggctcctgctactctggctccgaggtgccagatgtgacatcgagctgacccagtctccactcctcctgtctgacaacggtgganacagtgtccacatcacgttgccggacaagtcggaacnttagaccaacttaatttaacgtgtatacaacatacgacgtacgggaccgaccctaagcttacctaatcgtatggctagctaactccgtagtttcgaacgtaaacggttcgggtacccngtacgtacggttacacggttcgacgtaggtaggtactcggtaggaactagttattaccgctacctacacctatacttagtaacttcgacgtactaaaggtagtaagttacgtttaacacgtttaaaaccttttgtaaccgttactaaccgttaaacgtaatttaaacgttaacgttaacgggtttttaccgttaaccggtaaccgggtaaaccggaacccgttaaaacggttaaaccccttaaaaggtaaaacccgttttaaaaccgtaaacgggttcccgggtttaaggtccaaacccgttaaccggttaaccctaacggttttccctttaaacggttaccctttaccctttaacccggttaccccgttaacccccgtaacggtttaccttacccggttaacggtttaccg

SEQ ID NO: 142269 - DNA, 620 bp, Homo sapiens
  misc_feature: GYAE6OF02GT2IV.46.67.G01.1.454.CMB.1.raw
  modified_base (219)..(219): a, c, t, g, unknown or other
  misc_feature (219)..(219): n is a, c, g, or t
tcagactagcagtacacgaccggtgctcgatttagagtatacatattggggtttggggagtctcggtcaggacacagcatggacatgagggtccccgctcagctcctggggctcctgctactctggctccgaggtgccagatgtgacatcgagctgacccagtctccatcctccctgtctgcaaccggtggagacagtgtcaccatcacttggccgggnaagtcgaacatgacactattaaatgtatcaacatagaccagggaccgacccctaagctacctaatctatgctgcatccagtttcgactaaaggtcggggtacccagtcggtaggttcaggtggacgtaggtggtacgtcgtagggactaggtatttaccactactcacctatacaagttactacgtcgtactaacggtagtaagttatttacgactaactttaatttacctgtaactaactaagtaattaactaagttcggtttaccggaaccgtaagggtacaacgtaactaactaaaacgttaaacgaacttaggtacgtcgtaacgacctaacgtacttacgtacttacgttaccttaacgttcccttacccgtacccttacttaccggtacttaacg

SEQ ID NO: 142270 - DNA, 800 bp, Homo sapiens
  misc_feature: GYAE6OF02JFCN7.46.67.G01.1.454.CMB.1.raw
  modified_base (296)..(296): a, c, t, g, unknown or other
  misc_feature (296)..(296): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgagggaaggggctggaatacagttggaagtgtctactcatacggtggaggtttcctagttacagtccgtctctcaagngtcgagtcaccatactctcgtggacacgtccagtactaatcgtacgttttcccaggaatagtcgtacgttctaggtacgacccgtccgtcgtcgtaacgtccggggttcctttttaagtaaccgttggtacggacggtaacgggtaaggtacccggggtacttttaagtttacgttacgggtttaaggttttttacggggtacggttttagggtttttaaccgttttaccggtaacccgttaaccccggtttaagtaccgggtttaccggggaacccgggggttcctttaccccgggaccccgggttacggggacccgtaaaggggttaaccgttaccggttcgggttacccgttaacccggttcgtttaccccgttacgttaccccgtacccggtaaccggtaacccggggttaccctacgggtttccccggttaccccttttacccccgggcggtaccccgttaacccccttccggtacccgtaacggtcccttaaccccgg

SEQ ID NO: 142271 - DNA, 834 bp, Homo sapiens
  misc_feature: GYAE6OF02HE4PB.46.67.G01.1.454.CMB.1.raw
  modified_base (208)..(208): a, c, t, g, unknown or other
  misc_feature (208)..(208): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtgggctgggtccgnagctccgagggagggctggaatacagttggaagtgtctctcatagtggaggttcctattacagtccgtctctacaagagtcgagtcaccatatctctggacacgtccagcaatctacgttttccctgaacgtatgtaagttctgtcgacccgcgtctgacgacgggtcgttttattacgtggtcgacggaaggtacggacggtacgttaagtttaacgttaggtttagttttttacggggaggttttgggttttaacgttttaccggtaacccgtttaaccccgttaacggttaacgtttaccggggggtaacccggggggttcccggttaccccgggtacccccggggtttaccgggggggaccccgtaaagggggggttaaaccgtttaacccgggtttacggggtttaccccggttaaccccggtttacccgttttaccccggtttaacccggtcccccgtttaccccgaaaccccggggtaaacccggggtacccccgttaaaccggtttcccccggggtttacccccgtttttaccccccccgggtacccgggttccccccttaaccccccccgtttaccccgtacccccggtaaacccgggtacccggttaaccccccgg

SEQ ID NO: 142272 - DNA, 789 bp, Homo sapiens
  misc_feature: GYAE6OF02F9HD0.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccggcaagtcgaacattgacaccttattaatgtatcaacatagacaggacgcccctaagctctaatctatgctgcatccagtttgacaaagtgggtcccagtcgtaggtcagtggtcagtggatcgtagggactagtactttacacttcctaccacctactactaagttaactcgtacggacctaaacggttggaaagtttaacgtttttcgtaaccgttaaaacctttttaacgtttaacgttaccggtttaaccgtaaaaccgttaaacggttaaaacttttaaacccgttaaagttttttaccgggttttttaacccggggaaccccgttaaaaacggggggtaacccttaaacccggggttaaaacctttaaaaccgttaaaaaaaccgttttaaaaacccgggttaaaaccgtttagggtttaaccgggtaccgtttaccgtaaaccccgtaaccccgttaactttacccggttttaccgtttaacccgttttaacccgttaacccgttttacccccggtttaccccccgtaacccgtttaacccgttttaccgttaccgggttttaaaaccc

SEQ ID NO: 142273 - DNA, 646 bp, Homo sapiens
  misc_feature: GYAE6OF02IW89G.46.67.G01.1.454.CMB.1.raw
tcagactagcagtacacgaccggtgctcgatttagagtatacatattgggtttggggagtctcggtcaggacacagcatggacatgagggtccccgctcagctccgtggggctcctgctactctggctccgaggtgccagatgtgacatcgagctgacccagtctccatcctccctgtctgcaccggtgggagacagtcgtccaccatcgacttcggccgggacaacggtccggaatagttcgaactaccttagtttaagttggtatacaacagtacgaccgacgggaccgtacccctaagtactacctaatcgttatcgctgactatccgtagtttacgaacgtaacggtcgggtccagtcggtagttcgaggtcggataggtagactacggtgggaacagttactttacgacgttcctacctaaccgtactacgtacgtaactcgtagacctaaggtacgtaagttacgtttacgacgttaacttacttactaggtaccaactaagtattaactagtttacgttaccggacgtaacggtactaacgtaaccttaaagtaaactaacgtaactggttagacctacgtaccgtaactacgttctaacgttcctacgtactaccgttcccgacttacgtctaaggtc

SEQ ID NO: 142274 - DNA, 712 bp, Homo sapiens
  misc_feature: GYAE6OF02J0V5U.46.67.G01.1.454.CMB.1.raw
  modified_base (193)..(193): a, c, t, g, unknown or other
  misc_feature (193)..(193): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgccaaccgtggganacagtgtcacatcacttggccgggcaagtcggaacagttgacacttaatttaaattcggtatcaacatagacacgggacggccctaagctcctactatatgcttgacactccgtagtttcgataaacggttgggtacccagtcgacggttcgaacggttggcgtagtcggataccgtgggacgtaaggtatttaccaacggggttctccgtaacccactttacgaaccgttaaagttccgttacgtacgtaacccggtaggtaaaacgtttacgttttacggtaactaaaccgtttatttaaccgttacgttacgtaaaccgtaagtaaactttaacgtaacttttacgggtttcccggaaccgtaaggtaaaccgacggttaaccttaaacgtaaagttaaaacgtacgtaaggtacggtaccgttaggtacccgaaccgttaacggttaccttcggtttaccgtttacccgttacgttaccccttacccggtcctaacctttacgcgtttaaacccg

SEQ ID NO: 142275 - DNA, 568 bp, Homo sapiens
  misc_feature: GYAE6OF02F40T7.46.67.G01.1.454.CMB.1.raw
  modified_base (211)..(211): a, c, t, g, unknown or other
  misc_feature (211)..(211): n is a, c, g, or t
  modified_base (339)..(339): a, c, t, g, unknown or other
  misc_feature (339)..(339): n is a, c, g, or t
  modified_base (406)..(406): a, c, t, g, unknown or other
  misc_feature (406)..(406): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtccctcacctgcgctgtctctggtgcctccatcagtagtggtttcttcgtgggctgggtccggnagctcccaggggaagggctggaatacagttgggaagttgtctctcaatagtggaggttcctattacagtccgtctctcaagagtcgagtcaccatatctctggacacgtccagcaatcagttttcccngaagatgagttctgtgaccgccgctgacacggggtcttttacttacgtgtgcgagagacggctattntgtattttggtagttaggttatttcgtactacccttagactcgggacggggctccgtcccgtacggggccgaagggatacgtggtcacgtctccgtagcctccaccgaacggcccagtccggtccttccccgtggccctacccctcctacccaagctacccg

SEQ ID NO: 142276 - DNA, 659 bp, Homo sapiens
  misc_feature: GYAE6OF02GX8SR.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgccaaccggtgggagacagtgtccaccatcacgttcggccgggacaaggtccggaacagttacgaccaccttaattttaaaagttggtaatacaaacataacgaccgaagggaccggcccctaagcctacctaatctatgctgcactcctagtttgacgtaaaggtcgggtaccctagtcgtaggttcgagtcggcgaggtggtacgtcgtaggggactagtactttcacttctacacctatacgtagtaactcgtagacgtaacgtgtaaagttctttacgacttaactttacttaagttgtaacctaaactagtaaacttaacgtaagtttacggtttaccggaacggtaacgggtaactaaccgtaacttaaactaaaagttaaaccgaagttcggtcgtactacgaccctaacgtacgttacgtaccgttaccttactaccgtttcccgttacccgacgttacttcggtataaccg

SEQ ID NO: 142277 - DNA, 628 bp, Homo sapiens
  misc_feature: GYAE6OF02HKUMH.46.67.G01.1.454.CMB.1.raw
  modified_base (257)..(257): a, c, t, g, unknown or other
  misc_feature (257)..(257): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacgttcgccggacaagtcggaacattgacacttatttaaattggtatcaanatagaccgagggaccggcccctaagcctacctaatcctagtgctgcactcctagtttcgacgtaaagggtcgggtacccagtcggaggtttcgaggtggactagggtagtacgtcgtgggaacagtactttacactcctacaccagtactaagtatcgtcgaacgtaacggtagaagttacttttgaacttaattagttactataacaactaagtaacttacgtaagttacggtttaccggaaccgtaaaggtacccaacgtaactaaacgtaaacgttaaacgaacgttagtcggtctacgaccctaactagttaccttagtacctttacttaccttacccgttacccgacttacgtacgttacgtaacg

SEQ ID NO: 142278 - DNA, 749 bp, Homo sapiens
  misc_feature: GYAE6OF02IW4C3.46.67.G01.1.454.CMB.1.raw
  modified_base (191)..(191): a, c, t, g, unknown or other
  misc_feature (191)..(191): n is a, c, g, or t
  modified_base (202)..(202): a, c, t, g, unknown or other
  misc_feature (202)..(202): n is a, c, g, or t
  modified_base (225)..(225): a, c, t, g, unknown or other
  misc_feature (225)..(225): n is a, c, g, or t
  modified_base (723)..(723): a, c, t, g, unknown or other
  misc_feature (723)..(723): n is a, c, g, or t
tcagactagcagtacacgaccggtgctcgatttagagtatacatattgggtttgggggagtctcggtcaggacacagcatggacatgaggtcccgctcagctcctggggctcctgctactctggctccgaggtgccagatgtgacatcgagctgacccagtctccagtcctcctgtctgcaaccgtggganacagtgtcacntcacttgccggcaagtcggaacngttcgacgacctattaaacttgtatacgaactatacgacctagggacgtcccctaagctacctaacgtctaagtcggtcctaggtcaacgtccgtaacgtttacgacgtaaaggtccgggggttaccccaagttaccgggtaggttaccaaggttggacctagggtggtaacttcgtacggggtaacctaggttagttacctacttaccgtcgtaaacccagtttcaacggttaaccgttccgtcggtaaaccgtaacggttagttaaacgttacgttttacggtaaccttaaacggtttaactttacgttacggttaaccaaacgtaacggtaacctttagaaaccgtttcggtttacccggaacgtaacgggtaaacaccgtaaccgtaaacgttaaaacgtttaaacccggtaagttacgggttagacccgttaaggtacccgtaaccgtaacgttcgtaacggttacttaccgtaacgtttcccggtttacccnccgtttaactaccggtaccgttaacg

SEQ ID NO: 142279 - DNA, 632 bp, Homo sapiens
  misc_feature: GYAE6OF02GYZ7V.46.67.G01.1.454.CMB.1.raw
  modified_base (292)..(292): a, c, t, g, unknown or other
  misc_feature (292)..(292): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccggcagctcccgaggggaagggctaggaatacagttggaagtgtctctcatagtggaggttcctattacagtccgtctctcaagngtcgagtcacatatctctggacacgtcagcaatctagttttccagaacgatgagttctgtgaccgccgctgacgacgggtcgtttaattacgtggtcgcgagaggacggtctattatagttagttttaggagttaggttagtttcgactacccgttagacgtcgggaccggggtctacccggacccgtcggggcccgaggggtaacttacggtcgggtacctacccggtcgttcccgttacgtcccttacccgaccgtaacgggccctacggttcccggttacccttccccggtacgtcccgtaaccccttcccgtacccgtaacggtccgtaaccccgg

SEQ ID NO: 142280 - DNA, 624 bp, Homo sapiens
  misc_feature: GYAE6OF02FMBQ2.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagacccctgtccctcacctgcgctgtctctggtcgcctccatcagtagttgtttctcgtggggctggggtccgcagcctccgagggagggctaggaatacagttggaagtgtcgtctctagtagtggaggttcctattacagttccgtctctcgaagagtcgagtcaccatctctctggacacgtcagcaactctacgttttcccagaagtatgtacgtttcgtggtcgacccgtccgtcgtacgaccgtacgggttactttacgttacgttggtcgacggaggacggtacgtacttaagtttagttagttagttttttcgggagtttggtttactttcggacctacccgtagtacgtcggcggggtcctcccggtacccggtgggtacccgaagggtaacgtacgttcggtaccgtacccgttccgtaccgttacgccctacccg

SEQ ID NO: 142281 - DNA, 599 bp, Homo sapiens
  misc_feature: GYAE6OF02HIHCS.46.67.G01.1.454.CMB.1.raw
  modified_base (288)..(288): a, c, t, g, unknown or other
  misc_feature (288)..(288): n is a, c, g, or t
  modified_base (339)..(339): a, c, t, g, unknown or other
  misc_feature (339)..(339): n is a, c, g, or t
  modified_base (368)..(368): a, c, t, g, unknown or other
  misc_feature (368)..(368): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgaccacctatttaaattggtatcaacatagacagggacgcccctaagctctaatctangctgcatcagtttgctaagtcgggtccatcgaggttcagtgcagtgatcgnggacagtattcactctcacatcagtactntcgactaacgtagtaagtatttacgactaactttattacttagtacaacgtaagtaattactaagtttcgtttacggaccgtaaagggtactaacgtaacctaaacgtaaaacgtttaaaccgaacgttagggtacggtacttcgaaccctaaccgtaactttaccgttacgtttcctaccttaacgtttccccgtaccccggttacctaccgtttacgtagtttaacccg

SEQ ID NO: 142282 - DNA, 677 bp, Homo sapiens
  misc_feature: GYAE6OF02F6EX7.46.67.G01.1.454.CMB.1.raw
  modified_base (329)..(329): a, c, t, g, unknown or other
  misc_feature (329)..(329): n is a, c, g, or t
  modified_base (502)..(502): a, c, t, g, unknown or other
  misc_feature (502)..(502): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggtccttcggagaccctgtccctcacctgcgctgtctctggtgacctcatcagtagttggtttcctcgtggggcctggggtccgcagcctccgaggggagggctaggaatacgattggaagtgtcctcgtcgtagtcggtggtacggttcctaagttacncgtccgtctctgaagcgtcgagtcacatactctcgtcggactaccgtacagactaactcgtaacgttttcccaggtaagtagtagtacgttcctaggtcgtccccgtccgtcgtacgaccggttaccggggttacctttagttcgttcgtggacggtacggtacggtacggtntttagttagttgttaggtttttacggtgtttacggttatttaccgaccttaccggtagtacgtaccggggagggttaccctaccggcccgggtacgggtaccggtaacgggtaacgtttacggtcggttacccgttaccggttccctacccggttaccgtccccgtaacccccgg

SEQ ID NO: 142283 - DNA, 712 bp, Homo sapiens
  misc_feature: GYAE6OF02H0YQ6.46.67.G01.1.454.CMB.1.raw
  modified_base (170)..(170): a, c, t, g, unknown or other
  misc_feature (170)..(170): n is a, c, g, or t
  modified_base (205)..(205): a, c, t, g, unknown or other
  misc_feature (205)..(205): n is a, c, g, or t
tcagactagcagtacacgaccggtgctcgatttagagtatacatattgggtttgtcctcctgctggtggcagctcccagatgggtcctgtccctggtgcaactgcaggagtcgggccacgactggtgaggccttcggagaccctgtccctcacctgcgctgtctctggtncctccatcagtgtggttcttgtgggctgggtccgnacgctccgagggagggctaggaactacgagttggaagtgtctctcgagtaggtggtacggttccttaattacagttccgtctctacgaagtacgtcgagtcaccgatacttctacgcgaaccacgtcagactaactcttacgttcccaggaacttagagttgttacctgggttaccgcccgtaccgtacgtacggtacccggtaacggggtttcttttaaacgtttcgtggtacggtaccggtaaggtaacggtacgtaatttaacggttaagttacggttttaaggttttggaggtttacggttttagttaccgtaacctaaccgttagtcggtaccgggacgggtccgtaccggtacccggtaggggaccggtaaggtaacttacggtacgttacccgtacgttccttaccgttacgacccgtaccgacccggaaccgggtcctaacgttcccggttccctaaccccggtcgtaccctacccgtcctaacggacgccctaaccgg

SEQ ID NO: 142284 - DNA, 721 bp, Homo sapiens
  misc_feature: GYAE6OF02IZSGZ.46.67.G01.1.454.CMB.1.raw
  modified_base (172)..(172): a, c, t, g, unknown or other
  misc_feature (172)..(172): n is a, c, g, or t
  modified_base (210)..(210): a, c, t, g, unknown or other
  misc_feature (210)..(210): n is a, c, g, or t
  modified_base (639)..(639): a, c, t, g, unknown or other
  misc_feature (639)..(639): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgagggccttcgggacaccctgtccctcacctgcgctgtctctggncctcatcagtgtggtttctcgtggggctggggtccgancgcctaccgagggacggggtctagggaatacgtagttaggaagttcgtcctcgtataggttagtgggtaacgttcctaagttacgacgttccgtcctctacgaagacgtcacgttaccacgattactcgtgtacggacctaacgtccaagacctagtaccttaacgttttccgaaagaacggtattacggtacgttcgttacggcgtaacccgtcgtacgtacggaaccgttacggggtttcttttaaagttacgcgttggaacggaaggtaccgacggttatttagtacgtttggtttagtttacgggttacgttaggtttactacggacccttaccggtagacgtacggggttaccggcctttacccggccgggtacggacggtaaacggtacttacggtccgggacctccgtacccgttccgttanaccccgtactaaccgggacccggtcctcgttacccggtcccgttccgacgccccgtaccttcccgaacgaccggcctaccgg

SEQ ID NO: 142285 - DNA, 679 bp, Homo sapiens
  misc_feature: GYAE6OF02ICD5O.46.67.G01.1.454.CMB.1.raw
  modified_base (171)..(171): a, c, t, g, unknown or other
  misc_feature (171)..(171): n is a, c, g, or t
  modified_base (290)..(290): a, c, t, g, unknown or other
  misc_feature (290)..(290): n is a, c, g, or t
  modified_base (293)..(293): a, c, t, g, unknown or other
  misc_feature (293)..(293): n is a, c, g, or t
  modified_base (349)..(349): a, c, t, g, unknown or other
  misc_feature (349)..(349): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtncctccatcagtagttggtttcttcgtggggtcgtgggtccggcagcctccgaggggagggctaggaatacagttaggaagtgtctctcatagtggtagttcctatacagtcctctctanagngtcgagtcaccatatcgtctggacacgtcagacaagtcttacgtttcccagaagtntacgtcgttcgtgtcgaccgcgtcgcggtacgacggtacgttttatacgtggtcgacggtaagcggtacggtcttaatttagtgttagttttgggtagttaggtttacttacgacctaccgtagtacgtcgggaccggggtcctacccgggtacccggtacgggggtcctaaggggtaaaccgttcggttcggtacccgttaacccggttcccgttaccgttacccgcccgtaaccccgaccggaacccggtaccccgtacggttcccgttccccgtttacccccgcggttccctacccccgtcccgtaacccgaccggacctaccccgg

SEQ ID NO: 142286 - DNA, 743 bp, Homo sapiens
  misc_feature: GYAE6OF02JSTPZ.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactgggtgaggcctttcgggacgaccccgtgtcccctcaccctgccgcctgtcctctggtcgcctccatcagtagttggtttcttcgtgggctgggtccgcagctcccgagggacgggctcggaatacagttggaagtgtctctcattgtggtacgttctatacgagttccgtctcgtacgaagtcgtcgacgtccactatactctacgtcggaccacgtcgacgactaacgttcgtaccgtttacccagtaacgtacgtacggtacgttcgtaggttaccgacccggtaccgtcgtacggtaccggtcgggtttaccgttttagtacgtcggtacgcggtaggacggtacggtacgtttacgttacgttagtttaggttttacggtaggtttaggtttacgttacgtaccgtacgttaggtacggtacgggtaccggggtccgttaccggtacccgggtacgggtaccggtacgggtaacgttacggttaccggtaccgttaccgttcctaccggttaccgcccgttacccgaccggtaacccggtaccgttaccggttcccggttacccgttacccgtaccggtaccctaccccgttacccgaccggtacgtccgtaccg

SEQ ID NO: 142287 - DNA, 691 bp, Homo sapiens
  misc_feature: GYAE6OF02IO3OE.46.67.G01.1.454.CMB.1.raw
tcagactagcagtacacgaccggtgctcgatttagagtatacatattggggtttgggggagtctcggtcaggacacagaatggacatgagggtccccgctcagctcctgggggctcctgctactctggctccgaggtgccagatgtgacatcgagctgacccagtctccatccctccctgtctgcaaccgtgggagacagtgtcaccatcacttcggccgggacaagtcggaacattgactaccttaatttaaattggtaatacaacatacgaaccgagggaccggaccctaagctacctaatctatgctgcactcctagtttgacgaaaggtcggggtaccagttcggtaggttacgaggtcgggactacggtggtaacgttcggtacggggactagttaactttccgtacctccttaccaacctacttacgtaacgttactacgtcgaaccgtaaacgggttagtaaacgttagttttacgtaacttaaacttttaacgtttaacgttacgttaacctaaacgtaagttaaaactttaacgttaagtttcggttttaccggacgtaaacgggacctaaacgtaacctaaaactaaaacgtttaaacgacttaggtacgactacgtacctacctacttccttacgttacctacttacgtccttacccgtacctacttctacgtacgttac

SEQ ID NO: 142288 - DNA, 769 bp, Homo sapiens
  misc_feature: GYAE6OF02I135E.46.67.G01.1.454.CMB.1.raw
  modified_base (248)..(248): a, c, t, g, unknown or other
  misc_feature (248)..(248): n is a, c, g, or t
  modified_base (263)..(263): a, c, t, g, unknown or other
  misc_feature (263)..(263): n is a, c, g, or t
  modified_base (281)..(281): a, c, t, g, unknown or other
  misc_feature (281)..(281): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtcgcctccatcagtagtgtttctcgtgggctgggtccgnagctccgagggaggntggatacagttggaagtntctctcattagtggtacggttcctattacgacggtccgtctctacaagagtcgagtacacctataatctcgtagactaccgtcaagacgtaattaccttacgtttttaccccgagtaacgtagttacgtagttttccgtagttccggaacccgtcccggtactacggtaccgtaaccggggttaccgtttttaacttaaccgttgggttacgaccggtaacggtaacggtacgggtacctttaagtttagttacggtttaaggtttttttacgggaagggttttaggtttttaacgttttacccggtaaccgttaacccggttaagtaaccggttaccggggggtaccccggggggttccttaccccggggtaacccccgggtttggggggaccccggtaaaaggggttaaccgttaccgggttcgggttaacccggtaccccggtttccgttaaccccgtttaccggtacccccgttaacccccggg

SEQ ID NO: 142289 - DNA, 699 bp, Homo sapiens
  misc_feature: GYAE6OF02JPLOV.46.67.G01.1.454.CMB.1.raw
  modified_base (172)..(172): a, c, t, g, unknown or other
  misc_feature (172)..(172): n is a, c, g, or t
  modified_base (206)..(206): a, c, t, g, unknown or other
  misc_feature (206)..(206): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcncctcatcagtagtggttctcgtgggctggtccgnagcctaccgagggagggctaggaatacgtagttggaagtgtactctactagtacggtggtacggttaccttagttaactaggttcccgttctcctagaagtagtcgagttccactatactctcgtcgacacgtaccagctaactctacgttttccaaggatacgtgtagttcgtgtacgacccgtcgtcgtacgaccgtacgggttcttttaacgttacgtgtacggacgtacgtacgtacggtacttacgtttagtaggtttagttttagggagtttacggtttacgttcgtaacctaccggttagtaacgttcggggacgggtcctacccgggacccggtgggaccgtaagggtaccttacgggttacgtcccgtaaccggttccttaaccgttcgaccctaccggtaaaccgtccggtacctacggttccccgtcccttaacccggccgtaacccgtccccgtaccgtaccgaaccggtccgtaacccgg

SEQ ID NO: 142290 - DNA, 639 bp, Homo sapiens
  misc_feature: GYAE6OF02JUIS2.46.67.G01.1.454.CMB.1.raw
  modified_base (189)..(189): a, c, t, g, unknown or other
  misc_feature (189)..(189): n is a, c, g, or t
  modified_base (494)..(494): a, c, t, g, unknown or other
  misc_feature (494)..(494): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaccgtgganacagtcgtcaccatcacgttcggccgggactaaggtcggaactattacgaacctaaccttaatttaaacgttggtaataccaacgtagtaacgaaccgacgggaccgaccccttaagccttacctaatctagtgctgctacttccgtagttcgaacgtaagggtcggtacctagtcggtacggttcaggtcggataggtagagtcggtaggactagttacttccgactcaccacgtatacgtagtactcgtacgtacgtaacgttataggtttactttacgaactttattaacgtactacgtaanaacgtataacttacgtacgttcggttacgacgtaacggtactaacgtaactaaacgtaaacgtacgtagtcgtacgactcgtacgtacttattcgtacttactaccgttaccgttcccttaccgtactacgtttaccgagttacg

SEQ ID NO: 142291 - DNA, 654 bp, Homo sapiens
  misc_feature: GYAE6OF02IX3UH.46.67.G01.1.454.CMB.1.raw
  modified_base (450)..(450): a, c, t, g, unknown or other
  misc_feature (450)..(450): n is a, c, g, or t
  modified_base (464)..(464): a, c, t, g, unknown or other
  misc_feature (464)..(464): n is a, c, g, or t
  modified_base (478)..(478): a, c, t, g, unknown or other
  misc_feature (478)..(478): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggtccttcggacgaccctgtcccctcaccgtgcgctgtctcgtggtcgcctccatcagtagttggtttctcgtggggctcggggtccgcagcctcccggaggggaacgggctaggaacttacgattagggaagtcgttcctctcaagttacggtaggtacggtttcctaatttaccgacggttccgtctcctacgaaggtacgtcgagtaccaacctattacgtctcgtacggactaccgtcacgacaattcctacgtttcccaggaatgtacgagtttcncggtagaccctcgntcgacgtacgggtntttacgtagtcgtgacgagtacgcgtatagttatggtttacgtttaggtacgtttggtttaccttccgtaacctaccgttagaacgttccgggaccgggtctccccggacccgggttgggaccgtaaggtacgttaccgtcggccttacccggtcttacggttccgccctaacccg

SEQ ID NO: 142292 - DNA, 743 bp, Homo sapiens
  misc_feature: GYAE6OF02H3GKA.46.67.G01.1.454.CMB.1.raw
  modified_base (238)..(238): a, c, t, g, unknown or other
  misc_feature (238)..(238): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggcctttcggagacccctgtccctcacctgcgctgtctctggtgcctccatcagtagtggtttctcgtgggctgggtccgcagcctccgagggagggctaggaatacngttggagtgtctctcagtagtggtacgttcctattaccgagttccgtctctcgaagagtcgagtcacctatactctctcgactaccgtccagactaaattccttacgttttccccgaggtaagtacgttgtacgtttctacggtcggacccgtcccgtcgtacggaccgtacgggttaccgttttaagttacccgtgggtcgacggaacggtacggaccggtatttaagtttacggttagtttacgggttttttagggaggtttacgggttttaacttttaccggaacccgttaccgttacggtaacggttccgggacgggggtccctcccggtaaccccgggtaggggacccgtaacgggtaacgttaccgttcggtacccgtaccgttccgttcccgttacaccctcccgaaccggtaccggacccgtaccgtcccggtttaacccctcccccggtacgtcccccgtaccccttaccccgaaccgtaccggtaccgtaccccg

SEQ ID NO: 142293 - DNA, 754 bp, Homo sapiens
  misc_feature: GYAE6OF02FQIVP.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactgggtgagggtccttcgggacgaccctgtccctcacctgcgctgtctcgtggtcgcctccatcagtagttggttttcttcgtgggggctcgggggtccgcacgcctcccgaggggaagggctaggaatacagttagggaagttgtctctacgtagtaggtgggtaggttccttattacagtccgtctctcaagtagtcgagtcacatactctctggacacgtccagcaatctacgttttccctagaagtatagtacgttctggtcgaccggccgtacgtacgaccgacgggttcgttttaacttacgtgtacggacggagtacggaccgggtacttaagtttagtaggtttagttttgggtaggtttaggtttaactttccggtaacctaacccgtagtacggtacgggtaccgggggccgttcccggacccggtcgggggacccgtaagggggtaaacttaccggttcgggttaccctaccggtttccgttacccgtttacgtccccgttaacccgaacccggtaacccgggccccgttaacggttccccggttaccccgttttacccccgggtcccgtaccccgttacccccgttacccgttaccccgtaacggtacgtaaccccccgg

SEQ ID NO: 142294 - DNA, 679 bp, Homo sapiens
  misc_feature: GYAE6OF02F3SIC.46.67.G01.1.454.CMB.1.raw
  modified_base (191)..(191): a, c, t, g, unknown or other
  misc_feature (191)..(191): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtggganacagtgtcaccatcacttcgccgggacaaggtcggaacattacgactaccttaatttaagttggtatcaacatagaccagggaccggcccctaagcctacctaatctatgctgcatcctagtttgactaaaggtcgggtacccagtcggaggttcaggtggactaggtggatcgtagggactagtattcacttcacacctatactagttaactcgtacgacgtaacggtagtaacgttattttacgaccttaaacgtttatttacgtatacctaaagtaacgttaaactttaacgtaagtttacggttttaaccggaaccggtaacgggtaaccgtaaaccgttaaccgttaaaccgttaaaacgttaaacggtaaaccgttagggtaccggtacttacggaccgtaaccctactttaccggttacgtttacccttaccgttacctttccccgttacccgtaccctaacgtttccgtacgttaacccg

SEQ ID NO: 142295 - DNA, 661 bp, Homo sapiens
  misc_feature: GYAE6OF02HRG5B.46.67.G01.1.454.CMB.1.raw
  modified_base (100)..(100): a, c, t, g, unknown or other
  misc_feature (100)..(100): n is a, c, g, or t
  modified_base (195)..(195): a, c, t, g, unknown or other
  misc_feature (195)..(195): n is a, c, g, or t
  modified_base (222)..(222): a, c, t, g, unknown or other
  misc_feature (222)..(222): n is a, c, g, or t
  modified_base (267)..(267): a, c, t, g, unknown or other
  misc_feature (267)..(267): n is a, c, g, or t
  modified_base (373)..(373): a, c, t, g, unknown or other
  misc_feature (373)..(373): n is a, c, g, or t
tcagactagcagtacacgaccggtgctcgatttagagtatacatattggggtttgggggagtctcggtcaggacacagcatgggacatgagggtccccgntcagctcctggggctcctgctactctggctcgaggtgccagatgtgacatcgagtctgacccagttctccatcctcctgtctgcaaccgtggganacagtgtcaccatcacttggccgggtnaagtcggaactagttgacctacttaatttaaagttggtatacaanatacgaccgagggaccgcccctaagctacctaatcgtatcgctgactactacctagtttacgagtaaaggtccgggtacctagtacggtacgtttcgaggtgacgngtggatcggtaggtacagtactttccgacttcaccgaactatacgtattatcgtgaacgtaacgtgtaagttcgtttacgaacctttaagttacttacgtacgttaacgaacgttaagtaacttacgtaacgttttcggttaaccgaaccggtaacggaactacgtaaacgttaaactaaagttaaaccgaacttacggtcggaccgttacaccgtaaccttaacgttctacggtaacctttacgacctttcccggtaacccgtaccttacgttacccgtaagtaccg

SEQ ID NO: 142296 - DNA, 735 bp, Homo sapiens
  misc_feature: GYAE6OF02JSO5M.46.67.G01.1.454.CMB.1.raw
  modified_base (216)..(216): a, c, t, g, unknown or other
  misc_feature (216)..(216): n is a, c, g, or t
  modified_base (261)..(261): a, c, t, g, unknown or other
  misc_feature (261)..(261): n is a, c, g, or t
  modified_base (297)..(297): a, c, t, g, unknown or other
  misc_feature (297)..(297): n is a, c, g, or t
  modified_base (332)..(332): a, c, t, g, unknown or other
  misc_feature (332)..(332): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgacggccttcggagaccctgtccctcacctgccgtctgtctctggtacnccctccatcgagttagttcggtttctcgtggggctggggtaccgnagcctccgagggagggctggaatacgattcggagtntcgtctcatgtggacgttcctattacagttccgtntctacgaaggtctacgagtccaactagttactccgttacgtacggtactaccgtcaagtactaacttcgttacggttttaccccaggaacgactttaggtacgtttccgttcggtacaacccccgggtccgtagttacggaacccggtaggggttacttttttaacgaccggttcggttaacggacccgggtaagaccgggttacggtaacctttagttttaacgtggttttagtttttacgggagtttttcggtttaacttaaccgaccgttaaccggttagtacgggttacccggggagggttacccgtacccgggaacccgggttgggaacccggaggttaaaccgttccggttccggtacccgtaccgttccttccggtttaaccgcccccttaaccgg

SEQ ID NO: 142297 - DNA, 815 bp, Homo sapiens
  misc_feature: GYAE6OF02H1G35.46.67.G01.1.454.CMB.1.raw
  modified_base (175)..(175): a, c, t, g, unknown or other
  misc_feature (175)..(175): n is a, c, g, or t
  modified_base (249)..(249): a, c, t, g, unknown or other
  misc_feature (249)..(249): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgacggccttcgggagaccctgtccctcacctgccgctgtctctggtcncctcatcagtgtgttctgtgggctcgggtcgctagccgtaccgagggacggctaggatactagtaggatcgtcncgtcagtagtggacgttcctaatacagtccgtctctacgaagtgtacgtagtcaaccctagtatctcgtacggtaccaccgtaccgtagactaacgttcctaacgttttaccccgaggtaagtaacgtgtaacgttcgtcggtacgaaccgtccgtacgtacgtccgaacggggtttctttaacgttcgttaggacggtacggtaacgtacgggtacggttacgttaaagttacgttacggttttagttttaggggtaacggttttagggtttaactttaccgggaccttaacccggttaacggtccggttaaccggggtacggggtaaccgttccgggttaccccggtacggggtaaccggttaaaccggggtacgttaacgggttcgtaacccgtcccggttaccgttaacccgttaaccgttcccgtaaccccgtaccgggtaacccggggtcccccgttaaccggttcccccggggtttaacccctttccccccggttaccgggtaacccccttaccccggtacccccggtttaacccaccgggtaacccggttacccccgg

SEQ ID NO: 142298 - DNA, 678 bp, Homo sapiens
  misc_feature: GYAE6OF02H0U9M.46.67.G01.1.454.CMB.1.raw
tcagactagcagtacacgaccggtgctcgatttagagtatacatattgggtttggggagtctcggtcaggacacagcatggacatgagggtccccgctcagctccgtggggctcctgctactctggcctcgaggtgccagatgtgacatcgagctcgacccagtcctccactccctcctgtctgcctacggtggagacgagtcgtcacctatcacttcggccgggacaaggtcggaactagttagacctacttaatttaaacgttgtacttacaactaacgtaggaccgagggaccgtaccccgtaagcctacctatctatcgcttgctagtaccgtagtttgacgtaacgggttcggtaccctagtcggtaacgtgacggtgacgtagtgacgtgagggtaactaggttaccttcgtacgtacctctacacttacgtaagtacttccgtagaaccttaagggtactaagtttactttacgaacttaacgttttactaacgttacggtaaacccttaaagtaacctttaaacttaacgtacgttttacggttaccggacgtaaacggtcaaacgttaactaaactaaacgtaacgacgtacgtagtcgtaacggtcctaaacgtcgttactcgtttaaccttcgtaccgccttaccgtacgtcttacggtcctaacgg

SEQ ID NO: 142299 - DNA, 651 bp, Homo sapiens
  misc_feature: GYAE6OF02G5DJO.46.67.G01.1.454.CMB.1.raw
  modified_base (474)..(474): a, c, t, g, unknown or other
  misc_feature (474)..(474): n is a, c, g, or t
tcagactagcagtacacgaccggtgctcgatttagagtatacatattggggtttgggggagtctcggtcaggacacagcatggacatgagggtccccgctcagctcctggggctcctgctactctggctccgaggtgccagatgtgacatcgagctgacccagtctccatcctcctgtctgcaccggtgggagacagtgtcaccatcctacttcggccgggacaagtcggaacagttcgacctaccttaatttaaagttgtatacaactatacgaccgagggaccgacccctaagcctactaatctatcgctgcactcctagtttcgacgtaacggtcgggtacccagtcggtaggttcaggtggactaggtggtactcggtaggaactagttacttactacttccgtacaacccgtatacgtaagtaacttccgtagaacgtacggtataacgttatttcgaacttaactttntatacgtactaacgtattactaacgttagttcgtttaccggaacgtaaggacctaagtaaccttaaactaaaggttaaactacgtacgtcgacttacgaaccgtaccttaacttcgtttagtaccctttacgtacccgtttcccgttacccgacctttaacttccgtaacttaaccg

SEQ ID NO: 142300 - DNA, 703 bp, Homo sapiens
  misc_feature: GYAE6OF02GQ9PQ.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtgggagacagtgtcaccatcacttcggccgggacgaacggtcggaactattcgacctaaccttaatttaaagttggtattacaactataacgaccgagggaccgaccctaagcctactaatctatgctgctactcctaggtttgacgtaaagggttcgggtacccagttcggtacggttcgaggtcggacgtaggtacggattccggttagggactaaggttactttcgaacttctaccgaacctactttacgaaagttactaccgtgaacccggtaacgtttagtaaagtttacgttttacgacctttaaaacctttatttaccgttagttaaaccaacgttaaagttaaacttaacttaaagtttcggtttaaccggaacgtaaacgggtaactaaccgtaactaaaacttaaaacgttaaaccgtacgttacggtacggtactacgacctaacgtcgttaccgtaggtttaccttactcgtttaccccgttacccgactacttccgtattaaccg

SEQ ID NO: 142301 - DNA, 835 bp, Homo sapiens
  misc_feature: GYAE6OF02JK450.46.67.G01.1.454.CMB.1.raw
  modified_base (223)..(223): a, c, t, g, unknown or other
  misc_feature (223)..(223): n is a, c, g, or t
  modified_base (263)..(263): a, c, t, g, unknown or other
  misc_feature (263)..(263): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaacttgcaggagtcgggacccacgactggtgaggccttcgggacgaccctgtcccctcaccgtgcgtcttggtcctcgtggtcncctacatcagttagtggtttctcgtggggactgggtccgntagcctcccgagggaggggtctggaatacgagttgggaagtgttctctacgagttaggtggtaggttcctagttacacggttaccgttcgtctacgaagtacgtacgtacggttccacgtagtactcttcgtacggtaactaccggtcctaacggactaacgttacttaaccgtttttcccgaaggtaaacgacgtttagtaacgtttccgtggtttacggacccggtacccgtcgttaacgaccggtaacggggttccttttaacgttccgtaggttaccgtacggtacggtaacggtacgggttaccttaaggtttaactacggggttttaacgttttttacggggtaacgggttttacgggtttttacgttttaacccgaacccggtttaaacccgtttaagggttaaccgggttacccgggggtaccgggggttacccgtttaacccccgggggaaccccccgggggtaaggtaaaccggggttaaacctttaccgggtaccggtttcccggttaacccggttaccgtttacccgtttaacggcccccgttacccgtaaccccggggg

SEQ ID NO: 142302 - DNA, 564 bp, Homo sapiens
  misc_feature: GYAE6OF02F380E.46.67.G01.1.454.CMB.1.raw
  modified_base (387)..(387): a, c, t, g, unknown or other
  misc_feature (387)..(387): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaatgtatcaacatagaccagggacggcccctaagctcctaatctatgctgcatccagtttgcaaggtgggtcccatcgagttcagtggcagtggatcgtgggacagtatttcactctcaccatcagtaatctgacaacgtgaagtnttttgactaacttattactagtacaaactagtaacttactaagtttcgtttaccggacccgtaaggggtacctaaccgtaacttaacgtaaaactttaaaccgaacgttgacggtactcgactaaccgattctcgttacttacgtacttccgttacccgacctacgttcctagtaac

SEQ ID NO: 142303 - DNA, 651 bp, Homo sapiens
  misc_feature: GYAE6OF02HUJYO.46.67.G01.1.454.CMB.1.raw
tcagactagcagtacacgaccggtgctcgatttagagtatacatattgggtttgggggagtctcggtcaggacacagcatggacatgagggtccccgctcagctcctgggggctcctgctactctggctccgaggtgccagatgtgacatcgagctgacccagtctccatcctccctgtctgcaaccggtgggagacagtgtcaccatcacttcgccgggcaaggtcggaacattgacacctatttaaatggtatacaacatagaccgagggacgccctaagctacctaatctatgactgacactccgtagtttgacgtaaaggtcgggtaccagtacgaggttcagtggcaggtgatgagggtatagtattcactcacacctatcaagtaatcgtacgactaagtagtaagttatttacgaacgttaaactttacttaacgtacgttaactaaagtaaacgtaaacgtttaactaagtttacggttttaccgggaaccggtaaacgggaaccgtaaccgtaactaaaaccgttaaaaacgttaaaccgaacgttaggtacgtaccgtacgaccgaacctacgtacgttacgtacccgtttacgtacctttaccccggttacccgtacccgtaacgttaccgtagtaaccg

SEQ ID NO: 142304 - DNA, 617 bp, Homo sapiens
  misc_feature: GYAE6OF02G5713.46.67.G01.1.454.CMB.1.raw
  modified_base (219)..(219): a, c, t, g, unknown or other
  misc_feature (219)..(219): n is a, c, g, or t
  modified_base (230)..(230): a, c, t, g, unknown or other
  misc_feature (230)..(230): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttggccgggnaagtcggaacntgacacctatttaaatgtatcaacatagaccgagggaccggcccctaagcctacctaatctatgctgctatcctagtttgacgaaaggtcggggtcccagtcgaggttcaggtcgcagtggatcgtagggactaggtatttcactctaccacatactaagtaactcgtagacgtaacgtagtaagttatttgactaactttattacttacgtactaacaagtaattaactaagtttcggtttacggaaccgtaacgggaacctaacgtaaccttaaacgtaaaacgttaaaacgtaaaccgttggtacggtacgttacgaccgtaacctagttaccgtacgttaccttactactttacccgtaccccgtactacttcgtacgtaacg

SEQ ID NO: 142305 - DNA, 629 bp, Homo sapiens
  misc_feature: GYAE6OF02JVK3T.46.67.G01.1.454.CMB.1.raw
  modified_base (395)..(395): a, c, t, g, unknown or other
  misc_feature (395)..(395): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctccatcctcctgtctgcaaccggtggagacagtgtcacatcacttcggaccggcaagtcggaactattcgaactaccgttaattttaaactggtaatacaactatacgaaccgacgggaccggacccctaagactacctaatctatagctgcatccagtttgactaaaggtcgggtaccagtcgagttacagtgcgagtgatcgtaggactagtacttacactctaccacgtntacgtactaatcgtagtactaacgtacgtaagtagtttcaacgtaagttacttactagtacctaacgtagtaacttaactacgtttaggtttaccggtaccgtaacgggtactaaaccgtacttaaacgtaaaagttaaaccgtaactagggtacgacgttacgtacctaacgttactacgttacgtaccgttacacctttaccgtacccgtaccttagtccgtacgttaaccg

SEQ ID NO: 142306 - DNA, 679 bp, Homo sapiens
  misc_feature: GYAE6OF02FIF7W.46.67.G01.1.454.CMB.1.raw
  modified_base (290)..(290): a, c, t, g, unknown or other
  misc_feature (290)..(290): n is a, c, g, or t
tcagactagcagtacacgaccggtgctcgatttagagtatacatattgggtttgtcctcctgctggtggcagctcccagatgggtcctgtccctggtgcaaactgcaggagtcgggcccacgactggtgaggccttcggagaccctgtccctcacctgcgctgtctctggtgcctccatcagtagtggtttcttctggggctgggtccggcagctcccgagggaagggctggaatacattggaagtgtctctcataggtggaggttcctattacagtccgtctctcaagngtcgagtcacatatctctggacacgtcagcaatctacgttttcccagaagtatgtagttctgtcgaccgcgtctacgacgtacgggtcgttttatacgtgtcgcggagacgtacgtcttactttagtcgttagttttacgggagtttggttactttcgacctaacccgttagtaccgtcgggtaccggggacgttacccggtacccggtacggggtacccgtaaggggtaaccgttaccggttcggtacccgtacccgtttcgtacccgttaccgtccctacccgaacccggtaacggggtccccacgggttaccccggttacccttacccccggtacggtaccccgtacccccgtttacccgacccgtaaccggtccgttaaccccgg

SEQ ID NO: 142307 - DNA, 729 bp, Homo sapiens
  misc_feature: GYAE6OF02HQ4QW.46.67.G01.1.454.CMB.1.raw
  modified_base (192)..(192): a, c, t, g, unknown or other
  misc_feature (192)..(192): n is a, c, g, or t
  modified_base (218)..(218): a, c, t, g, unknown or other
  misc_feature (218)..(218): n is a, c, g, or t
  modified_base (260)..(260): a, c, t, g, unknown or other
  misc_feature (260)..(260): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctccatcctccctgtctgcaaccggtggganacagtgtcaccatcacttggccgggnaaggtcggaacattcgactaccttatttaattggtatacaanatagaccgagggaccgaccctaagcctacctaatctatgctgctactccgtagtttcgacgtaaagggtccgggtacccagtccgtaggttcagggtggactaggtggactcggtaggtactagtactttaccacttctacctacctaagttaccgaagttaacgtcgttacgaacggttaaacggtaaggtaaagttaacgtttttacgaacctttaaactttacgtttaccgtacgttaactaaacgttaagttaaacttaaacgttaagtttaccgggtttaccgggaaccggttaaacgggtaaccgtaaacgtaaaccgttaaaccgttaaaaacggttaaaaccgtaacgtacggttacggtaccgttacggtaaccctaaccgttactttacggttaccgtttacctttaccggtacctttacccccgtcccgttacccttaacggttccgtaagttacccg

SEQ ID NO: 142308 - DNA, 661 bp, Homo sapiens
  misc_feature: GYAE6OF02GMWGE.46.67.G01.1.454.CMB.1.raw
  modified_base (332)..(332): a, c, t, g, unknown or other
  misc_feature (332)..(332): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctctggggctgggtccgcagctccgagggagggctggaatacagttggaagtgtctctcatagtggaggttcctattacagtccgtctctcaagagtcgagtcaccatatctctgacacgtccagcaatctcgttttaccgngaagtatgtagttctcgtgaccgccgtctcgaccgtacgggtctttaagttactgtcgtcgagacggacggacgtagttacgtagttacgttttggttaggttggtttacgtttcgtaaccgtacccgttagtacgtcgggtacgggtccgtacccggtacccggtcgggacccgaaggggtaacgttaccggttggtaccgtaccgttccgttaccgttacgtccctaccgaacccggaacgggtaccccgtacgttccccgggttacccgtttccccccgtaccggtccctaccccgttcccgtacccgtaacgaccgttaccccgg

SEQ ID NO: 142309 - DNA, 694 bp, Homo sapiens
  misc_feature: GYAE6OF02IS5KT.46.67.G01.1.454.CMB.1.raw
  modified_base (195)..(195): a, c, t, g, unknown or other
  misc_feature (195)..(195): n is a, c, g, or t
  modified_base (504)..(504): a, c, t, g, unknown or other
  misc_feature (504)..(504): n is a, c, g, or t
tcagactagcagtacacgaccggtgctcgatttagagtatacatattgggtttggggagtctcggtcaggacacagcatggacatggagggtccccgctcagctcctggggctcctgctactctggctccgaggtgccagatgtgacatcgagctgacccagtcctccatcctccctgtctgccaaccgtggganacagtgtccaccatcacgttgccgggacaagtcggaacattcgaccaccttatttaagtcggtattacaaacgattaggaccgtacgggaccgcccctaagtctaccttaagtcctatcgctcggactactccgtagtttacgacgtaaacggtcgggttaccctaagtccgtaacgggttcaaggtcggtacgtagtcggtatccggtaggtacgacgttacttcgactctaccgaccattcgaagttactacgtgtaacgtaacggagtaagttatttcgacttaacgtttagttaacgtccgttanaacctaagttaactttaacgtacgttacggttttacggaccgtaacggtaactaccggtaacttaaaccgtaaaacgttaaacgtacggttacgtaccgtacgtacgtaccgtaacgtaacctttacgtccgtttaaccgttcccgttaacttaccccgttccggaccctactttaccggtattaaccgg

SEQ ID NO: 142310 - DNA, 711 bp, Homo sapiens
  misc_feature: GYAE6OF02IMN9K.46.67.G01.1.454.CMB.1.raw
  modified_base (314)..(314): a, c, t, g, unknown or other
  misc_feature (314)..(314): n is a, c, g, or t
  modified_base (352)..(352): a, c, t, g, unknown or other
  misc_feature (352)..(352): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccgcagcctccgagggagggctaggaatacgattggaagtgtctctcatagtggtagttcctattacnggtccgtcgtctcaagagtcgagtcaccatactctcgngactacgtccagtacaacttcttacgttttcccagtaacgtattcgtagtttcgtacggtccgaaccccggtccgtccgttacggtaaccgtaccggggttaccgtttttaacgttacgttaggttacggacggtaacggtaacggtaccggtatttaacgtttagttacggtttaagttttttcgggtaagtttcggttttaacgtttaccggtaacccttaccccggttaaggtaccgttaccggggtaccgggggtacctcccgggtaacccggtcggggaacccgtaaggggtaacttaccggttcgggtaccgttaccggttcccgttacccgttaccggtaccctaaccccgg

SEQ ID NO: 142311 - DNA, 683 bp, Homo sapiens
  misc_feature: GYAE6OF02HT9NE.46.67.G01.1.454.CMB.1.raw
  modified_base (193)..(193): a, c, t, g, unknown or other
  misc_feature (193)..(193): n is a, c, g, or t
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
  modified_base (246)..(246): a, c, t, g, unknown or other
  misc_feature (246)..(246): n is a, c, g, or t
  modified_base (255)..(255): a, c, t, g, unknown or other
  misc_feature (255)..(255): n is a, c, g, or t
  modified_base (363)..(363): a, c, t, g, unknown or other
  misc_feature (363)..(363): n is a, c, g, or t
  modified_base (415)..(415): a, c, t, g, unknown or other
  misc_feature (415)..(415): n is a, c, g, or t
tcagactagcagtacacgaccggtgctcgatttagagtatacatattgggtttggggtagtctcggtcgaggacacagcatggacatgaggtcccgctcagctcctggggctcctgctactctggctccgaggtgccagatgtgaccatcgagctgaccagtctccatccctccctgctgcaacgtggagacngtgtcacntcattcgccggnaagtcggaacattcgactacctaattttaaagngtatacaanatagacaggacgccctaagctctaatctatcgctgacactccatttcgactaaaggcggtaccagtcgtaggttcaggttcgacgagtcgatcgtagggtaccaggtnttacacgtacttacgaactacgtaccgtaatacgttctaagtccgaaaggtnaaacggttatttacggaacctaaagtttacttaagttacgttaacaacgtaacttaaactactaacttacggttttacgaaccgtaacggtaaccgtaaccgtaaaccttaaggaaaaacccgttttaaaacgaaaaccgttttagggtaaccgttaccgttaagggtaaccctaaacccgtttaagtaccgtttaacgtaaccgttttcctaaccgggtttaccccttaccccgttaaccggttacctacggtttcctttaaaacgg

SEQ ID NO: 142312 - DNA, 625 bp, Homo sapiens
  misc_feature: GYAE6OF02HAIAY.46.67.G01.1.454.CMB.1.raw
  modified_base (172)..(172): a, c, t, g, unknown or other
  misc_feature (172)..(172): n is a, c, g, or t
  modified_base (256)..(256): a, c, t, g, unknown or other
  misc_feature (256)..(256): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggcctttcggagaccctgtccctcacctgcgctgtctctggtncctccatcagtagtcggtttcttcgtggggctgggtccgcacgctccccgaggggagggctggaatacgagttggaagtgttcncgtcagttagtggaggttcctattacagtccgtctctcaagagtcgagtcaccatatctctggacacgtcagcaatcagttttcccagaacatcgagttcgtgtcggaccgccgcttcggactaccgggtcttttattacgtggtgacgtagaggacggtactattatgtactttttggagttggttactttcggactacccgtagtactacggccggggtcttcccggacccgtcggggcccgtagggtaactcgttcggtaccaccgttccgttaccttacggcccttacccgaccgaacgggccccgtagttcccggttaccttcccccgtgggtcccctacccttcccgtcccacgtcgaccccg

SEQ ID NO: 142313 - DNA, 730 bp, Homo sapiens
  misc_feature: GYAE6OF02FXTBQ.46.67.G01.1.454.CMB.1.raw
  modified_base (167)..(167): a, c, t, g, unknown or other
  misc_feature (167)..(167): n is a, c, g, or t
  modified_base (171)..(171): a, c, t, g, unknown or other
  misc_feature (171)..(171): n is a, c, g, or t
  modified_base (208)..(208): a, c, t, g, unknown or other
  misc_feature (208)..(208): n is a, c, g, or t
  modified_base (244)..(244): a, c, t, g, unknown or other
  misc_feature (244)..(244): n is a, c, g, or t
  modified_base (248)..(248): a, c, t, g, unknown or other
  misc_feature (248)..(248): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctcnggtncctcatcagtagtggtttcttcgtgggctgggtccgnagctccgagggaagggctggaatacgattggaagtnttcnctacatagtggacggttacctattacagttccgtcgtctacgaaggacgttcgagtaccaaccgtaattactaccttacgtacggtaaccaccggtaccaggtacaacttctacgttttacccaggaactagtagtacgttctggtacgacccgtccgctacggacgtaccggggttagttttaataccgttggtcggtacgaggaacggtacggtacttaagtttacgttagttagtttttagggtaggttacggtttacgtttaccgtaaccgtacccgttaaggtaccgtacggggtaccggggtaccttaccggaccccggttacggggacccgtaaggggtaaacttacgttacgggtacccgtaccgttaccgttaccgtaccgaccgtaccgaaccggtaacggaccctacggttcccgttaccgttaccccgtcggaccctaccccgtacccgtaaccgtacggtacgtacccg

SEQ ID NO: 142314 - DNA, 705 bp, Homo sapiens
  misc_feature: GYAE6OF02INZ7Y.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtcctccatcctccctgtctgcaaccggtgganacagtgtcacatcacttgccgggacaagtcgaacattgacacctattaaatgtatcaacataagaccagggacgacccctaagctacctaatctatgctgcactcctagtttgactaaaggtcgggtacccagttcgaggttcaggtcgctagtgatcgtgggactagatttacgcttactaccaccgtataccgtaagttaactctacgactaaacggttagtaaacggttattttacgaccttaaaccgttttaattaaccgttacgttaaacaaacgtaaagttaaacgtttaactaaacgtttacgggtttttacccggaaaccggttaaacggggtaacctaaaccggtaaccttaaaaccgttaaaaacttaaaaccggttaaacccgtaggttaaccggtaccgttacggaaccgttaaccctaacgtttacccgtttacgttaccctttaccgtaacctttaccccgtttcccccggacctttaaccgttaccttaggttaaacc

SEQ ID NO: 142315 - DNA, 926 bp, Homo sapiens
  misc_feature: GYAE6OF02H9DPJ.46.67.G01.1.454.CMB.1.raw
  modified_base (253)..(253): a, c, t, g, unknown or other
  misc_feature (253)..(253): n is a, c, g, or t
  modified_base (302)..(302): a, c, t, g, unknown or other
  misc_feature (302)..(302): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcgcctcatcagtagtggtttctcgtggggctgggtccgcagctccgagggagggctagggaatacgagttggaagttgtactntcgagttaggtggtaggttccttagttacgaggtccgtctctacaaggngtcgacgttaccacctagttactctcgtaggacctacgtaccgagtactaagtccgtttaacgtttttccccaaggtaaacgtagttacggtaacgttttcctaggttaccgaacccggtccggtaccgttacggaacccgggtaaccggggtttaccgttttttaacggttaccgttaggtttcgggttacgggtaacggggttaacgggtaccggggtttaaccttttaagtttaacggtttacgggtttttaaggtttttttcggggtaaagggtttttacggggtttttaacgtttttaccgggttaaacccgttaaccccggtttaggtaaccgttcgggggtaaacccggggggtcccttaccccggggtaaccccgggtaccggggggtacccggtaaacgggggttaaccgttaaccgggttcgggttaccccgtaccggtttaccccgtttaccgttacccggttacccccgttaacccggtaccccgggtaaaacccgggtcccccgttaaccgggttcccccgggttttaccccgtttaccccccggttacccgggtccccctaaccccccgtttaccccgttacccggaaacccggtaccccgttacccggg

SEQ ID NO: 142316 - DNA, 602 bp, Homo sapiens
  misc_feature: GYAE6OF02IGHK1.46.67.G01.1.454.CMB.1.raw
  modified_base (249)..(249): a, c, t, g, unknown or other
  misc_feature (249)..(249): n is a, c, g, or t
  modified_base (351)..(351): a, c, t, g, unknown or other
  misc_feature (351)..(351): n is a, c, g, or t
  modified_base (388)..(388): a, c, t, g, unknown or other
  misc_feature (388)..(388): n is a, c, g, or t
  modified_base (416)..(416): a, c, t, g, unknown or other
  misc_feature (416)..(416): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtcgcctccatcagtgtgtttctcgtggggctgggtccggnagtcctccgagggagggctggatacgtattcggagtgtctctcagttgtgtacggttctattacgtacgtccgtctctacagtagtcgagtaccacatatcngtacgacgacgtccacgacaactctacgttttacccngtacgtatgtattactgtcgaccgtccntagaccgtaggtccttattcgtagtcgacgacgacggtacgtctagttacttacggttattttaggagtttgtttacgtttacgtcgtaaccgtagtacgtaccgcggggtactccggtacccgttcgggacgtacggtacgttaccgtacgggtcctccgtaccgttaccgtcgtaccctacccg

SEQ ID NO: 142317 - DNA, 800 bp, Homo sapiens
  misc_feature: GYAE6OF02HIW1R.46.67.G01.1.454.CMB.1.raw
tcagactagcagtacacgaccggtgctcgatttagagtatacatattgggtttgggggagtctcggtcaggacacagcatggacatggagggtccccgctcagctccgtggggctcctgctactctggctccgaggtgccagatgtgacatcgagctcgacccagtctccactccctccctgtctgccaaccggtgggagacgagtcgtccaccatctacttcggccgggctaaggtcggaacattgaccaccttaatttaaattggtatacaacataacgaccgaggggaccgcccctaagccttacctaatctatcgctcgctataccgtagtttacgacgtaaagggtcgggtcccagttaccggtaacggtttcgaaggttcgggactaggggtacggtacgttacggtacggggtaactaggtacttttaccgaccgtttacccaccctaaaccgtacgtaacgtaagttaactcgtaccgtacccgtaaaggttacggtaaatttaccgttttagaaccttaaagttttacttaacgttcgtaacccgtaaatacggttaaattaactaacggttttagtttacccggggaaaccgtaacggggtaaaccctaaccggttaaaccgtttaaaacgtaaaaccgtttaaaacccggaaacgttttcgggtaacgggtaccgttaacgtaacccgtaaccgttaccgttaccggtttaacccttaactttaccccggtttaactttcccccgaaaccccgttttcccgaacccgtttacgttaaccggttaaccgg

SEQ ID NO: 142318 - DNA, 603 bp, Homo sapiens
  misc_feature: GYAE6OF02F5BAQ.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttgccgggcaagtcgaacattgacacctatttaaattggtatcaacatagaccagggacggcccctaagctcctaatctatgctgcatccagttttgactaaaggtggggtcccagtcgtaggttcagtggctagtggatcgtgggacaggtattcactcacaccatacagtaactctgcaacgtgaagtatttcgactaactttattacttcgtacaaactagtaaattactaagtttcgttttaccggaccgtaaacgggaaccaacgtaacttaaactaaaacttaaacgaaacgttaggttacggcttacgacctaaccgtaacttcgttacgtttacttaccgtacctttccccgttaccccgtacccgttacttccgttagttaaccg

SEQ ID NO: 142319 - DNA, 595 bp, Homo sapiens
  misc_feature: GYAE6OF02G2RKT.46.67.G01.1.454.CMB.1.raw
  modified_base (193)..(193): a, c, t, g, unknown or other
  misc_feature (193)..(193): n is a, c, g, or t
  modified_base (218)..(218): a, c, t, g, unknown or other
  misc_feature (218)..(218): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtggganacagtgtcaccatcacttgccgggnaagtcggaacattcgactaccttatttaaatggtatacaacatagaccagggaccgccctaagctactaatctatgctgcactcctagtttgacaaaggtcgggtcccagtcgtaggttacaggtggactaggtggtatcgtagggaactaggtatttaccactctacaccgtatcgaagttatctgacgaagtagaacgttatttgacttaacttattacgtacgtacaaactagtaatttaacagtttggttaccgacgtaaggacacgtaactaaacgtaaagttaaaccgacgtagtcgtactagaccctaacgtatttacgtcgttaccctttagaccgtttcctaccccgtacgtaccttcgtagtaaccg

SEQ ID NO: 142320 - DNA, 694 bp, Homo sapiens
  misc_feature: GYAE6OF02IO2YR.46.67.G01.1.454.CMB.1.raw
  modified_base (303)..(303): a, c, t, g, unknown or other
  misc_feature (303)..(303): n is a, c, g, or t
  modified_base (309)..(309): a, c, t, g, unknown or other
  misc_feature (309)..(309): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgcagatgtgacatcgagctgacccagtctccatcctccctgtctgccgaaccggtgggagacagtcgtcaccatcacgttcggccgggcaaggtcggaacattcgactactatttaaacgtggtactacaacatagaaccgagggaccgacccctaagcctacctaagtntactgntacgcaacttccagtttagacgtaaaggtcggggtaccctagtaccggtaggttccaaggttcgggacgagggttaggaacgttggtacgggaacgtaggtactttaccactttacctccgaacctacgtacgtaagtaaacgttcgtaacggaaccgtaacgttaaggtaagttagtttacggtaacttaaaccgtttaattaacctagttaacaaactaaagtaaatttaactacgtttaacgtttaccggtaacgaaaggtaaccaacgtaaacttaactaaaacgtaaacgtaactggtacgactaggtaccttaacgacttacgtcgttaacctttaccgacgtttacccgttaccccaacgttacttacgtaccgttaa

SEQ ID NO: 142321 - DNA, 538 bp, Homo sapiens
  misc_feature: GYAE6OF02GSA9T.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacgcccctaagctcctaatctatgctgcatccagtttgacaaaggtcgggtccagtcgaggttcagtggcagtggatcgtgggacaggtattcactctcacatcagtaactctgactaagtagtaagtatttgactaacttattactgtacaacataattacagttcgttacggacgaaggtacaacgtactaaactaaacttaaacgaactgtagactagacctacctacttcgtgtaccttactactccgttacccgacctatcctagtac

SEQ ID NO: 142322 - DNA, 714 bp, Homo sapiens
  misc_feature: GYAE6OF02HCZBL.46.67.G01.1.454.CMB.1.raw
  modified_base (306)..(306): a, c, t, g, unknown or other
  misc_feature (306)..(306): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatccctcctgtctgcaacggtggagacagtgtcacatcacgttcggccgggcaaggtcggaactattacgactaaccttaatttaaagttgtatacaactatacgaccgagggaccggaccctaagcctactaatctangctgctactctagtttacgacgtaaagggtcgggtacctagtcggtaggttacaggtgcgtagtaggattcgtagggactaggttactttcaccttcactacctagtacgtaagttatcgtacgacgtaacgtagtaagttagtttacgaacttaacgtttagttacttaacgtacctaaagttaacgtaaactttaacgtacgtttacggtttacccggaaccggtaacgggtaacctaaaccgtaaacgtttaaaaccgtaaaaacgtttaaaaccgtaacgtttacgggtacgtaccgttacggtaaccctaaccgtttaccgttaccggtttaccgttacttttaacccgtacctttaccccgtttaaccccggtacctttaacgtttcccgtaaggtttaacc

SEQ ID NO: 142323 - DNA, 730 bp, Homo sapiens
  misc_feature: GYAE6OF02GYJ0X.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctcgacccagtctccactcctcctgtctgcaaccggtgggagacagtgtccaccatcacttcggccgggacaaggtacggaacattcgaacctaaccttaattttaaagttggtactacaaatagtaacgaccgaggggaccgacccctaagcctacctaatctatgctcgctactccgtagtttcgacgtaaacgggtcgggtccctaagtcgggtaggtttacgaggttcgggactagggtggtaagttcggtagggtaactaaggttaactttccgaacctttcctaaccgtaaccctattaccgtaaagttacttaccgtacgtaaccgtaacggttaggtaaagtttacttttagacctttaaactttaacgttaacttacgttaactaaactaagttaaacttaacctaagtttcgtttaaccgggacgttaaacgggacctaacggtaacttaaaccgtaaaacgttaaaccgtaacgttcggtacggtacttaaccggacctaaccgtaaccgttcttacgttaccgtttacctaccgtttcccgttacccgacttacttcgtataaccg

SEQ ID NO: 142324 - DNA, 684 bp, Homo sapiens
  misc_feature: GYAE6OF02H9K5V.46.67.G01.1.454.CMB.1.raw
  modified_base (195)..(195): a, c, t, g, unknown or other
  misc_feature (195)..(195): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatcctccctgtctgccaaccggtggganacgagtgacacatcacttcggaccggataaggtcgaacagttgacctaaccttaatttaaagttggtataccgaaactaagtaacgaccgaagggaccggtaccccctaaggcctaccttaagtcctaatcggctgctacgtcctagtttgacgaaacggtcggggtaccctagtcgtaggttcgagtcggcgagtggatcgtagggactagtactttccgaacttctaccacctataccgtaagttactcgtacgacgtaagtagtaagttacgtttagaccttaactttattaaccgttagtaacctaaacgtaataaacgtttacgtaacgttttcggttacccggaaccggtaaggtaaccgtaaccgtaaactaactaaaacgttaaacgtaacgtaggtcgtacgtccgactaacccgtattccgtaacgtttacttaaccgttacttcccgttacccccgactacgttaccctagttaaccg

SEQ ID NO: 142325 - DNA, 735 bp, Homo sapiens
  misc_feature: GYAE6OF02G7MBJ.46.67.G01.1.454.CMB.1.raw
  modified_base (238)..(238): a, c, t, g, unknown or other
  misc_feature (238)..(238): n is a, c, g, or t
tcagactagcagtacacgaccggtgctcgatttagagtatacatattgggtttggggagtctcggtcaggacacagcatggacatgagggtccccgctcagctccgtggggcctcctgctactctggctccggaggtgccagatgtgacatcgagctgacccagtctccatcctcccgtgtctgcctaaccggtgggaagactagtcgtcaaccctatcctaacgttcgcccgggganaaacggtccggaaactagttcggaaccaaccttaaattttaaagttcggtatacaaacaatagaaccgagggaccgacccctaagcctactaatactaagtcgactagactaactccgttaagtttcgaacgtaaaagggtttccggggaccctaagttccgggaacgggttttccaaaggttcgggtacgaaggttcgggtaaactccggttaagggacaagttacgtttcaaccgttctaccggaacctagtactaacgtaatcgttagacgtaacgtagtaatagtttacgactaacgttaattacttacgtaacaactaagtaaacttaataaagttacgtttacggaaccgtaaggtaaccgaacggaacttaaactaaaagttaaaacctaacgttaacgtagtaccgtacgtccgtaaacgtacttacgttaacgttacctttacgttaccgtaccgtttacccgaaccctacggttacctaggttaacc

SEQ ID NO: 142326 - DNA, 737 bp, Homo sapiens
  misc_feature: GYAE6OF02H129V.46.67.G01.1.454.CMB.1.raw
  modified_base (232)..(232): a, c, t, g, unknown or other
  misc_feature (232)..(232): n is a, c, g, or t
  modified_base (496)..(496): a, c, t, g, unknown or other
  misc_feature (496)..(496): n is a, c, g, or t
tcagactagcagtacacgaccggtgctcgatttagagtatacatattgggtttggggagtatcggtcaggacacagcagtggacatgacgggtccccgctcagcctccgtggggctcctgactactcgtgggcctaccggagggtcgaccaggtattcgtggaaccagtcgaggcctcggaaccctgtcctacccacgtccctcccgtggtcacgaccgtaacggtgggaanacgtgctacacctatacgcgtcggaccggagtacgaaccgaatgtacgacctaacttattaagtgtacactagtatacgacgacgggaccacctaagtcctacgtaactactctcgtactacgactactacgtttaggtaaccagggtttaaacgggccggtttacccgaagttcgggttacgtacggtaacggttggaacgttagggtaacgtacggtacggtacgaagttacgtaccgttcacttaccgacactacggtaanacggtactcgtacggacgttaacgtacgtaacgttacgtactaacgttacttacgtaattacggtaaactaacgtaaacttacgttaacgtacgtttaacgggttaccgtaaacggtaactaaaccgtaactaaaccggttaaacgtaacgtaaacgtcgtacgtaccggtacaccgtacgtacgttactccggttattcctacgttaccgttccgaacgttaccgcttaccggtataccg

SEQ ID NO: 142327 - DNA, 588 bp, Homo sapiens
  misc_feature: GYAE6OF02IH0MD.46.67.G01.1.454.CMB.1.raw
  modified_base (344)..(344): a, c, t, g, unknown or other
  misc_feature (344)..(344): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccgcagctccgagggagggctggatacattggaagtgtctctcatagtggagttcctattacagtccgtctctcaagagtcgatcaccatatctcgtgacacgtcagcaatctacgttttcccagaagtatgtagttntgtgaccgcgtctcgacgacgggtcgtttattctgtgacgagagacggcttatagtgttagtttggagttggtttattcgactaccgtagtacgtcgggtacgggcgtccgaccccggtcggggccgagggtaactacgtcgtccgtaccgttcttccgtacgcccgtccgtaccgaacgggtcccctagttcccggttacctccccgtcggccctaccccgtacccgtaccgacgcgtacccg

SEQ ID NO: 142328 - DNA, 736 bp, Homo sapiens
  misc_feature: GYAE6OF02IE92D.46.67.G01.1.454.CMB.1.raw
  modified_base (200)..(200): a, c, t, g, unknown or other
  misc_feature (200)..(200): n is a, c, g, or t
  modified_base (214)..(214): a, c, t, g, unknown or other
  misc_feature (214)..(214): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggcctttcggagacccctgtcccctcacctgcgctgtctctggtgccctccatcagtagttgtttcttcgngggtctgggtccgnacgtcctacccggaggggacgggtctaggaatacgtagttaggaagttcgtacctctactagttaggtggtacggtttaccttaagttaacgtacgttccgttcctacctacgaaaggtacgttacgacgttccaacctattacttccgttcgtacggtacctaccgtaccgaacggtactaaacttccgtttaaccgttttttaccccgaggtaacgtagttacggttacgttcgtcggtacgcccgtacgtcgtacgaccggtacggttcttttaactcgtagtcgacggtagtcgtacgtactttattagttgttttacgtttagggtagtttacggttttacttaccgtaacccgttacgttaagtacggttccggggacgggtcccgtaccgacccgggtggaccgaagggtactcgttcgcctacgtccttacgtccaccctaccaccggaccggtcctacggtccccgtttccctacccggtccaccctccccttccaaccgtacgcctacccgg

SEQ ID NO: 142329 - DNA, 571 bp, Homo sapiens
  misc_feature: GYAE6OF02GLA6G.46.67.G01.1.454.CMB.1.raw
  modified_base (296)..(296): a, c, t, g, unknown or other
  misc_feature (296)..(296): n is a, c, g, or t
  modified_base (340)..(340): a, c, t, g, unknown or other
  misc_feature (340)..(340): n is a, c, g, or t
tcagactagcagtacacgaccggtgctcgatttagagtatacatattgggtttgtcctcctgctggtggcagctcccagatgggtccttgtccctggttgcaactgcaggagtcgggcccacgactggtgaggccttcggagaccctgtccctcacctgcgctgtctctggtgcctccatcagtagtggttcttcgtgggctgggtccggcagctcccgaggggaagggctaggaactacagttggaagttcgtctctcagtagtggaggttcctattacagtccgtctctcaagngtcgagtcaccatatctctggacacgtcagcaatcagttttccngagatgattctgtgaccgcgctgacgacgggtctttattacgtgtcgcgagagacggctattatgtagttttggagttggttattcgactacctagtactcggacggggctacgtacccgtgggaccgagggtaactacgtcggtccaccgttcttccgttacgcctaccgaccgaacggcccacgtccggttcccttccccgtcggccacccctcctccacgtctacccg

SEQ ID NO: 142330 - DNA, 675 bp, Homo sapiens
  misc_feature: GYAE6OF02HVP0X.46.67.G01.1.454.CMB.1.raw
  modified_base (190)..(190): a, c, t, g, unknown or other
  misc_feature (190)..(190): n is a, c, g, or t
tcagactagcagtacacgaccggtgctcgatttagagtatacatattgggtttggggagtctcggtcaggacacagcatggacatgaggtccccgctcagctcctggggctcctgctactctggctcgaggtgccagatgtgacatcgagctgacccagtctccatcctccctgtctgcaaccgtggganacagtgtcaccatcacttgccgggcaagtcggaacattgacactatttaaatgtatcaacatagaccaggacgccctaagctctaatctaatgctgcatccagtttgcaaagtgggtcccagtcgagttcaggtgcagtgatcgtgggacagattcactctcaccatctagtaactcgtagactaaacgttgtaaagttatttttacggaccttaaactttaactttaacgtaacggtttacaaaaccgtaaggttaaaactttaaacgtaaacgtttacgggttttttaacccggaaccgtaaaacggggtaaccgaaaccggttaaccttaaaaacgtaaaaacgtttaaaaacccggtaaagttaaccgggttaggaccgtttacgaacccgtaaccttaacgttaccttaacggttacctttaacggtaaccctttaccgtttaacccccggtacctaaccgtttcgttaacgttaaccgg

SEQ ID NO: 142331 - DNA, 768 bp, Homo sapiens
  misc_feature: GYAE6OF02IX3GC.46.67.G01.1.454.CMB.1.raw
  modified_base (212)..(212): a, c, t, g, unknown or other
  misc_feature (212)..(212): n is a, c, g, or t
  modified_base (326)..(326): a, c, t, g, unknown or other
  misc_feature (326)..(326): n is a, c, g, or t
  modified_base (357)..(357): a, c, t, g, unknown or other
  misc_feature (357)..(357): n is a, c, g, or t
tcagactagcagtacacgaccggtgctcgatttagagtatacatattggggtttgtcctcctgctggtggcagctcccagatgggtcctgtccctggtgcaactgcaggagtcgggcccacgactgggtgaggccttcggagacccctgtccctcacctgcgctgtctcgtggtgcctcatcagtagtggtttctcgtggggctgggtccgnagcctacccgaggggagggctaggaatactagttggaagtcgtactctacataggtggtaggttacctattacagttccgtctctcaaggagtcgagtcacctatactctacgnggacacgtccagcaactcgtagttttcccgngtaaacgatcgtagttctacgtcgaccggtcgctacggaccgtacggggttacttttaacgtacgttcggtacggtccggtaaggtaacggtaaccgggtacttaacgtttaagtacggtttaagtttttcgggtaagggtttacggtttaggtttaaccgtaacccgttaaccccgttaagggttacgttacccggggtaacccgggggtaccctacccgggtaaccccggttacgggggacccggtaagggtaaccttaacggtcgggttaacccgtacccgtttacctacccgttagtccccgtacccaaaccgggtaacccgggtacccctacggttcccggtacccttttccccccggaggtacccccttacccgtacccgtaacccgaacggtaccgtaaccccg

SEQ ID NO: 142332 - DNA, 866 bp, Homo sapiens
  misc_feature: GYAE6OF02GPPOD.46.67.G01.1.454.CMB.1.raw
  modified_base (212)..(212): a, c, t, g, unknown or other
  misc_feature (212)..(212): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtcnccctccatcgtagtagttggttttcctcggtggggtcgtcggggtccggacgacggtccgtacccggaagggggtaacgggggccttagggaaacttaaccgtaagtttaggggaaaggttgttccttacgtctaagttaggtcgggtacggtttccttaagtttaccgtaacggttcccgtaccttcgtaacgtaaacggtacggttaccggtacgttacccgaacctaagttaacttccggttacgtacgggtaaccctaaccggttaccacggtacctaaagttcccgtttaacgtttttacccccgtaaggtaaacgtacgtttaacggttaccgttttacgttacggtaccggtaaccccggtcccgtcgtaacgggtaacccggttaaccgggggttacctttttaacgttaccggttaggttccggacggtaacgggaacggtaaccggtactttaagttttaacgttggttttaacgttttgggtaaggttttcggttttaacgttacccgtaaacccgttacccgttaagtacggtaccggggtaccggggtccttaccccgggtacccggtacggggaccgtaacgggtacgttacggtcggtacccttaccggtcctttacccgtacgtaccccgtaacccgg

SEQ ID NO: 142333 - DNA, 513 bp, Homo sapiens
  misc_feature: GYAE6OF02HIBL8.46.67.G01.1.454.CMB.1.raw
  modified_base (509)..(509): a, c, t, g, unknown or other
  misc_feature (509)..(509): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaagtgggtcccatcgagttcagtggcagtggatctgggacagatttcacttctcaccatcagtaatctgcaacgtgaagtatttgactaacttattactgtacaacataattacaattgttttacggacctaagggacacgaactaactaaattaaacgaactgtaggctgcaccatctgttcttcacttctcccgtcattcngtac

SEQ ID NO: 142334 - DNA, 716 bp, Homo sapiens
  misc_feature: GYAE6OF02IDVWK.46.67.G01.1.454.CMB.1.raw
tcagactagcagtacacgaccggtgctcgatttagagtatacatattgggtttgggggagtctcggtcaggacacagcatggacatgagggtccccgctcagctcctggggctcctgctactctggctccggaggtgccagatgtgacatcgagctgacccagtctccatcctccctgtctgcaaccggtggagacagtgtcaccatcacttcggccgggcaaagtcggaacattgactactatttaaattggtatacaacatagaccgagggaccgcccctaagctactaatctatcgctgctactcctagtttcgacgtaaaggtcgggtcccagtcgtaggttcgaggtggacgtaggtgactcgtagggtacagtactttcactctccacatacgtaagttactcgtagacctaacggtagtaagttagtttcgaccgttaaattttacgttaacttcggttaactaaacgtaacgttaaacgtttactaaacgttttacggttttacccgggaaccggtaacgggtaaaccctaacggtaaacctttaaacggtaaaaactttaaaaccggtaacgtttagggttaccggtacgtttaccggaacccttaaccggtactttaccgttacggtttaaccctttttccggtaacccgtttaccccgtttacccccgggtaactttaccgtttacccgttaaggtttaaacccc

SEQ ID NO: 142335 - DNA, 784 bp, Homo sapiens
  misc_feature: GYAE6OF02G30TS.46.67.G01.1.454.CMB.1.raw
  modified_base (221)..(221): a, c, t, g, unknown or other
  misc_feature (221)..(221): n is a, c, g, or t
  modified_base (264)..(264): a, c, t, g, unknown or other
  misc_feature (264)..(264): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctcgacccagtctccatccctccctgtctgaccaaccggtggagacagtgtcacatcacttcgccgganacggacgaactattgaactaccttaatttaattggtatacaanatacgaaccgacggaccggtacccctaagccttacctaagttctatcggtactgaccacgttccgtagtttacgaacgtaaacgggttcgggtaccctaagtaccggttaggttaccgaagggttcgacgtaagggtcggtaactcggttacggggactaggtactttacacgttccacgtaccagttaacgagtaactcgtacgaacgtaacgttagtaacgttattttacgaaccgtttaatttacttacgttagtaaccgtaagttaaacgtaaattaacttaacggttttaccgttaacgggtacccgtaaagggtaaccctaaaccggttaaaccgttaaaaacgttaaaacgtttaaaaccggtaaacctttaggggtacccgtttacgaacgtaacccgtaaccgttaacgttttaccgttaacccggtttcccttttaaacccggttacctttacccccggtttaaccccggtacccctttaaacggtttacccgttaagtttaaaccccgg

SEQ ID NO: 142336 - DNA, 763 bp, Homo sapiens
  misc_feature: GYAE6OF02IDWAW.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtccgggcccacgactggtgaggccttcgggacgacccctgtccctcacctgcgctgtctctggtgcctccatcagtagtggtttcttcgtgggctgggtccggcagcctcccgagggagggctggaatacattggaagtgtctactcagtagtggtaggttcctaattacacgtccgtctctacaagagtcgagtcaccatactcgtcgtaggaccacgtccagacaactcttacgttttccccaggaagtatacgtagtttctggtacggacccgccgtaccgtacggtaccgtacgggttcgtttttaagttaccgtggttacggcggtaaggacggtaacggtacttagtttaattaggtttagttttagggtaagtttagggtttttactttaccggtaaccctaccgttaacggtcggttaccggggaccggggggtacctcccgggtaaccccgggtcgggggaccgtaaacgggtaacgtacgttaccgggttaccgtacccgttccgttacccgttaccggtaccccttacccgaacccgggtaaccgggtacccctaacggtttccccggtttccccgttacccccccgttcgggccccgttaacccccgtccccttacccgtaaaccggacccgtaaccccgg

SEQ ID NO: 142337 - DNA, 623 bp, Homo sapiens
  misc_feature: GYAE6OF02F75EZ.46.67.G01.1.454.CMB.1.raw
  modified_base (238)..(238): a, c, t, g, unknown or other
  misc_feature (238)..(238): n is a, c, g, or t
  modified_base (293)..(293): a, c, t, g, unknown or other
  misc_feature (293)..(293): n is a, c, g, or t
  modified_base (386)..(386): a, c, t, g, unknown or other
  misc_feature (386)..(386): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggttcttctgggctgggtccgcagctccagggagggctggaatacatggagtntctctcatagtgaggttcctattacagtccgtctctcaagcgtcgagtcaacccntatctcgtggactacgtcctagcaattccagttttcccagaaagtatgacgttctaggtagcccgccgtctagaccgtacgggtcgttttaanacgtgtgaccggagacggtacggcttagttacttggtacttttgggagttaggttattttcgactaccgttagtcgacgtaccgggggtcaccggtcccgtacgggccgtaaggggaactaacgtggtacctaccggtcgtaccgttacgccttacccgaaccgtaccgggccctacggtaccgttcccttaccccgttcggccctacccccgtctaaccctaccggaccgtacccg

SEQ ID NO: 142338 - DNA, 519 bp, Homo sapiens
  misc_feature: GYAE6OF02G8QG8.46.67.G01.1.454.CMB.1.raw
  modified_base (216)..(216): a, c, t, g, unknown or other
  misc_feature (216)..(216): n is a, c, g, or t
  modified_base (389)..(389): a, c, t, g, unknown or other
  misc_feature (389)..(389): n is a, c, g, or t
  modified_base (483)..(483): a, c, t, g, unknown or other
  misc_feature (483)..(483): n is a, c, g, or t
  modified_base (507)..(507): a, c, t, g, unknown or other
  misc_feature (507)..(507): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtgggagacagtgtcaccatcacttgccgggnaagtcggaacattgacaccttatttaaattggtatcaacatagaccagggaccgcccctaagctcctaatctatgctgcatccagtttgacaagtgggtcccatcgagttcagtgcagtgatcgagggacagtatttcactctcaccatcagtaactctgacaagtgtaagtntttagactaacttattactgtacaagtataattacaattggtttcggaccgaaggtacaacgactaacaaagttaaacgatgagctagcaactntctgtacttacacgttccttcccnctactctatacg

SEQ ID NO: 142339 - DNA, 624 bp, Homo sapiens
  misc_feature: GYAE6OF02INWBN.46.67.G01.1.454.CMB.1.raw
  modified_base (335)..(335): a, c, t, g, unknown or other
  misc_feature (335)..(335): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggcctttcgggagacccctgtccctcacctgcgctgtctctggtgcctccatcagtagtggtttctcgtgggctgggtccggcagctccgagggagggctggaatacagttggaagtgtctctcagtagtggaggttctattacagtccgtctctcaagagtcgagtcacatatctctggacacgtccagcaatctagttttcccngaagatgtagttctgtcgaccgcgcgtcgacgtacgggtactttattacgtgtcgcgagacgacgctattagtgttagtttacggagttggtttactttcgtactacccgtaagtacgtcgggacggggtctaccggaccccggtggggacccgtagggtaactacgtcggttaccgtaccgttccgttacccgttagcccgtaccgaacccgaacgggtaccctacggttccggttacccttacccccgtcgaccctaccccgtcctaacccgacgaccgtaccccgg

SEQ ID NO: 142340 - DNA, 872 bp, Homo sapiens
  misc_feature: GYAE6OF02FWMIK.46.67.G01.1.454.CMB.1.raw
  modified_base (212)..(212): a, c, t, g, unknown or other
  misc_feature (212)..(212): n is a, c, g, or t
  modified_base (235)..(235): a, c, t, g, unknown or other
  misc_feature (235)..(235): n is a, c, g, or t
  modified_base (248)..(248): a, c, t, g, unknown or other
  misc_feature (248)..(248): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtcncctcatcagtagtggtttctcgngggctgggtccgnagcctccgagggaagggctaggaatacgagttaggaagtgttctctacgattaggtgggtacggttaccttaagttaccgtacggttccgtacttaccgtacgaaggtacgtacgtacgtacctacctaattaccgttccgttacgttacggaacccgtacccggttaccgaacggtacctaaacgtttaccgtttaaccgtttttccccgaagggtaaaacgttacgtttacggttaacgttttccgtaggtacccggaccccggtaccgtcggtaacggtaacccgggttaccggggtttaacttttaaccttacggttgggtaaccggtaccggtaaagggaaccggttaccgggtaactttttaaacgtttaggttaacgggttttaagttttttggggtaagtttttacgggttttaacgtttacccgtaaacccgttaaccggttaagtaccggggttacccggggtaccgggggtacccttaaccccgggggtaaccccgggttaggggaaccccgggtaaagggtttaacccgttacgggttacccgggttaacccggttaccccggtttaccggtttaccccgttttaacccggacccccggtttaaaccccggg

SEQ ID NO: 142341 - DNA, 673 bp, Homo sapiens
  misc_feature: GYAE6OF02HUO05.46.67.G01.1.454.CMB.1.raw
  modified_base (288)..(288): a, c, t, g, unknown or other
  misc_feature (288)..(288): n is a, c, g, or t
  modified_base (338)..(338): a, c, t, g, unknown or other
  misc_feature (338)..(338): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtggggctgggtccgcagctcccgagggagggctggaatacattggaagtgtctctcagtagtggaggttcctattacagtccgtctctcaagngtcgagtcaccatatctcgtggaccacgtccagcaatctacgttttcccngaagatgagtttctgtcgaccgcgctacgacgacgggtcgttttaattacgtggtcgcggagacggacggtcttaagttattggttagtttttaggaggtttggtttatttcgaacctaccgtagacgtcgggaccggggtcctcggtaccccggtaggggacccgaaggggtaacttaccggtggtacccgtaccggtccttacccgttacgtacccgtacccgaacccggtaaccgggcccctaacggttcccggtttacccccgtttccccccggtcggttaccccctacccccgttaccccgtaacccggtaacggtacccgtacccccgg

SEQ ID NO: 142342 - DNA, 596 bp, Homo sapiens
  misc_feature: GYAE6OF02GSPLR.46.67.G01.1.454.CMB.1.raw
  modified_base (212)..(212): a, c, t, g, unknown or other
  misc_feature (212)..(212): n is a, c, g, or t
  modified_base (252)..(252): a, c, t, g, unknown or other
  misc_feature (252)..(252): n is a, c, g, or t
  modified_base (577)..(577): a, c, t, g, unknown or other
  misc_feature (577)..(577): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtcccctcacctgcgctgtctctggtncctccatcagtagtggtttcttcgtggggctgggtccggnagctccgagggaggggctggaatacagttggaagtgtctcgtctagtagtggtacggttacctattaccgagtcccgtctctacgaagtgtcgagtcacctatacttctcgtggacctacgtccagctaatcttacgttttccctagaagtatggtacgttctggtcgacccgcgtgtcgtaacgtacgggtcttttaagttaccgttggtcgtacgagtagacggtctagttattgttagtttttggtaggttagtttatttccgactaccgtagacgtcgggacgggtccgtccggcccggtgggcctaaggatcgtggtccnccgtctccgtgcctacccg

SEQ ID NO: 142343 - DNA, 947 bp, Homo sapiens
  misc_feature: GYAE6OF02JROUQ.46.67.G01.1.454.CMB.1.raw
  modified_base (237)..(237): a, c, t, g, unknown or other
  misc_feature (237)..(237): n is a, c, g, or t
tcagactagcagtacacgaccggtgctcgatttagagtatacatattgggtttgggggacctcctgtgcaagaacatgaagcacctgtggtttgtcctctgctggtggcagctcccagatgggtcctgtccctggtgcaactgcgagggacgtcgggcccacgacttggtgacggtccttcgggacgaccccgttcgtcccctacaccgttcgcggcttcggtcttccgttgggtcncccgttaccagtccgtaaggttcggtttcgggttttcccttcgggtcgggggtccgttccgggggtcccggtacctacggtccctccccgggaaggggaacgggggtcgtacgggtaacgtaacgtgttacgggtaacgttcgtcttacgtacgtagttacggttcgggtacgtttaccgttaacgttacctacggttcccgtaccttaccgtaccgtaaacggtaccgtacggtaacggttacctaaccgtattacttccgttcgtacggaacctacgttacccacggtactaacgttcgttaaccgttttcccgtaaggtaaacgtcgtttacgtaacgtttccgtacggtaccggtacccgccgtaccgtacggtaaccgggtaaccggtttcgttttaacgttcccgtaggttaccgtaaccgtaaaggtaccgggtacgtttaactttaacgtttacgtttaagggtttaagtttttaacgggtacggtttttaacggtttaaccgttttaaccgaacccgttttaaacccggtaaggttaaccgttcccggggtaacccggggtttacccgtaccccggggtaaaccccgggttccggggaaacccgggttaagggtaaaccccgttacggtttaccccggtaccggtttaaccccgttacccgggtttaaccccggttaccccggttacccttaacccccggg

SEQ ID NO: 142344 - DNA, 700 bp, Homo sapiens
  misc_feature: GYAE6OF02HWCB9.46.67.G01.1.454.CMB.1.raw
tcagactagcagtacacgaccggtgctcgatttagagtatacatattgggtttgggggagtctcggtcaggacacagcatggacatggagggtccccgctcagctcctggggctcctgctactctggctcgaggtgccagatgtgacatcgagctgacccagtctccatcctccctgtctgcaaccggtgggagaccaggtcgtccaccattccacttggcccggggacaaggtacggaactacttggacctaaccttaattttaaagttggttaacttacaaactatacggaccgaacggggaaccggtaccccctaagcttacctaacttctatgctagtcacttcgtacgtttcgacgtaaaggtcgggtacccagtcgaggttcgaggtggacgtaggtcggagttcgtgggaactagtactttcaacttctaccaacctatacgtaagtactcgtacgtacgtaacgtaggtagttattttacgaacttaactttattacgttacgtactaactagtaattacgttaaagttcggtttacggaccgtaacggacctaacgtaaccgttaaacttaaacgttaaacgtaacgttagggacgttacgacggtacccaacgttacctttaccgttacgtttcctttaccgttaccttaccccgtttacccggtaccttactttaccgttacgttaacg

SEQ ID NO: 142345 - DNA, 735 bp, Homo sapiens
  misc_feature: GYAE6OF02HRM8D.46.67.G01.1.454.CMB.1.raw
  modified_base (485)..(485): a, c, t, g, unknown or other
  misc_feature (485)..(485): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctccatccctccctgtctgaccgaaccggtgggagactagtcgtccacctatctacgttcggcccgggacaaaggtacggaaacctagtttacgaacctaaccgtttaattttaaaagttggtaacttacaaacgtaactaacggaaccgaacggggaacccggcccccttaaaggaccctaccgttaaactcttaactggaccttgactacttccgtagttacgacgtaaaggtccgggtacccagtcggtaacgttgacgtggacaggtgagtcgtagggactagtactttacgactacctacgacctatacgtaagttacncgtacgactaacgttagtaagttatttacgaacctttaagtttacttaacgttcgttaaaccaaaggttaactaaacgtttaactaacggttttccggtttaaccggaaaccgtaacgggtaacctaaaccgtaaaccttaaacgtaaaacgtaaacttaaggtcgtaccggtctaaccgtaccgaacgttaacctcttacgttacctttaacctcgttacccaccccgttaaccgtacttgacgttaac

SEQ ID NO: 142346 - DNA, 738 bp, Homo sapiens
  misc_feature: GYAE6OF02FT0MO.46.67.G01.1.454.CMB.1.raw
  modified_base (426)..(426): a, c, t, g, unknown or other
  misc_feature (426)..(426): n is a, c, g, or t
  modified_base (432)..(432): a, c, t, g, unknown or other
  misc_feature (432)..(432): n is a, c, g, or t
tcagactagcagtacacgaccggtgctcgatttagagtatacatattggggtttggggagtctcggtcaggacacagcatggacatgagggtccccgctcagctcctggggctcctgctactctggctccgaggtgccagatgtgacatcgagctgacccagtctccatccctccctgtctgcaaccggtgggagacagtgtaccaccatctacgttcggccgggactaaggtaccggaactattacggaacctaacccttaattttaaagttggttaactaccaaacaagtaacggacccgaacggggaacccggacccccttaaagtcccgttaccttaacttaccttactcgtaccgttggacctactccctaggtttcgactaaacgggtcgggtacccagtccggtaggttcgaggtcganaggtgntcggtacgggatagttatcctactaccgtcaaccgtatacctaagttactccgtggaaccgtaaggttacggtaagtttactttacgaaccttaaactttacgtttaaccgtaacgtaacgtaaacgtaattaacttaacgttagtttacggtttaccggaacggtaacggtaacctaaccgttaaccttaaacgttaaaacttaaacggtaagtcggttagtaccgttacgaccgtaacctagttccgttacgttaccttactaccctttacccgttacccctagtaccttccgttacgttaccg

SEQ ID NO: 142347 - DNA, 578 bp, Homo sapiens
  misc_feature: GYAE6OF02IKEEI.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggaccgcccctaagctcctaatctatgctgcatcctagtttgactaaaggtcgggtacccagtcggtaggttcaggtgcagtggtatcgtggacagactcgtacactctacaccatcaagtactctgactaagtgtaagtatttgactaattattactgtacaactagtaattaactaattggtttaccggacgtaaggaactaacgtactaaactaaaagttaaacgacgttaggtacgacgtacgaccaacctacgttaccgttagttacctttacttacgtttcccgttaccccgtctacgttaccttacg

SEQ ID NO: 142348 - DNA, 850 bp, Homo sapiens
  misc_feature: GYAE6OF02JQTMC.46.67.G01.1.454.CMB.1.raw
  modified_base (154)..(154): a, c, t, g, unknown or other
  misc_feature (154)..(154): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgacgntgaccacgtctccactccctccctcgtcaacgaccgacggtaggacgacgtacgtcgtaccacctaccgacgttcggaccggacgtaacggtacggaacctacgttacgaaccgtaccttaactttaaaacgtttaaggttaacgttaccgtaaacgtaacgtaacgtaaccgtacgggtaacccggtaaccccgtaacggtaccttaccgtaacttacttacttacgtcccgtagtactaccggtaaaacgttggaccgtaacggttacggggttacccgtacgtaccggtaacggttacgtacggtacccggttacggtaggtacgtacggttcccgtaacggtaacgtttacgttaccgtaccgttacgtaaccgtaacgtactacgtaacgtaacgtacgtacgtaacgaaacgttacggttaacgtaacgtttaacgttaacgtttaactttaacgtttaacgtaacgaaaccgttaaacgttaaacgttaaacgttttaacgttaacgttaacggttaccggttaaccgtaacggtaaccgttaaacgttaaaccgtaaacgtaaacgttaaaccgttaaacgttacgtaacgtaacgtacgtaccgttacgttacgttaccgttcggttaccttacctaccgttaccgttaccgttaacttaacgttaacgtacgtaccgtacgttacg

SEQ ID NO: 142349 - DNA, 586 bp, Homo sapiens
  misc_feature: GYAE6OF02I2NDU.46.67.G01.1.454.CMB.1.raw
  modified_base (191)..(191): a, c, t, g, unknown or other
  misc_feature (191)..(191): n is a, c, g, or t
  modified_base (215)..(215): a, c, t, g, unknown or other
  misc_feature (215)..(215): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtggganacagtgtcaccatcacttgccggnaagtcggaacatgacactatttaaatgtatcaacatagaccgagggacgacccctaagctacctaatctatgctgcatcctagtttgacaaaggtcgggtacccagtcgaggttcagtggcagtggtactcgtaggacagtacttctactctacaccgtatacctagtaactacgtcgtaacaacgtagtaagttactttagacttaacttaattacttactataactaagtaaacttactaagttcgttacggaccgtaaggactaacgtaactaaactaaactaaacgtaactagtcgacgttagacctaacgtacttactcgttacgttcctacgttccttacccggtacctaacgttcctacgtaac

SEQ ID NO: 142350 - DNA, 747 bp, Homo sapiens
  misc_feature: GYAE6OF02JZO9R.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtgggctgggtccggcagctcccgagggaagggctggaatacagttggaagttgtctctcataggtggacggtttcctattacagtccgtctctacaagcgtcgagtccaccagtatctctcggaccacgtccagacctaatccgttacgttttccccgagaacgacgtcgtacgtttcgtggtcgacccgcgtctacggaccgtaccggggttcgtttttaacgttacgtaggttcgaccgaagtacggacggtacttacgtttagttacggttagtttttagggagtttaggtttacgtttcgtaacctacccgttagacggttaccgggacggggtccgttacccgggtaccccggtaggggtacccgtaacggggtaaccgttaccggttcggtaacccgtacccgttccgttacccttaccggtccctacccggtaacccggaaccgggtaccccgtacggttaccccggtttacccctttcccccggtaccggttacccccgtacccccttaccccgtaaccccggtaaccggtacccgtaccccgg

SEQ ID NO: 142351 - DNA, 575 bp, Homo sapiens
  misc_feature: GYAE6OF02GZLPQ.46.67.G01.1.454.CMB.1.raw
  modified_base (219)..(219): a, c, t, g, unknown or other
  misc_feature (219)..(219): n is a, c, g, or t
  modified_base (230)..(230): a, c, t, g, unknown or other
  misc_feature (230)..(230): n is a, c, g, or t
  modified_base (358)..(358): a, c, t, g, unknown or other
  misc_feature (358)..(358): n is a, c, g, or t
  modified_base (376)..(376): a, c, t, g, unknown or other
  misc_feature (376)..(376): n is a, c, g, or t
  modified_base (381)..(381): a, c, t, g, unknown or other
  misc_feature (381)..(381): n is a, c, g, or t
  modified_base (394)..(394): a, c, t, g, unknown or other
  misc_feature (394)..(394): n is a, c, g, or t
  modified_base (401)..(401): a, c, t, g, unknown or other
  misc_feature (401)..(401): n is a, c, g, or t
tcagactagcagtacacgaccggtgctcgatttagagtatacatattgggtttggggagtctcggtcaggacacagcatggacatgagggtccccgctcagctcctgggggctcctgctactctggctccgaggtgccagatgtgacatcgagctgacccagtctccatcctccctgtctgcaaccgtgggagacagtgtcaccatcacttggccgggnaagtcggaacnttcgacaccttatttaaattggtatcaacataagaccgagggaccgcccctaagcctactaatctatgctgctatcctagtttgcgtaaaggtcgggtcccagtcgtaggtcagtgcagtggattcgngggacagtattcacttcncactntacagtatcgtanacagtanaagttatttgacttaattcttacttagtacaacgataacttactagttcgtttacggaccgtaagggtactaactacgtaaactaaaacgttaaacgtaacttaggagtacgtagacctactacgtacttcgttcttacgttaccttaccgttcccgactacgttccattaccg

SEQ ID NO: 142352 - DNA, 859 bp, Homo sapiens
  misc_feature: GYAE6OF02IBRYR.46.67.G01.1.454.CMB.1.raw
  modified_base (205)..(205): a, c, t, g, unknown or other
  misc_feature (205)..(205): n is a, c, g, or t
  modified_base (210)..(210): a, c, t, g, unknown or other
  misc_feature (210)..(210): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtcctggtgcaactgcaggagtcggcccacgactggtgaggccttcgggagaccctgtccctcacctgcgctgtctntggtncctccatcgagtagttgtttcttcgtggggctgggtccggacagccgttaccgaggggaacgggtctagggaaactacgtagttaggaagttcgtactcgtaacgtagtaggtggtaacggtttaccttaagtttaaccgacggtttacccggttctacttaaccgaaaggtacgtacggtaacgttaccaaacctaagttaacgttaccttacccggttagggtaaaccctaccggttaacccaaagtaccgtaaaacttcgtttaaccgttttttacccgaaggtaaaacgtagtttacggtaacgttttacgtacggtacccggaacccgtccgtacgttaccggaaccggtacgggtttaacgttttacttaacgtcggttagaccggtaaggtacggtaaccgtattaaacgtttgttaaggtttaaggttttttagggtacggtttaacgggttttacgtttaaccgggtaaacccttaaccggtaacgtttaaccgggtaccggggtacccgggggttaccttaaccccgggtaccccgggtaacgggggttaaccgaacgggggttaaaacttccgggttaacggtcccttaaaccccggttccgtttaccccggtttaaccgtcccccgtaaaccccggg

SEQ ID NO: 142353 - DNA, 665 bp, Homo sapiens
  misc_feature: GYAE6OF02JJEYN.46.67.G01.1.454.CMB.1.raw
  modified_base (374)..(374): a, c, t, g, unknown or other
  misc_feature (374)..(374): n is a, c, g, or t
  modified_base (401)..(401): a, c, t, g, unknown or other
  misc_feature (401)..(401): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggacgaccctgtccctcacctgcgctgtctctggtcgcctccatcagtagttggtttcttcgtggggcttgggtccggcagcctccgaggggaggggctggaatacagttggaagtgtctctcagtaggtggtacggttccttagttacaggttccgtctctacaagacgtcgagtcaacctatacgtctcgtggacncgtcagcaatcctagtttcccagaatntgtagttctggtacgaccgccgtctacgacgtacggggttcttttatacgttgttcggacgtaagacggtacgtactttaagttgtaggtttagtttttacgggtagtttcggttttaacgtttccgtaaccgtacccgttaaggtacgtaccggggtacgggggtccctacccggtaccccgggtggggtacccgtaacggggttaactaccggttcgggtacctaaccccggtcctttaccggttaccgtcccctaacccgg

SEQ ID NO: 142354 - DNA, 781 bp, Homo sapiens
  misc_feature: GYAE6OF02HBVDM.46.67.G01.1.454.CMB.1.raw
  modified_base (191)..(191): a, c, t, g, unknown or other
  misc_feature (191)..(191): n is a, c, g, or t
  modified_base (221)..(221): a, c, t, g, unknown or other
  misc_feature (221)..(221): n is a, c, g, or t
tcagactagcagtacacgaccggtgctcgatttagagtatacatattgggtttggggagtctcggtcaggacacgagcatggacatgagggtccccgctcagctcctggggctcctgctactctggctccgaggtgccagatgtgacatcgagctgacccagtctcatcctcctgtctgcaaccgtggganacagtgtcaccatcaacttggacccggganaacggtcgggaactagttcgaaccaccttaatttaaacgttggtatacaacatagaccgagggaccggcccctaagctacctaatctatagctgctactccctagtttacgaccgtaaacggttcggggtacccctaagtccgggtaaggtttaccgaagggttcgggacctagggtacggtaagttccggttacgggggaactaacggttatttacctaaccgttacctaccgtaaaccccaagtttacctaaacggttaacttcccgtagtaaccgtaaccggtaaggtaacggttaactttttacggaaccttaaaccgtttacttttaaccgttacggttaactaaaccgttaaggtaaaccttttaaaccgtagtttcggttttaacccgggtaccggtaaacgggtacctaaacggttaacctaaaaccgtaaaacgtttaaaccgtaaacgttcgggttaacgtccgttacggtaaccgttaccctaacgtttacttccggttaacttccttaacgttcccttacccggtacctaccgttaccgtataacccg

SEQ ID NO: 142355 - DNA, 674 bp, Homo sapiens
  misc_feature: GYAE6OF02HV9NC.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtcgcctccatcagtagtggtttcttcgtggggctgggtccggcacgccgtccgaggggacgggctaggaatactagtggaagtgtctctctataggtggtacgtttcctattactacgtccgtctctacgaagagtcgagtccacatacttctcgtaggacctacgtaccagactaattctacgttttcccgagtaacgtagtgtacgtttctcggtacgaccccgtccgtcgtacggaaccgtaccgggttacttttacgttacgtggtcgtacggaggaacggtaccggtacttaagtttagttaggtttagtttttagggaggttttggtttacgttaccgtaaccgttaacccgtaaggttacgtacgggtaccggggtcctacccgggtaacccgggtcgggaccgtaagggtaacttcggtcggtacctaccgttccgtacccgttacgccctaacccg

SEQ ID NO: 142356 - DNA, 691 bp, Homo sapiens
  misc_feature: GYAE6OF02I59XC.46.67.G01.1.454.CMB.1.raw
  modified_base (508)..(508): a, c, t, g, unknown or other
  misc_feature (508)..(508): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccagactgggtgaggtccttggagaccctgtccctcacctgccgctgtctcgtggtcgcctcatcagtagttcggtttcttcgtggggctcgggtccggcagcctcccggaggggaggggctaggaattacgagtttaggaagttcgtactctacaagttaggttggaacggtttcctaagttacgacggttcctactctacgaagtgtcgtagtccaaccatactcgtcgtaggaccaccgtacagctaatctaacgtttcccagtaagtatggtagttcgtgtaccgaccggtcctcgtcgaaccgtgggttaccgtttacttagtgttggaccgaaggtacgtacggtnttaagttacgttagtttagtttttaggagtttagtttaacttacgtaacctacccgttaaggtacgtaccgggtacggggtcctaccccgggtcccgggtagggtacccggaagggttaaccgttccggtaccggtaccgttaaccccgttacgtttccccgtttaccgtaccccgtaacccg

SEQ ID NO: 142357 - DNA, 772 bp, Homo sapiens
  misc_feature: GYAE6OF02JJL3M.46.67.G01.1.454.CMB.1.raw
  modified_base (151)..(151): a, c, t, g, unknown or other
  misc_feature (151)..(151): n is a, c, g, or t
  modified_base (159)..(159): a, c, t, g, unknown or other
  misc_feature (159)..(159): n is a, c, g, or t
  modified_base (239)..(239): a, c, t, g, unknown or other
  misc_feature (239)..(239): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcganctgacccngtcctcatcctcctagtctacgcaaccggtgggaacgacagtcgccactactacacgttgccgggacaagtccggaaacngttacgaccaacgttatttaaaacggtggtaactctaaaccagtaacgaaccgaacggtaccggtacccctaaggtaccttaccgtaaactctaacgtcgacttcacgtaccttccgtaggtttacgacgtaacgggtaccgggtaccgtacgttaccggtaacggttactaacggggtcggtaacgtacggttcggttaagtaaccggtacggggtaactaaacggtacgttttaaccacgttacctaacctaaccggtaactaccgttaagtaacgttacctaggtacccgttaaagtagtaaacgttagtttacctaactaaacttacgttaacgtagtacaaacgtaactagtttaactacgttaacggtttcggaaccgtaacggaacgttaaccggtaaacgttaaactaaaacgtttaaaccgaaacgttacgggttaacgtacgtaaccgtaacgtaacctaacgttacttaccggttaacttactaccgtttaccgtacccgtactttaacttcgtaacttacg

SEQ ID NO: 142358 - DNA, 875 bp, Homo sapiens
  misc_feature: GYAE6OF02HRDOH.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcggcccacgactggtgaggtccttcggagaccctgtccctcacctgcgctgtctcgtggtcgcctccatcgagttagttcggttttcttcggtcggggtcgttcggggttccggacgacggtcctacccggaggggaacgggggtccgtaggtaacgttaacgtaagtttacgggaaggttggttaccttccgttacgtaagttaagggttcgggttaacgggttttacccttaagtttaaccgtacggtttcccggttaccttcgttaaccgtaacggtaacggttccggaacggttaccaaacccgtaagttaacgtaccttcgtacggaacctaccgtaccgtaacgactaaacttaccgttaacgtttttaccccgaaggtaacgtaagttacgttacgttttaccgttacggtaccggaaccccgtcccgtacgtaccggtaaccggtacgggttaccgttttaacgtttacgttacggttacggaccggtaaggtaaccggtaacggttccttaagtttacgttagtttaacggtttttcgggtaggtttacggttttacgtttacgtaacccgttaaccgtaagttaacgttccggggaaccgggtccgttaacccgggtcccggtaccggggaccggtaaacggggttaaccgttaccggtcggttacccgttacccggttaccgtttacccggttaccgaccccttaaccccggg

SEQ ID NO: 142359 - DNA, 632 bp, Homo sapiens
  misc_feature: GYAE6OF02GWXWZ.46.67.G01.1.454.CMB.1.raw
  modified_base (220)..(220): a, c, t, g, unknown or other
  misc_feature (220)..(220): n is a, c, g, or t
  modified_base (312)..(312): a, c, t, g, unknown or other
  misc_feature (312)..(312): n is a, c, g, or t
  modified_base (348)..(348): a, c, t, g, unknown or other
  misc_feature (348)..(348): n is a, c, g, or t
  modified_base (416)..(416): a, c, t, g, unknown or other
  misc_feature (416)..(416): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaaccatcacttggccgggnaagtcgaacattgactactatttaaatgtatacaacataagaccgagggaccggcccctaagcctacctaatctatgctgcactctagtttnacaaggtcgggcccagtcgagttcaggtgcaggtgntcggtaggactgtattcactctacacctatactagtaactctagactaacggtgtaaagttcgtttanaacgtttaacttacgttactacgttaacaaactaagtaaactttaactaacgtttacggtttaccgaacgaaacgggtactaaccgtaacgttaaaaccgtaaaactttaaacgtaacttggttaaccgccttacgaacccgtaacgttacttacgtttcgttacctttacgtaccctttccgttaccccgtacctaacgtttcctaaggttaacc

SEQ ID NO: 142360 - DNA, 722 bp, Homo sapiens
  misc_feature: GYAE6OF02H1HHU.46.67.G01.1.454.CMB.1.raw
  modified_base (97)..(97): a, c, t, g, unknown or other
  misc_feature (97)..(97): n is a, c, g, or t
  modified_base (191)..(191): a, c, t, g, unknown or other
  misc_feature (191)..(191): n is a, c, g, or t
tcagactagcagtacacgaccggtgctcgatttagagtatacatattgggtttggggagtctcggtcaggacacagcatggacatgagggtccccgntcagctcctggggctcctgctactctggctccgaggtgccagatgtgacatcgagctgacccagtctccatcctcctgtctgcaaccgtggganacagtgtcaccatcacgttcggccgggacaaggtcggaactgttagacctaccttattttaaagttggtaatcaatatagaccgagggaccgcccctaagctactaatctatcgctcgctactaccgtagtttcgaaccgtaaagggttccgggtaccctagttcggtacggttcgaaggttcggacgtagggtcggacgtcggtaggggaactaggttacttacgacttccgaactacctattacgagttaacttcggtacacggtaactaggtaacgttagttttacggaaccttactttaagttaccgttaacgttacctaaacgtaagttaaacttaacgtacggttttacgtttaccgggaaccgttaaaccgggacttaaaccggtaaaccttaaacggttaaaaacgttaacggtaaacttggggttaccgtacgttaccggtacctaaacgttcgtttaccgttacgtttaacccttcgttaccctttcccttacccggtacctttacgtcgttacgttaacg

SEQ ID NO: 142361 - DNA, 585 bp, Homo sapiens
  misc_feature: GYAE6OF02IENK3.46.67.G01.1.454.CMB.1.raw
  modified_base (250)..(250): a, c, t, g, unknown or other
  misc_feature (250)..(250): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcgggagaccctgtccctcacctgcgctgtctctggtgcctccatcagtgtggtttcttcgtggggctgggtccggcagctcccgagggagggctggaatacattggaagtgtctntcatagtggaggttcctattacagtccgtctctcaagagtcgagtcaccatatctctggacacgtccagcaatctagttttccctgaacgtatgagttctgtcgaccgtccgctggaccgacgggtcttttattactggtcgtacgagtggacggtcttagttatgtattttggagttgtttatttcgactaccctagagtcgacggggctcgacccgtggggaccaggggtactacgtgtaccgtacgtcctcctacgtcctaccaccgaacggtcccacgtcggttacccttccccgtcggccctaccccttaccctaccgacgacgtacccg

SEQ ID NO: 142362 - DNA, 641 bp, Homo sapiens
  misc_feature: GYAE6OF02IQ81N.46.67.G01.1.454.CMB.1.raw
tcagactagcagtacacgaccggtgctcgatttagagtatacatattgggtttggggagtctcggtcaggacacagcatggacatgagggtccccgctcagctcctggggctccctgctactctggctccgaggtgccagatgtgacatcgagctgacccagtctcatcctccctgtctgcaaccgtgggagacagtgtcaccatcacttcggccgggactaacgtacggaaccattcgactaccttaatttaaattggtattcaacatacgaccgaagggaccggccccctaagctcctaaatctaatgctgcatccgagtttcgacgaaggttggggtacccctatcggaggtttacaggtggcgaggtggtattcggagggactaagtacttttccgaactcctaccgacctatacagttaactccgtagacgaacgtggtaaagtagttttcgactacttaattacttacgtacaactaagaactttactaacgttcgtttacggaccgtaacggaactacgtaacgtaaacctaaaagttaaaacctaagttgtacggtactcgtaaccacccgttaattcgttccttacgttacctaccgttccctttacccgaccctacttacgttcgtaaccg

SEQ ID NO: 142363 - DNA, 844 bp, Homo sapiens
  misc_feature: GYAE6OF02IAXXS.46.67.G01.1.454.CMB.1.raw
  modified_base (62)..(62): a, c, t, g, unknown or other
  misc_feature (62)..(62): n is a, c, g, or t
  modified_base (203)..(203): a, c, t, g, unknown or other
  misc_feature (203)..(203): n is a, c, g, or t
  modified_base (207)..(207): a, c, t, g, unknown or other
  misc_feature (207)..(207): n is a, c, g, or t
  modified_base (233)..(233): a, c, t, g, unknown or other
  misc_feature (233)..(233): n is a, c, g, or t
  modified_base (250)..(250): a, c, t, g, unknown or other
  misc_feature (250)..(250): n is a, c, g, or t
tcagactagcagtacacgaccggtgctcgatttagagtatacatattgggttggggacctcngtgcaagacatgaagcacctgtcgtttgtcctcctgctggtggcagctcccagatgggtcctgtccctggtgcaactgcaggagtcgggcccacgactggtgaggccttcggagaccctgtccctcaccgtgcgctgtctntggngcctcatcagttagtgtttcttcggngggtccgtcgggccgcncggtccggtaccgggggagggtctaggaacttacgtaggttacggacgttcgtactcttacgagttagggtcggttacggtttacctaacgttacgacggttcccgttgttacctaacggtaaggtaccggtacgacgtacctaacctagttacgttccgtacgtacggaaccgtaccgtaccgtaagtacccgtaacgttccgttacgttttaccgaggtaacggttacgttaacggtagtttcgtacggtccgtaccccgggtccgtaccgttacgggtaacccggtaacgggtttacgtttaaaccgttaccgtgggtaaccggaaggtaccggttaacgggttaaccggtttactttaaacggtttacggtttaacggtttttaacggttttggggttaacggtttaacggttttacttaaccccggaacgttaacccgttagggttaccggttacccggggcgggttaccgtacccggttacccggggtaaccggggtaacccgtaacggggtaacttacccgggtacgttcccggtaacccgttcccggtttaacccgtttacccggtacccccgtacccgtaaccgg

SEQ ID NO: 142364 - DNA, 657 bp, Homo sapiens
  misc_feature: GYAE6OF02HR2CW.46.67.G01.1.454.CMB.1.raw
  modified_base (414)..(414): a, c, t, g, unknown or other
  misc_feature (414)..(414): n is a, c, g, or t
  modified_base (505)..(505): a, c, t, g, unknown or other
  misc_feature (505)..(505): n is a, c, g, or t
  modified_base (517)..(517): a, c, t, g, unknown or other
  misc_feature (517)..(517): n is a, c, g, or t
  modified_base (559)..(559): a, c, t, g, unknown or other
  misc_feature (559)..(559): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcggcccacgacgtggtgaggccttcggagaccctgtccctcacctgcgctgtctcgtggcgcctccaatcgagttaggttcgtttcgttgtcgggggcttcggggtccggctacgccgttacccggaggggaacggggtcgtaaggtaataccgtagttagggaagttcgtcctctcaagtagtggtacgttaccgttaataccgaggttcccgtctactacgaaggaacgttcgagtccaccgtaatactcgtcgtcgaacncgtcaagacgtaacttcgttacgttttacccagtaagtatcgtagttcgtagtccgaccgtcgcgtgacgtacggttgtttatcgtggcgnaggtacacggtnaagttttgtagtttagtttggagttcgttattcgacctacgngtaacgtcggacgggtccgtacccggccgttacggggaccgtaaggtaacgtacgttcggtcccgaccgttcccgttacgtaccgtcctaaccccggg

SEQ ID NO: 142365 - DNA, 669 bp, Homo sapiens
  misc_feature: GYAE6OF02G1MPP.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttgccgggcaagtcggaacattgacacctatttaaattggtatcaacatagaccagggacggcccctaagcctcctaatctatgctgcatccagtttgacaaagggttcggggtcccagtaccggaggttcaggtggcaggtggatcgtagggacagtactttcactcgtacacctataccgaagttaactctacgaccgtaacggtagtaaaggttattttacggaccttaaacgtttatttaacgttacgtaactaaacctaagtaaactttaacgtaaagttttcggttttaaccgggaaccgtaaacgggtaaccaaaccggtaacttaaaaccgtaaaagtttaaaccgaaacgttggtacggtacgttacggtaccctaaccgttacttaccgttcgttacctttaccgtaacctttcccgttacccccgtaccttacttccgttacgtaaccg

SEQ ID NO: 142366 - DNA, 588 bp, Homo sapiens
  misc_feature: GYAE6OF02HAAMX.46.67.G01.1.454.CMB.1.raw
  modified_base (250)..(250): a, c, t, g, unknown or other
  misc_feature (250)..(250): n is a, c, g, or t
  modified_base (329)..(329): a, c, t, g, unknown or other
  misc_feature (329)..(329): n is a, c, g, or t
  modified_base (346)..(346): a, c, t, g, unknown or other
  misc_feature (346)..(346): n is a, c, g, or t
  modified_base (358)..(358): a, c, t, g, unknown or other
  misc_feature (358)..(358): n is a, c, g, or t
  modified_base (375)..(375): a, c, t, g, unknown or other
  misc_feature (375)..(375): n is a, c, g, or t
  modified_base (385)..(385): a, c, t, g, unknown or other
  misc_feature (385)..(385): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtcgcctccatcagtagtgtttctcgtggggctgggtccggnagcctccgagggaaggggctggaatactattggaagtgtctctcatagtggaggttcctatacagtccgtctctcaagngtcgagtcacatatctntgacacgtcagnactctacgtttccaganatgtacgttntgcgaccgcgctgacgtcgggtctttatcgtgtgcgagacgcgtatattagtagttgttttaggagtttggtttactttaccgtaactacttagacgttcgggtaccgggtccgttacccggtacccggtcggggtaccaaggggttaacttacggtaccggttaccgtcccgttacgtttcccggtactccccgtaacccgg

SEQ ID NO: 142367 - DNA, 784 bp, Homo sapiens
  misc_feature: GYAE6OF02HTCPG.46.67.G01.1.454.CMB.1.raw
  modified_base (197)..(197): a, c, t, g, unknown or other
  misc_feature (197)..(197): n is a, c, g, or t
tcagactagcagtacacgaccggtgctcgatttagagtatacatattgggtttggggagtctcggtcaggacacagcatggacatgagggtccccgctcagctcctgggggctcctgctactctggctccgaggtgccagatgtgacatcgagctgacccagtctccatccctccctgtctgaccaaccggtggganactagtgtccaccatcacgttcggccgggtacaaaggtcggaaactagttcgaacctacctttaaatttaaagttggtaactacaaactaagtaacgaccgaacggggaccggtacccctaagtcctacgtaatctatcgctgactagtcctagtttcgacgtaaacggtcgggtaccctagtcgtaggtcgtaggtacggcgtacggtaggtacgtcggtaggggtaactaacggttactttaccgtaaccgttccttacccgtaaaccgtacttaccgtaaacgtttaacgtaccggtttacggtaacccggttaaaacgggtacggttaaacggtttaacgttttacggtaaacctttaaaccgttttaacgttaacgttacggttaacaaacgtaaagttaaactttaacgttaacggtttacggtttacccggaacgtaaaccgggaacctaacgtaaacgttaaaactaaaacgtttaaacgaagttccggtaggtaccttacgtaacccaacgttaccttacgtccggtttaaccttacctacgttacccctacccggtaccttacgttccgtaacgtac

SEQ ID NO: 142368 - DNA, 595 bp, Homo sapiens
  misc_feature: GYAE6OF02GOU05.46.67.G01.1.454.CMB.1.raw
  modified_base (192)..(192): a, c, t, g, unknown or other
  misc_feature (192)..(192): n is a, c, g, or t
  modified_base (216)..(216): a, c, t, g, unknown or other
  misc_feature (216)..(216): n is a, c, g, or t
  modified_base (226)..(226): a, c, t, g, unknown or other
  misc_feature (226)..(226): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttgccggnaagtcgaacnttgacactatttaatggtatcaacatagaccgaggacggcccctaagctcctaatctatgctgcatccagtttgacaaaggtcggggtacccatcggtaggttctaggtggcagtggactgtagggacagtactttcgacttctacaccatcaagttaactcgtagtacaaacggtgtaagtagttttcgacttaaacgtttattacgttagtactaaacctagtaaactttaactaagtttcgtttacggaaccgtaagggtaacctacgtaaccttaaactaaaacttaaaccgaacgttagagtactacgacgtaacctaattctggttaccttcgattcccttacccgacctattacctagtaac

SEQ ID NO: 142369 - DNA, 666 bp, Homo sapiens
  misc_feature: GYAE6OF02ISKHT.46.67.G01.1.454.CMB.1.raw
  modified_base (192)..(192): a, c, t, g, unknown or other
  misc_feature (192)..(192): n is a, c, g, or t
  modified_base (303)..(303): a, c, t, g, unknown or other
  misc_feature (303)..(303): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgcaaccgtgganacagtgtcaccatcacttggccgggacaagtcggaacattgacaccttaatttaaattggtatacaacatacgaccgagggaccggacccctaagctcctaatctatgctncactcctagtttcgacgtaaggtcgggtacccagtcggtaggttcagtggacaggtggatcgtagggactagttacttcactcctcaaccgtactacgtaagtactccgtagactaaacggtgtaaagttgtttacgacttaaactttattaacgtagtacctaaacgtaacgttaaatttaacctaagttttacggtttacccggaacgtaaacgggtacctaaaccgtaacttaaaaccgtaaaaagttaaacccgttaagttacgggtacgtaccttagtaacccctaacgttactaccgtttacgttacccttactaaccgtttccccgttccccgtacctacgtttacctagttaacc

SEQ ID NO: 142370 - DNA, 611 bp, Homo sapiens
  misc_feature: GYAE6OF02IMTZF.46.67.G01.1.454.CMB.1.raw
  modified_base (251)..(251): a, c, t, g, unknown or other
  misc_feature (251)..(251): n is a, c, g, or t
  modified_base (600)..(600): a, c, t, g, unknown or other
  misc_feature (600)..(600): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggcctttcggagaccctgtccctcacctgcgctgtctctggtgcctcatcagtagttggtttctcgtggggctgggtccggnacgcctccgagggaggggctaggaatacattggaagtgtactctcatagtggtacggttcctattacagttcccgtctctacgaagagtcgagtcacatatctcgtgactacgtcagtcaatctacttttcccagacgatgtacgtttcgtgtacgcccgcgtctacgacgtacggggttcttttagttacgttggttacggacgaggacgacgtactagtttagtgttagtttttgggagtttagttctttaccgaactacctagtacgtcggtacggggtcctccgtcccgggtacgggaccgaagggttaacgtacgtcggtaccgtaccgttccgttacccgtcncccgtaacccg

SEQ ID NO: 142371 - DNA, 633 bp, Homo sapiens
  misc_feature: GYAE6OF02FVGNL.46.67.G01.1.454.CMB.1.raw
  modified_base (334)..(334): a, c, t, g, unknown or other
  misc_feature (334)..(334): n is a, c, g, or t
tcagactagcagtacacgaccggtgctcgatttagagtatacatattgggtttgtcctcctgctggtggcagctcccagatgggtcctgtccctggtgcaactgcaggagtcggcccacgactggtgaggccttcggagaccctgtccctcacctgcgctgtctctggtcgcctccatcagtagtggtttctcgtgggctgggtccgcagcctccgaggggaagggctggaaatcattggaagtgtctctcatagtggagttcctattacagtccgtctctcaaggagtcgagtccaccatatctctggacacgtccagcaatcagttttcccngtagatgagtttctgtcgaccgcgcttgaacgtcgggtcgttttattactggtgacgagacggaccggcttaattagtgttagtttttgggaggtttgttacgtttcgactaccctagtctcgggaccggggtctaccgggtacccgtggggtaccaggggtaactcggttcgtaccgtaccgttcttacccgttaccgtcccgtaaccaacccggtaacgggcccctacggttacccggttccccgtttccccgtacggccccttaccccgtacccgtaccctaaccggcgtaccccg

SEQ ID NO: 142372 - DNA, 604 bp, Homo sapiens
  misc_feature: GYAE6OF02IW4JI.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtgggagacagtgtcaccatcacttgccgggcaagtcgaacattgacacctatttaaatgtatcaacatagaccagggacggcccctaagctacctaatctatgctgctatcctagtttcgacgaaaggtcgggtcccctaatcggtaggttacgagtggcgagtggaagtcgtagggacagtatttcactctcaaccatacaagttaactcgtcgacgaacgtagaagttatttagacttaaactttatttactagtaacaactaagtaaacttactaattcggtttacgaaccgaacggtaactaacgtaactaaactaaaacttaaacgtaaacgtcgttacgctacggacctaactacttacgttacgttctttaccgtacttacccgtttacccgacctaacttccgtagtaacg

SEQ ID NO: 142373 - DNA, 762 bp, Homo sapiens
  misc_feature: GYAE6OF02HMBPK.46.67.G01.1.454.CMB.1.raw
  modified_base (172)..(172): a, c, t, g, unknown or other
  misc_feature (172)..(172): n is a, c, g, or t
  modified_base (213)..(213): a, c, t, g, unknown or other
  misc_feature (213)..(213): n is a, c, g, or t
  modified_base (644)..(644): a, c, t, g, unknown or other
  misc_feature (644)..(644): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggtccttcggagaccctgtccctcacctgcgctgtctctggtncctccatcagtagttggtttcttcgtggggctggggtccgnagcctcccgaggggaacgggctaggaatactagttaggaagtgtctctacagttagtggtacggtttccttaattacgacggttcccgtcttacctacaaggagttcgacgtcaccgattacttcctcgtacggaacctaccgtaccgagacgtaacttccgttacgtttttccccagtaacgtattaggtacgtttctaggtaccggacccgtcccgtacgttacggaacccgtacggggtttactttttaacgtttaccgttgggttacggacggtaaggacgggtacggtacctttaatttagttaggtttagtttttacgggtaaggtttggtttaacgtttaccgtaccgttaccctaggtacgtcgggtacggggtcctacccggtacccggttggggaccgtagggtaacttcgtcggttaccnccgttcgtaccgttaccgtccgtacccgaaccggtaccgggtaccctacgtttccccggttacccttccccgggtcgtacccctaccccgttacccgtacccgtaaggcccgtacccg

SEQ ID NO: 142374 - DNA, 797 bp, Homo sapiens
  misc_feature: GYAE6OF02JY5BC.46.67.G01.1.454.CMB.1.raw
  modified_base (168)..(168): a, c, t, g, unknown or other
  misc_feature (168)..(168): n is a, c, g, or t
  modified_base (192)..(192): a, c, t, g, unknown or other
  misc_feature (192)..(192): n is a, c, g, or t
  modified_base (211)..(211): a, c, t, g, unknown or other
  misc_feature (211)..(211): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccagactggtgnggccttcggagaccctgtcccctnacctggccgccttgtcctntggtcgcccttccatccgaggttggttcggttttctcgtcggggggtcttcgggggtcccgcagtccgtacccggaggggaaggggtcctaggaactacgagttacgggaagttcgtcctctcagtaggtcggtaaggtttcctaagttacacggttcccgttctaccgtactaacggacgttccggtaacgtacctaaccctaagttacttccgttcgtaggtaacctacggtacccgagactaacgttccgttacgttttacccaggtaagagtttcgtaacggttccgttaggtaccggaccccggtccgacgttacggaaccgtacgggtttccgttttaacgttcgtaaggtttcggacggtaacgggtacggttaacccgggttctttaaacgtttacgttaggtttttaaggttttacgggttaacgtttagggttttacctttaccggaaccttacccggttagtacggttaccgggacccggggttctaccccgggtacccggtcggggtaaccagggttaaccgttcggttacgggtccctaacccggttcttacccggtaactccccgtaacccg

SEQ ID NO: 142375 - DNA, 597 bp, Homo sapiens
  misc_feature: GYAE6OF02JPNHR.46.67.G01.1.454.CMB.1.raw
  modified_base (152)..(152): a, c, t, g, unknown or other
  misc_feature (152)..(152): n is a, c, g, or t
  modified_base (194)..(194): a, c, t, g, unknown or other
  misc_feature (194)..(194): n is a, c, g, or t
  modified_base (381)..(381): a, c, t, g, unknown or other
  misc_feature (381)..(381): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcganctgacccagtctccatcctccctgtctagccaaccggtgganactagtgtccaccatcacgttggccgggtcaaggtccgaactgttcgactaccttattaattggatcaacatacgaccgagggaccgtacccctaagcctaccgtaatccttaatgctgccaactccgtagttcactaaaggtcgggtacccagtcggtagttcagtgcgtagtgtatcgaggtacngttatcctactcgtaccacgtatactacgttaatcgtacgacgtaagttcggaattagtttcgtacctaacgtttataaccgtcgttacaacgtataaacttacagtttcgttacggaccgacggtaactaccgaattactaaaacttaacgacttggactcgttacgactaacgattcctagttacctacgtacttcgaccctagtctactgtac

SEQ ID NO: 142376 - DNA, 743 bp, Homo sapiens
  misc_feature: GYAE6OF02HLYDH.46.67.G01.1.454.CMB.1.raw
  modified_base (212)..(212): a, c, t, g, unknown or other
  misc_feature (212)..(212): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggcctttcggagaccctgtccctcacctgcgctgtctctggtgcctccatcagtagtgtttcttcgtggggctgggtcccggnagcctccgagggagggctaggatacattggaagtgtctctcagtagtggagttctattacgagttcctcgtactcgaagagtcgagtacaccatactcgtcgtagaccgaccgtaccgagacctaattccttacgttttcccctaggtaaacgtatgtacgttcgtacggtgtacccggtaccgtcgtacgtaaccggtacgggtttccgttttagttacgtggttacggtcgaaggaccggtacggtacgttaacgttacgttaggtttacgtttttagggtaggtttaggttttacgttaccgtacctaacccggttaacgtacgtacgggtacggggtccgttacccggaacccgggtaccgggtaccggtaagggtaaccgttaccgtcggttaccgtaccgttcccgttaccgttccgtaccctcccgaacccgggtacgggtaccccgtaccggttacccggttccccgttacccccgtccggtaccctaccccgttaccccgtaaccgtaccggacctccccgg

SEQ ID NO: 142377 - DNA, 816 bp, Homo sapiens
  misc_feature: GYAE6OF02JSQGN.46.67.G01.1.454.CMB.1.raw
  modified_base (204)..(204): a, c, t, g, unknown or other
  misc_feature (204)..(204): n is a, c, g, or t
tcagactagcagtacacgaccggtgctcgatttagagtatacatattgggtttggggtagtctcggtcaggacacagcatggacatgagggtccccgctcagcctcctggggctcctgctactctggctccgaggtgccagatgtgacatcgagctgacccagtcctccatcccgtccctgtctgacaaccgtggagccagttnccacctatcacttggacccgggctaaggtccggaacattccggacctaaccttaattttaaaagtcggtaactactaacataacggaccgagggtaaccccggaccctaacgtaccgtacctaacgtactacttacggcctagtccgaacttccgttacgttttacggtaaccgttaaacggtccgggggttaccctaacggttaccggttacggtttaaccgtaaggtccggtacggttaaggtacggttacgttacgggtaacggacggtaaccggttagttttaacccgtaccgtttaccttaacccgacccgtaagttacccgttaaaggttaacttacccgtaaccggtaacgttaaaccggggtaaacttaaggtttaaacttttacgtaaaccgttaaccttttaaacgtttacctttacggtaaacccgttaggtaaacttaaacgttaacgtttaaacgtttccgtttaacgggtaaccgtaaccgacgtaaccgtaactaaacgttaaaacgttaccgtaaactggttacgacgtctaccgaaactcgtacgttcttaccgttcttaccgttccgtaaccctactaccgttactacgtaacg

SEQ ID NO: 142378 - DNA, 664 bp, Homo sapiens
  misc_feature: GYAE6OF02FOM3R.46.67.G01.1.454.CMB.1.raw
  modified_base (203)..(203): a, c, t, g, unknown or other
  misc_feature (203)..(203): n is a, c, g, or t
  modified_base (271)..(271): a, c, t, g, unknown or other
  misc_feature (271)..(271): n is a, c, g, or t
  modified_base (335)..(335): a, c, t, g, unknown or other
  misc_feature (335)..(335): n is a, c, g, or t
tcagactagcagtacacgaccggtgctcgatttagagtatacatattgggtttggggagtctcggtcaggacacagcatggaccatgagggtccccgctcagctcctggggctcctgctactctggctccgaggtgccgagtactgtgacgatccgagctgacccagttcgtccgatcctaccgtgtctcgacaaccgtgganacagtcgtcacatcgacttgccgggctaacgtcggaacacgttgacctacctatttaaattggtactnaaccattacggacctagggacgcccctaagtctacctatactatgacttgacacgtccagtttnacgaaagtcggggtacccattcggaggttccaggtcggcgtagtcggaactccgtaggggaactacggtacttttcaaccgtttcgacgtaaccgtattacccgtaagttaactcgtacgtaccgtaaggttcgtaaacgttagtttcgaacgtaactttaagttacctacgtacaaactaggtaaatacggttaactacggttttacggaacgttacgggaactcgtaactaacgtaaactaaaccgtagtacgtcggacttacggctaacggtactaacgtcgtacctttacacgttcccttaaccgtcctaacggtccttacgaac

SEQ ID NO: 142379 - DNA, 839 bp, Homo sapiens
  misc_feature: GYAE6OF02HJ0O8.46.67.G01.1.454.CMB.1.raw
  modified_base (173)..(173): a, c, t, g, unknown or other
  misc_feature (173)..(173): n is a, c, g, or t
  modified_base (209)..(209): a, c, t, g, unknown or other
  misc_feature (209)..(209): n is a, c, g, or t
  modified_base (234)..(234): a, c, t, g, unknown or other
  misc_feature (234)..(234): n is a, c, g, or t
  modified_base (246)..(246): a, c, t, g, unknown or other
  misc_feature (246)..(246): n is a, c, g, or t
  modified_base (249)..(249): a, c, t, g, unknown or other
  misc_feature (249)..(249): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctcgtggtcncctcatcagtagtgtttcttcgtgggctgggtccgnagctccgagggaggctaggaatacnttaggagtgtcnctnagttagtggtacgttacctagttacacgtccgtcttctacaagagtacgagtaccaacctagtacttaccgtctacggacctaccggtaccaagtacctaagttccttaacgttttaccccgtaggtaaacgtacgttagtacgttcgtacggtaccgacccggtccgtaccgtacggtaccggtacggggtttacttttaacggttacgttaggtcggacggtaacggacggtaccggtactttaagttagtttacgtttaaggttttacgggtaggttttacggttttaacgtttaccgaaacccgttaaccgttaagtaaccggtaccggggtaccggggtccctttacccgggtaacccgggttacggggtacccgtaaacggggttaaccgttacccgggttaccggttaccccggttacccgttaccgttaccccggttaccgtaccccgttaacccggtaacccgggtaaacccgggtccccgtaccgggtttacccccggtttacccccgtttcccccgggttaccgtacccccgttacccccgttaccccggtaaccggtaacccggtacctacccccggg

SEQ ID NO: 142380 - DNA, 669 bp, Homo sapiens
  misc_feature: GYAE6OF02GV1KZ.46.67.G01.1.454.CMB.1.raw
  modified_base (481)..(481): a, c, t, g, unknown or other
  misc_feature (481)..(481): n is a, c, g, or t
  modified_base (599)..(599): a, c, t, g, unknown or other
  misc_feature (599)..(599): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatccctccctgtctgcaacggtgggagacagtgtcaccatcacttggccgggacaaggtaccggaactattacgactaaccttaatttaagttggtaactacaactatacgaccgagggaccggtacccctagcctacctaatactatgctcgactacgttcctaggtttcgaacgtaaacgggtcgggtccccagtaccggtaggttcagggtggacgtaggtggtacttcggtgggacgagttacttacgaccttctactactatacgtaatagtactgacgtaagtagtaagttagtttacgacttaattnttaacttgacctaaactacgtaattaacgtagttttacggttacgggaaccgtaacggtacctaacgtaaccttaaaccgtaaaactttaaacggtaaccgttgtaccggacgttacnccgtaaacgttacttccgtactttccttaacgtacctttccgtaccccgtaccttattccgaacgtaccg

SEQ ID NO: 142381 - DNA, 771 bp, Homo sapiens
  misc_feature: GYAE6OF02IYME9.46.67.G01.1.454.CMB.1.raw
  modified_base (208)..(208): a, c, t, g, unknown or other
  misc_feature (208)..(208): n is a, c, g, or t
tcagactagcagtacacgaccggtgctcgatttagagtatacatattgggtttgtcctcctgctggtggcagctcccagatgggtcctgtccctggtgcaactgcaggagtccgggcccacgactggtgaggccttcggagaccctgtccctcacctgcgctgtctctggtgcctcatcagtagtggtttctcgtgggctgggtccgnagctccgagggagggctaggaatacagttggaagtgtctctcagttaggttgggggttcctagttaccagtcccgttctctacgaagtaggtacgagttcacctatatctcgtacggactacgtccacgacactctacgttttcccagaagtctgtacttcgtaggtcgacccgtccgtcgtacgaaccgtacgggttacgttttaataccgttggtcgacggaggtacggtaccggtacttaagtttacttcggtttaggtttttacgggaggtttacggttttacgttaccggtaaccctaacccggttaggtaccgttccggggaccggggggtacccctaccgggtacccccgggtggggtaccccgtaaggggtaacgttcccggttacgggttccgtaaacccgttccttacccgttacgtaccccgtacccgtaaccggaacccggggtcccttacccggttacccgggtttcccccttaacccccggttccggtaacccccttaccccgttaccccggttacccgtaaccggtacccggtacccgttaccccggg

SEQ ID NO: 142382 - DNA, 600 bp, Homo sapiens
  misc_feature: GYAE6OF02HFQEI.46.67.G01.1.454.CMB.1.raw
  modified_base (315)..(315): a, c, t, g, unknown or other
  misc_feature (315)..(315): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtcgcctccatcagtagtgtttctcgtggggctgggtccggcagctcccgagggaggggctaggaatacgattggaagtgtctctcatggtggaggttctattacgngtcctctctcaagagtcgagtcacatatctcgtgacacgtcagcaatctagtttcccagaagatgtacgttctaggtcgacccgccgtctacgaaccgtacgggttcttttacttacgtgtcgacggaggtaaggaccgtagttatttacgtgtttaacgtttttagggagttttaggttttacttcgaaccgtaccgtaagtcgtaccgggacggggtcctacccggtacccggtgggaccgaggtactacgtcggtacctccgtcttccgtacgccgtacccg

SEQ ID NO: 142383 - DNA, 879 bp, Homo sapiens
  misc_feature: GYAE6OF02H4S78.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggcctcgaggtgccagatgtgacatcgagctcgacccagtcctaccacttccctccctgtctgaccgtaaccggtgggacgacgaggttcgtccaacctatacctaccgtttccgggacccggggtacgtaaacggttaccgggaaactacgtttacggaaccttaaccgttttaaagtttttaaaacgtttacgggttaactaaccgtaaaactaacgttaaacggaaccgggaaccgggggtaaccccggtaaccccccgttaaagacccgtttaacccttaaacgttaccttaagtcgtacctacggtacctaaccgttacccgttaaggtttacgtaaccgtaaacggggtttcggggtaccctaacggttccgggtaaggtttccgaagggtcggtacgtacgggttacggtacgtcggtaacgggaacgtagttaaccgtttccaaccgttaccgtaccgacctacgtttaccgtaacgtttaccgtacgttacggtaaccgtaacgttaaggttactttagtttaccgaacttaacgtttactacgttacgtaactaaacgaacgtttaaacttactacggtttcggtttaacccggaacggaacgttaacccgtaacgtaaacgttaaaccgtaaacgtttaaacgaccggttagtaccggttactaccggaaccctacttaccgttcgtaccgtttacctcgttaccgtccccgttaccgtaaccctttagttacgtaccgtaaccg

SEQ ID NO: 142384 - DNA, 928 bp, Homo sapiens
  misc_feature: GYAE6OF02IIL9S.46.67.G01.1.454.CMB.1.raw
  modified_base (224)..(224): a, c, t, g, unknown or other
  misc_feature (224)..(224): n is a, c, g, or t
tcagactagcagtacacgaccggtgctcgatttagagtatacatattggggtttgggggagtctcggtcaggacacagcatggacatgaggggtcccccgctcagctcctgggggctcctgctactctggctccggaggtgccagatgtgacatcgagctgacccagtctccatcctccctgtctgcaacggtgggagacagtgtcaccatcacttggccgggnaaggtacggaaactagttacgacctaaccttaattttaaaagttggtaacttaccaaacgtaacgtaacggaacccgaacggggggaacccggtaccccccttaaaggtacccttaacccttaaattaccttaacgttcggtaccttcgtacctacgttaccctaaggttttacgaccgtaaaagggttccgggggtaacccctaagttaccggtaacggtttacgaggtcgggtacgtagggttcggtacgtacggtgggtaactaagttacgttttaccaccgttactaccgtaccctaggttaccttaaagttaacttcgtacggaccttaaaggtacggttaaaacgttaacggtttttacgaaacctttaaaacgttttaacgtttaaccgttacgtaaaccgtaaagttaaaccgttaaaagtttaaaccttaacggttttaaccgggttttaacccgggtaaacccgggtaaaacgggggttaacccccttaaaacgggtaaacccctttaaaaagtttaaaaaaacccggtttaaaaccggtaaaaccggtttacggggtaaccggggttaccccttaacgggtaaccccgtaaaccgtttaacctttacccgggttaacttttacccgtttacccgttaaccgtttaccccggtttacccccctaacggtacctttttacccgtaactttcccgg

SEQ ID NO: 142385 - DNA, 654 bp, Homo sapiens
  misc_feature: GYAE6OF02ISEC8.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttcgtgggctgggtccgcagctcccgagggaagggctggaatacagttggaagtgtctctcatagtggaggttcctattacagtccgtctctacaagagtcgagtcaccatactctctggacacgtccagctaatctacgttttcccagaagatgtagttctgtcgaccgcgctgacgacgggtctttatacgtgtcgcgagacgtacggcttagttagtgttagttttgggagtttaggtttactttaccgactacccgtagacgttcgggaccggggtcctccggacccggtacgggggacctaagggtaacttacgtcgggttcctaccgttccgttaccgttacgacccgttaccccgaacccggtaaccggggtacccctacggttcccggttccccgttttcccccggtacgggtaccccttacccccgttacccgtacccgaacgtcccgtacccg

SEQ ID NO: 142386 - DNA, 597 bp, Homo sapiens
  misc_feature: GYAE6OF02GK67Q.46.67.G01.1.454.CMB.1.raw
  modified_base (234)..(234): a, c, t, g, unknown or other
  misc_feature (234)..(234): n is a, c, g, or t
  modified_base (318)..(318): a, c, t, g, unknown or other
  misc_feature (318)..(318): n is a, c, g, or t
  modified_base (342)..(342): a, c, t, g, unknown or other
  misc_feature (342)..(342): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtgtttctcgnggggctgggtccgcagctccgagggagggctggaatacattggaagtgtctctcatagtggaggttcctattacagtccgtctntcaagagtcgagtcactatatctntgacacgtcagacaatctacgttttcccagaagtatagtacgttcgtacgtacgacccgtccgcgtacgaccgtacggggttcgtttacgttacgtggttacgcgtaggacggacggtcttaattagtagttagttttggagtttggttatttccgactaccgtagtcgtacggtcggggctccggtaacccggtgggaccgtagggtaacgttacgtcggtccgtacccgttcctaccgttacgcccgtacccg

SEQ ID NO: 142387 - DNA, 644 bp, Homo sapiens
  misc_feature: GYAE6OF02JZ14Z.46.67.G01.1.454.CMB.1.raw
  modified_base (228)..(228): a, c, t, g, unknown or other
  misc_feature (228)..(228): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggagacagtgtcaccatcacttggccgggcaagtcggaacnttgacaccttatttaatggtatcaacatacgaccagggaccgccctaagctctaatctagtgctgcactctagtttacgacgaaaggtcgggtcctagtcgtaggttcgaggttcggctaggtggatcgtaggactagtattcactctacgtactatctagtactcgtacgacgtaacgtagaattagttttacgacttaactttagtttaccgtagttaacgaacgtaagttaactttaactaagtttcggttttaccgacgtaacgggtacctaacggttaactaaacgttaaaacgttaaacggtaaccgttagtacggtactacggtacctaccgttaacgttcgttaacgtttacccgttaacgtaccgtttaccgttaccccgtaccttacgttaccgtacgttaacccg

SEQ ID NO: 142388 - DNA, 626 bp, Homo sapiens
  misc_feature: GYAE6OF02G7TDI.46.67.G01.1.454.CMB.1.raw
  modified_base (230)..(230): a, c, t, g, unknown or other
  misc_feature (230)..(230): n is a, c, g, or t
  modified_base (233)..(233): a, c, t, g, unknown or other
  misc_feature (233)..(233): n is a, c, g, or t
  modified_base (285)..(285): a, c, t, g, unknown or other
  misc_feature (285)..(285): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccggtgggagacagtgtcaccatcacttgccgggacaagtcggaacnttnacactatttaatgtatacaacatagacaggacgccagctctaatctatgctncatcctagtttgacaaggtcggggtcccagtcgtaggtcgagtcggactaggtgactcgtagggatagtacttcgaacctctacaacgtaatcgtaagttaatcgtacgtaacgtaaacgtagtaaaaggttacttttaacggaacccttaaatttaacgtttacgttacgttacgtaaaactaacgttaaaacttacgtaaacgttacggttttacggaaccgtaaacgggtaaccaaacgtacttaaactaaaactttaaacgaaccgtagtacgtatacctaacacctattctacgttacttacgactttcccggtacctaccgtatactagttaacg

SEQ ID NO: 142389 - DNA, 626 bp, Homo sapiens
  misc_feature: GYAE6OF02GY0ZO.46.67.G01.1.454.CMB.1.raw
  modified_base (325)..(325): a, c, t, g, unknown or other
  misc_feature (325)..(325): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtcgcctcatcagtgtgtttctcgtgggctgggtccgcagcctccgagggagggctggaatacagttggaagtgtctctcataggtggaggttctattacgagtccgtctctcaagngtcgagtacacatatctctggacacgtcagacatctacgttttccagaagtactgtagtttcgtgtcgacccgtccgcgtacggtaccgacggggttcttttaacgttacgttcggtacgtacggaggtacggacgtcttaagttagtagtttacggttttggtagtttggtttaacttcgtaacctaccgtagtacgtccgggacggggtcctacccgggtcccggtaggggtaccaacggggtaacttacggtacggttcccggtaccgttcccgttacgttaccgcccttaaccccgg

SEQ ID NO: 142390 - DNA, 902 bp, Homo sapiens
  misc_feature: GYAE6OF02I36QJ.46.67.G01.1.454.CMB.1.raw
  modified_base (880)..(880): a, c, t, g, unknown or other
  misc_feature (880)..(880): n is a, c, g, or t
tcagactagcagtacacgaccggtgctcgatttagagtatacatattggggtttggggagtctcggtcgaggacacgacgcagtacggacagtacggacgggtccccgctacgagtccttccggtcggggcctcctcgtccttaccgttcgcggtccgtaccgggacgggtcgaccgaacgtagtggtacgaacgtagtcgacgcgtacgacccgtacgtcctccctaccgttcccttccgtgttccgacgaccggtaacgggtgacgtaccgtcgttcgaccaacctctcctaacggtccgggaccggacgtaacggtacggaactaggttaccgaacctaaccgtttaatttaaacggttacgtaaccttaacgaaaccgagtaaccggaaccgggtacgggtaacccggtacccggtaactccttaaccgttacttaccgttacgttacgaccggttctaccgtaaccgttcccggtttaagggttaccgaaccgggtaaaccgggtttccgggtacctacgggttacggttacgtacggtacggtacggtacgtacggggcgttaacggcggtaaccgggtagtacgttaccttacgtaccgttacctaccttaacgacgtttacgtaactacggttacgtacgtaacgtaaacgggtttcgaaaggttttcttaacggttaaaccctttaaggtacctttacgaacgtttaaccggaacttaattaacgttacgttacggtttactaaccggtaacgggtaaggtaccttaaaccgtaacctttaaaaccggtaacgtttaaaccgaggttacggaccgttacgtactaaccgtagttaccgacctttaagtcctttaaccgacgttaccccgtntaactaccggtttcgaacttcg

SEQ ID NO: 142391 - DNA, 814 bp, Homo sapiens
  misc_feature: GYAE6OF02HT5W9.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtcccctcacctgcgctgtctctggtcgcctccatcagttgtgtttctcgtggggctgggtcccgcacgcctccggaagggagggtctaggaatacgtagttaggaagttcgtctctacgtagttaggtggttacggtttacctaagttaccgtacgttacccgtctaccgtaacgaacggtcgttaccggtacgtaccaacctattactccgtaccgtacggacctacgtcccaagtacctaacgttccgttaccgttttaccgagtatagtacgtacgttcgttacggtaccggtacccgccgttacgtacggtaccgtacggggtttactttaacgtacgtggtaccgaggtacggacggtacggtttactttaagttacgtttagtttacggttttagggtgttttacgtttaacggttacccgtaaccgttaccggttaggtaacccggtaccgggggtcccggtacccgttacccgggtaacccgggtacgggtaaccggtagggtaaccgttcgtccggttacccgttacccggttcccttacccgtacccgtaccctaccccggtaccggtacccggtacccgttcccgggttccccttcccccggtacccgtaccgtcccccttacccctacccggtaacgcgtaccccggtaccccgg

SEQ ID NO: 142392 - DNA, 735 bp, Homo sapiens
  misc_feature: GYAE6OF02JPVP2.46.67.G01.1.454.CMB.1.raw
  modified_base (171)..(171): a, c, t, g, unknown or other
  misc_feature (171)..(171): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtncctccatcagtagttggtttcttcgtgggctgggtccggcagtcctccggaagggaacgggctggaactacgagttaggaagtcgttctcgtcaagttaggtggtacggttccttagttaacaggttaccgtcgtctacgaagtcgtacgagttaccaccgtatactctacgtaggacctacgtccagacaacgttctacgttttacccagaacgtagtagtacgttactgtacgaccgtcgactacgacgtacggtactttacttacgtcgtagacgtagtacgtacggtattaacgttacgttagttacgttttggaagtttcggtttaacttaccgttaaccgtaccgttagtaccgttacggggtaaccggtcgttacccggtaccggtacggggacgttaacggggtaaaccttcggttaccgttaccgtaccggttacccttcggttaaccgtccctacccgtaacccggtaaccggtaccgacggttaccccggttacccgtttcccccgtacggtaccccttaccccgtcccgtacccggtacgtacccgtacccg

SEQ ID NO: 142393 - DNA, 351 bp, Homo sapiens
  misc_feature: GYAE6OF02GR6X8.46.67.G01.1.454.CMB.1.raw
  modified_base (350)..(351): a, c, t, g, unknown or other
  misc_feature (350)..(351): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacagtcgagctgacccagtcctccactcctccctgtctcgccaaccggtgggagacagtcgtacaccatctacgttcggccgggactaacggtacggaactattacgacctaccttaattttaaagttggtaatacaacatacgaccgagggaccgaccctaagcctacctaatctatgctgcactctagtttcgacgtaagggtcnn

SEQ ID NO: 142394 - DNA, 627 bp, Homo sapiens
  misc_feature: GYAE6OF02HXC0C.46.67.G01.1.454.CMB.1.raw
  modified_base (471)..(471): a, c, t, g, unknown or other
  misc_feature (471)..(471): n is a, c, g, or t
  modified_base (566)..(566): a, c, t, g, unknown or other
  misc_feature (566)..(566): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttcggccgggcaaggtcggaactattgacaccttatttaaagttggtaatacaacatagaccgaagggaccggacccctaagcctacctaatcctatgctgcatccgtagtttgacgaaaggtcgggtacccagtcgaggttcaggtggacagtggatcgtggacagtattcactcacacatcaagtactcgtagacgtaagtgaaagttacgtttagacttaaactttacttacttacgtaacaacgtaagtaaactttaanaaacgttttcgttacgggaccgtaaacggtacaaaccgtaacttaaactaaaactttaaacgaacgttacgtacgtacgtacgtaccgtaacctnttaccgttacgttacttaccgtactttacccgttacccggtactacgttacgtacgtaacg

SEQ ID NO: 142395 - DNA, 667 bp, Homo sapiens
  misc_feature: GYAE6OF02G0BK4.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcaccatcacttggccgggcaagtcggaacattgacacctatttaaattgtatcaacatagaccagggacgcccctaagctcctaatctatgctgcatcctagtttgacgtaaaggtcgggtacccagtcgtaggttcagtggcagtggatcgtgggactaggtactttacactcctaccaacctatacgtaagtaacttccgtagaccgtaaacggttaggtaaacgttacgttttacgacctttaaacttttacgtttaaccgttacggttacctaaaaccgtagttaaactttaaccgtaagttttcggttttaaccggaacccgtaaacggggtaacctaaaccggtaaccttaaaccgtaaaacgtttaaaccgtaacgttacgggtacggtcgtacgaaccgtacctaacgttccttcgttacttaccgtacttcccttacccgtctacgttcctagtaaccg

SEQ ID NO: 142396 - DNA, 609 bp, Homo sapiens
  misc_feature: GYAE6OF02G3I9H.46.67.G01.1.454.CMB.1.raw
  modified_base (437)..(437): a, c, t, g, unknown or other
  misc_feature (437)..(437): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtgggagacagtgtccaccatcacttcggccgggacaaggtccggaactattcgacctaaccttaattttaaaagttggttataccaaactataacggaacccgaggggaccggaccccctaagccttacctaattctaattggtttcgactactcctaggtttgacgtaaaggtcggggtacccagttcgaggttcaggtgctagtgatcgtggactagtattcactctacacatactagtatctgacagtnagtattgactacttatactgtacactatattactattgtttaccggacgtaaggacctacgtaactaacgtaaacttaaacgactagtagtctacgactacctagttacttcgtaccttaccgtactttccccgttacccgtaccttaacgttaccttacgttaacttaccg

SEQ ID NO: 142397 - DNA, 691 bp, Homo sapiens
  misc_feature: GYAE6OF02IBBZA.46.67.G01.1.454.CMB.1.raw
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgcaaccgtggagacagtcgcaccatcacttcgcgggcaagtcggaacatgactactattaaattggtatacaacatagacgaggacgaccctaagctactatctatcgctgacactcgtagtttacgacgtaaaggttcggggtaccctagttacggtaggttacgaggtggacgtaggtaggtacgtacgtcgggaactaggtaactttcgaacttccgtacctaacccaatttaccgtaagttaactcgtacgaaccgtaacggtaagtaaattagtttacgacttaaacgttttagttaccgttacggtaactaacgaagttaaacttaacgtaagttttacgggttttacggaaccggtaaggaaccgtaaccgtaaacgttaaacgtaaaactttaaaacggaacgttaggtacggtaccgttacgtacgacccttaagtttactccgtttaccttaaccgtactttacccgttacccgttaccgttaacttccgttaagtacccg

SEQ ID NO: 142398 - DNA, 1004 bp, Homo sapiens
  misc_feature: GYAE6OF02IKMJK.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgtctgtctcgtgtgcctcatcagtgtggtttcttgtgggcgtgggtccgcacgccgtccggagggagggcgtaggactacgagttaggaagttcgtctcgtactaagttaggtcggtaggtttaccttaagttacgacggttaccgtctacgttacgaagtacgtcgtacgtccacgtaacgttacttcgttacgtacggtacctaccggttaccgacggtacctaaactttaccggtttaaccgtttttccccgaaagggtaacgtaaggttcgtttaacggtttcgtttacgggtaccggtaccccggtcccggtacggttaccggtaaccgggttaaacccggggttttaccgtttttaaaccggttttaccggttacggggttacccggttaacgggggtaaccggtttaaacccggggtaaccgggggttttaccttttaaaacggttttacggtttagggtttttaaacgttttttacggggggtaaacggtttttcgggtttttaaaaccgtttacccggaaacccgggttttaacccccgttaaacggggttaaccggttacccggggggttacccgggttaacccgggtttacccccggtaccccggggggtttaaacgggggaaccccggttaaaggggttaacccggtttaccgggttacccgggtttaacccgttaccccggttttaacccgttaccgttttaacccccggccgtaaccgggtaccccgggtaacccggtccgttacccgggtttcccggttacccccgttccccgggttacccgtccccgttaaccccgttaccccgggtaacttaccggaacccgttcccgg

SEQ ID NO: 142399 - DNA, 639 bp, Homo sapiens
  misc_feature: GYAE6OF02IMXD4.46.67.G01.1.454.CMB.1.raw
  modified_base (193)..(193): a, c, t, g, unknown or other
  misc_feature (193)..(193): n is a, c, g, or t
  modified_base (231)..(231): a, c, t, g, unknown or other
  misc_feature (231)..(231): n is a, c, g, or t
  modified_base (364)..(364): a, c, t, g, unknown or other
  misc_feature (364)..(364): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgaccccagtctccatcctccctgtctgcaaccgtggganacagtgtcaccatcaccttgcccgggcaagtcggaacnttgacacctatttaaatggtatcaacatagacaggacgcccctaagctctaatctatgactgcatccagtttgacaaaggtcggggtacccagtacggtaggttcgagtggctaggtcggatcgtagggaacngtacttcgaactctacacctataccaagtaactcgtacgactaacgtagaacgttagttttcgactaaacttacttaacttcgtacaaacgtaagttaattacctaaagtttcggtttaccggaacgtaacggtaacgaaccgttaactaaacgtaaaacttaaacggtaacgttaggtacggtacgtaccgaccgtaaccgtacttccgttacgttaccgtttacctaacgtttcccgtttaccccgacccgtttaacgttcccttaggttaac

SEQ ID NO: 142400 - DNA, 673 bp, Homo sapiens
  misc_feature: GYAE6OF02HBK41.46.67.G01.1.454.CMB.1.raw
  modified_base (287)..(287): a, c, t, g, unknown or other
  misc_feature (287)..(287): n is a, c, g, or t
  modified_base (359)..(359): a, c, t, g, unknown or other
  misc_feature (359)..(359): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctcgtggtcgcctccatcagttagtggtttcttcgtgggctgggtccgcagctccgagggacgggctggaatacagttggaagtgtactctacgatggtggtaggttcctattacgagtccgtntcctgaagacgtcgactcaccatactctcgtcggactacgtccagactaactcgtacgttttccagaacgtntgtagttctcggtacgaccgtccgcgtacggaccgtacgggttacgtttaacttcgtcggtacgacgtacggacggtacggtacttaagttacgttaggtttagttttgggagtttggtttattaccgaccgtaccctagtacgtccggggacgggtcctacccgggtacccggtacgggtaccgtaagggtactacggttcggtaccctacggtccgttaccgtaccgtccgtaccgacccggacggtcccttacgtccggttaccccttcccgtacggccctacccgtcctaaccggacgtccgtaccccgg

SEQ ID NO: 142401 - DNA, 585 bp, Homo sapiens
  misc_feature: GYAE6OF02GTTOI.46.67.G01.1.454.CMB.1.raw
  modified_base (334)..(334): a, c, t, g, unknown or other
  misc_feature (334)..(334): n is a, c, g, or t
tcagactagcagtacacgaccggtgctcgatttagagtatacatattggggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgactacctatttaaattggtatcaacatagaccagggacgcccctaagctctaatctatgctgcatccagtttgcaagtgggtcccatcgaggttcagtcggnagtggactcgtgggacagtatttccacttcgtcacctatcgagttaactctcgactaacgtgaagtatttcgactaacttattactagtacaacaagtaattactaagttcggttttacggaacgaacgggtaaccaaccgtaactaaactaaaacgttaaaccgaacgttaggacggtactggacctacctaacttcgttacgttacttacctacgttacccgttcccgtacctacgttccgtagtaacg

SEQ ID NO: 142402 - DNA, 633 bp, Homo sapiens
  misc_feature: GYAE6OF02FT58W.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacgagtgtcaccatctacgttcgccgggcaagtcggaacagttagaccaaccttatttaaacgttggtactcaacatagaaccagggaccgcccctaagctacctaatctagtgactgacacgtcctagtttgacgtaaacgggtcgggtacccaagtcgtaggtttacaggtcggacgaggtgatcgtagggactaggtatttcacttctccaactatcgagtaactcgtagacaacgtagtaagtatttacgacttaactttacttacttacgtaactaacgtaagtaaacttactaagtttcggtttaccggacgtaacgggtacctaacgtaacttaaacgtaaaacttaaacgacgttaggacgtacgtaccgacgtaccagttccttacgttacttacctacgttcccttacccgacctacgttccgttagtacg

SEQ ID NO: 142403 - DNA, 757 bp, Homo sapiens
  misc_feature: GYAE6OF02HD4FF.46.67.G01.1.454.CMB.1.raw
tcagactagcagtacacgaccggtgctcgatttagagtatacatattgggtttgtcctcctgctggtggcagctcccagatgggtcctgtccctggtgcaactgcaggagtcgggcccacgactggtgaggcctttcggacgaccctgtccctcacctgcgctgtctctggtcgcctccatcagtagtgtttcttcgtgggtctgggtccgcagcctccgagggaacgggctaggaatacagttggaagtgtctctcagtagtggtagttcgtattacgagtccgtctctacaagacgtgacgtacaccattatcctcgtcgacaccgtcacgactaactcgtacgttttccctaggaacgtgtagtacgttcttaggtacgtacccgtccgtcgtacgaccggtacgggttacttttacgttacgttcgtggtacggtaagtacggtaccgggttactttaagtttaacgttagttttacgggtttttagggtaagggttttacgggttttacttttaacccggaacccttaacccggttaacggtacggttaccgggaccgggggtacccgtacccgggtaccccgggttacggggtacccggaaagggttaaccgttacgttcgttacccgtaccggttcccgttacgttaccgtccctacccgtaaccggaccggtacccgcggttaccccgttccccgttacccggtccggtacccctaccccgttcccgaaccctaggaccctaccccggg

SEQ ID NO: 142404 - DNA, 586 bp, Homo sapiens
  misc_feature: GYAE6OF02F8AH1.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtcgcctccatcagtagtggtttcttcgtggggctgggtccgcagcctccgagggaggggctggaatacattggaagtgtctctcatagtggaggttcctattacagtccgtctctacaagagtcgagtcacatatctctgacacgtccagcaatcaacgttttccctagaagtatgtagttcgtgtcgacccgccgctagaccgacgggttcgtttaattacgtgtcgacgagacgacgtctattatgttattttggagttggttatttcgaactaccgtagtacgtacggacggggtctccggtaccccgtgggtcccgaaggtaacgttacggtacggtccgtaccgttaccttaccgttacgaccctaccccgg

SEQ ID NO: 142405 - DNA, 659 bp, Homo sapiens
  misc_feature: GYAE6OF02GAJ9U.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccggcaagtcgaacattgactactatttaatggtatcaacatagaccagggaccgaccctaagctacctaatctatgctgcatcctagtttcgacgtaaagtcggggtacccagtcggtaggttcgaggtcggacgtagtcggtatcgtagggacagtacgtttccaaccgttctaccaccgacttacgtaagttaacttcgtagtactaacggtagtaacgttagttttacgacttaaactttacttaacgtcgtactaacgtaagtaacttactaaagtttcggttttaccggaaccgtaacgggtacctaacgtaacgttaaaccgtaaaacttaaacggtaacgttacggttacggtacttaaccggacgtaacctacgtttaccgttacgttcctttaaccgtacttcccgtttaccccgacttaaccgttcgtagttaaccg

SEQ ID NO: 142406 - DNA, 553 bp, Homo sapiens
  misc_feature: GYAE6OF02JIP43.46.67.G01.1.454.CMB.1.raw
  modified_base (408)..(408): a, c, t, g, unknown or other
  misc_feature (408)..(408): n is a, c, g, or t
  modified_base (493)..(493): a, c, t, g, unknown or other
  misc_feature (493)..(493): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctgggctgggtccgcagctccgagggagggctggaatacattggaagtgtctctcatagtggaggttcctattacagtccgtctctcaagagtcgacgtcaaccgattatcctcgtggacctacgtccagacaatctacgttttcccagaagtatgtagttctgtcgaccgccgtctcgacgtacgggttctttatacgtgtgacgagagtacgntattagtgtattttggagttggttacttcgactacctagatcggacgggctcgccgtgggacaggtatcgtgcacgtctacgtcncctacacgtacggcctagtccgtccttccccgtcgcctaccctcctacgacgcgtacccg

SEQ ID NO: 142407 - DNA, 921 bp, Homo sapiens
  misc_feature: GYAE6OF02JH7EJ.46.67.G01.1.454.CMB.1.raw
  modified_base (252)..(252): a, c, t, g, unknown or other
  misc_feature (252)..(252): n is a, c, g, or t
  modified_base (371)..(371): a, c, t, g, unknown or other
  misc_feature (371)..(371): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtcgcctccatcagtagtggtttctcgtgggctgggtccgcagcctccgaggggagggctggaatacagttaggagtgtctctnagtaggtggtaggttcctaattacacgtccgtctcttacgaagtagtcgagttccgacctattatcctcgtacgaacctacgtaccagacctaatcgtaacgtttttcccgagaaagtntacgtaacgtttccgtaggtacggacccggtaccgcggttacgaaccggtacggggttactttttaacgttaccggttggtcgtaacgggtaacggaacggtaccggttacgtttaaagtttacgttggttttaacggttttttagggtaacggttttagggttttaacgttttaacccggtaaccttaaaccccggtttaaggtaacccgggttaccgggggtaacccgggggggtttacccttaccccgggggtaaaccccccgggttacgggggtaacccccggtaaaccggggggttaaaacccgttaccggttttaacccggggttaacccgttaaacccccggtttacccgttttacccccgggttttaacccggttacccccttaacccccgggtaaacccgggtaaaccccggggtaccccccgttaacggttttaccccccggttacccccggttttacccccccggttacgggtacccccctaaacccccccggttttccccgtaaaccccgggtaaccggtaccccggttaacccccgg

SEQ ID NO: 142408 - DNA, 759 bp, Homo sapiens
  misc_feature: GYAE6OF02HU2AC.46.67.G01.1.454.CMB.1.raw
  modified_base (309)..(309): a, c, t, g, unknown or other
  misc_feature (309)..(309): n is a, c, g, or t
  modified_base (460)..(460): a, c, t, g, unknown or other
  misc_feature (460)..(460): n is a, c, g, or t
tcagactagcagtacacgaccggtgctcgatttagagtatacatattgggtttggggagtctcggtcaggacacagcatggacatgagggtccccgctcagctccgtggggctcctgctactctggctccgaggtgccagatgtgaccatcgagctcgacccagtcctccatcctccctgtctgaccaccggtgggacacgagtgtcaccatcacgttcggcccgggacaaggtacggaactagttcgacctaacttaattttaaacgttgggttaatacgaaactagtaacgaaccggaaggggaccncccccgttaaaggcctacctaatcctatcgctagcctatcctacgtttgaacgtaacgggttcgggaccctagttccggtaggttacgacggttggacctaaggttggaacttccggttagggaacaagttcctttacgaacttccgaacngaacctttagaagttaacgtcgtacgacgtaagtacgtaaggttttacttttacgtaactttacgttacgtacgtaaactaacgtaagttaaaccgttattaaacgtttcgggtttaacccgaagggttaaccgtaaccgtaacgttaaactaaaacgttaaaagttaaaaccgtggttacggtaacgtccttacggaccctaacggttaccttaccggttaacgttacccgttacgttaaaccggtttacccttaccccggtactttaccgtttaccggttagtaacctttaaccggg

SEQ ID NO: 142409 - DNA, 768 bp, Homo sapiens
  misc_feature: GYAE6OF02IZ8WL.46.67.G01.1.454.CMB.1.raw
  modified_base (171)..(171): a, c, t, g, unknown or other
  misc_feature (171)..(171): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtncctcatcagtagtggtttcttcgtgggctgggtccgcagctccgagggagggctggaatacagttggaagtgtctctcagtagtggtacgttcctaattacagtccgtctctcaagagtcgacgtcacctatactctctagacacgtccagcaatctacgttttcccagaagtatcgtacgttcttaggtcgtacccgccgtcgtcgaacgtaccggggttaccgttttaactacgttcggtaggccggaaggtacgtaacggtcttaagtttagttaggtttaagtttttggggtaaggtttggtttaacgtttccgtaaccgtacccgttaggaaccgttccggggtaacggggtccgttacccggtaccccgggttacggggggtacccgaaacggggtaacgttaccggttacgggttaccctaccccggtttctacccggtttaccgtacccgttaccccggaacccggtaacccgggggtaccccttaaccgggttccccggtttaccccgtttacccccccgggttaccggttacccccgtaaccccccgtttacccgaccccggtaaaccggtcccggtaaccccccgg

SEQ ID NO: 142410 - DNA, 526 bp, Homo sapiens
  misc_feature: GYAE6OF02IBS89.46.67.G01.1.454.CMB.1.raw
  modified_base (420)..(420): a, c, t, g, unknown or other
  misc_feature (420)..(420): n is a, c, g, or t
  modified_base (505)..(505): a, c, t, g, unknown or other
  misc_feature (505)..(505): n is a, c, g, or t
  modified_base (515)..(515): a, c, t, g, unknown or other
  misc_feature (515)..(515): n is a, c, g, or t
tcagactagcagtacacgaccggtgctcgatttagagtatacatattgggtttgggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacactattaaatggtatcaacatagaccagggacggcccctaagctcctaatctatgctgcatcctagtttgacaaaggtgggtcccatcgaggttcagtgcagtggatcgtgggacagtatttcactctcaccatcagtaatctagctaacgagtaagtattttgactaacttattactagtacaanagaaattacaaattcgttttacgaccgaaggacaacgaactaactaaaattaaacgaaactgtagctagctaacatctgtcttanacttcctccnccatctgtaac

SEQ ID NO: 142411 - DNA, 732 bp, Homo sapiens
  misc_feature: GYAE6OF02F4PMJ.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccggtggagacagtgtcacatcacttcgaccgggacaagtcggaacattcgactacctagtttaaattggtactacaacatacgacaggaccgaccctaagctacctaatctatgctgcactcctagtttgacgtaacggtcgggtacccagtcggaggttcaggtgacgtaggtcggtaatcggtaggggaactacgttattcctactcctacgtaaccatacgtagttaactccgtagaccgtaaacgttacgaagttacgttttacgaaccgtttaaacttaacgtttacgttaagtacctaaacgtaacgttaaacttaacgttaaacgttcggtttaaccggtaacccggaacgggtaacctaaacggtaaccttaaaacgttaaaaaccgttaaaaaccggtaacgttacgggttaacggtaccgttacgggtaacccttaaccggtaacgttttccgttaacgtttacccgtttaccgttaaccggtttacccctttaaccccgggttacccgtaaaccggttttccgaagtttaaaccccgg

SEQ ID NO: 142412 - DNA, 678 bp, Homo sapiens
  misc_feature: GYAE6OF02JWCF1.46.67.G01.1.454.CMB.1.raw
  modified_base (190)..(190): a, c, t, g, unknown or other
  misc_feature (190)..(190): n is a, c, g, or t
  modified_base (217)..(217): a, c, t, g, unknown or other
  misc_feature (217)..(217): n is a, c, g, or t
tcagactagcagtacacgaccggtgctcgatttagagtatacatattgggtttggggagtctcggtcaggacacagcatggacatgagggtcccgctcagctcctggggctcctgctactctggctccgagtgccagatgtgacatcgagctgacccagtctccatcctcctgtctagcaaccgtggganacagtcgtcaccatcacttggccgganaacgtcggaactagttgaacctaccgttatttaaagtcggtaatcgaacatagaccgagggaccgtccctaaaggccttacgtaaatctaacgtggacctcggactaactcccgtagtttacgacgtaaaacggttcggggtcccctaagtccggtaggttacaaggtcggactaaggttcggtaatccggtagggaactagtctttacgacttcgtacccgactaagtctaacgtaagttcgtacgtactaacggtgtaacgttatttacggaacttactttattaacgttagttacctaagtaagtaattaactaagttgtttacgacgtaagacgtaacgtaaccgttaaataaacgttaaagaaccgttagtacggtactacggtacctaacggttaccttcgtaacgttccttacttaccttaccgttaccgtacccgtatttaccgacgttaacc

SEQ ID NO: 142413 - DNA, 608 bp, Homo sapiens
  misc_feature: GYAE6OF02I2SZW.46.67.G01.1.454.CMB.1.raw
  modified_base (238)..(238): a, c, t, g, unknown or other
  misc_feature (238)..(238): n is a, c, g, or t
tcagactagcagtacacgaccggtgctcgatttagagtatacatattgggtttgggggacctcctgtgcaagaacatgaagcacctgtgggtttgtcctcctgctggtggcagctcccagatgggtcctgtccctggtgcaactgcaggagtccgggcccacgactggtgaggccttcggagaccctgtccctcacctgcgctgtctctggtcgccttccatcagtagtgtttcttcnggggctgggtccgcagcctccgagggaacgggtctaggactacattcgggaagttgtctctcaattagtggtaggttacctagttacagtccgtctctctaagagtacgattccacctactatctctcggacaccgtaccagcaactctacgttttcccagaagtactgtagttctgtcgaccgtccgtctgacgtacgggttacgtttacttacgtgtcgcgagacgacggtctattatgttacgtttggtacgttgttacttcgacctaccgtagtactacggacggggtcctaccggtaccccgtgggtacccgagggttaacctacggtacggtacctaccgtctacccgttcgtcccctaacccg

SEQ ID NO: 142414 - DNA, 630 bp, Homo sapiens
  misc_feature: GYAE6OF02FXN8I.46.67.G01.1.454.CMB.1.raw
  modified_base (285)..(285): a, c, t, g, unknown or other
  misc_feature (285)..(285): n is a, c, g, or t
  modified_base (351)..(351): a, c, t, g, unknown or other
  misc_feature (351)..(351): n is a, c, g, or t
  modified_base (373)..(373): a, c, t, g, unknown or other
  misc_feature (373)..(373): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagttagtggtttctcgtggggctggggtccgcagctcccgaggggaagggctaggaatacagttggaagtgtctctcagtagtggaggttcctattacagtccgtntctcaagtgtcgagtcaccgtatatctctaggcacgtccagcaaatcgtacgttttcccagaactntgacgttcgtgtagaccgccgntacgaccgacgggtctttattactgtgcgagagacggtctattagtgttattttgggattggttattccgactacctagacgtcggacggggtcctaccgcccggtcggggaccgaagggtaactcggttcggtacctaccgtcttacccttacgacccttcccgaacccggaacgggtcccctaacggtccccggtttaccccgttcccccggtggtcccctaccccttacccgacccgtaacgccgtaaccccgg

SEQ ID NO: 142415 - DNA, 628 bp, Homo sapiens
  misc_feature: GYAE6OF02FZH4B.46.67.G01.1.454.CMB.1.raw
  modified_base (192)..(192): a, c, t, g, unknown or other
  misc_feature (192)..(192): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggganacagtgtcacatcacttgccgggcaagtcggacattgacacttatttaaattggtatcaacatagaccgaggaccgccctaagctactaatctatgctgctatcctagttcgagaaacggtcgggtcccaagtcgaggttcagtggtcgagtaggatcgtgggaacaggtactttacactctaccactatacgtaagttaacgtctagactaacggtagtaaagttattttacgacttaactttatttaaccgtagtactaaacgtaagtaacttaacgtaagtttcgtttaccggtaacgaaacgggtacctaaacggaaccttaaacgtaaaaacgtaaaccgtaacgttacgtaggtacgttacgacctacccgtaattccgtcgttacctttactaccttccgttaccccgtacctacttacgtattaaccg

SEQ ID NO: 142416 - DNA, 643 bp, Homo sapiens
  misc_feature: GYAE6OF02FU97X.46.67.G01.1.454.CMB.1.raw
  modified_base (366)..(366): a, c, t, g, unknown or other
  misc_feature (366)..(366): n is a, c, g, or t
  modified_base (395)..(395): a, c, t, g, unknown or other
  misc_feature (395)..(395): n is a, c, g, or t
  modified_base (403)..(403): a, c, t, g, unknown or other
  misc_feature (403)..(403): n is a, c, g, or t
  modified_base (415)..(415): a, c, t, g, unknown or other
  misc_feature (415)..(415): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtcccctcacctgcgctgtctctggtgcctccatcagtagtgtttctcgtggggctgggtccgcagcctccgaggggagggctggaatacagttggaagttgtctcgtacagtaggtaggtacggtttcctagttaccaggttcccgtctctacaagacgttcgacgttcaccatctctcnggacacgtcagcaatctagtttccagatntgacgttngtcgaccgccgntacgacgacgggttctttatactggtacgcggaaggagtaccggtacttagttagttagtttaggttttacggaggttttaggtttacgtttaccgaaccttacccgttaagacgtaccggggtaccgggccttaccgggtaaccccgggttggggaccccgtaagggttaacctaccggttcggtccctaacccggtttcctacccgttaccgccccgttaacccgg

SEQ ID NO: 142417 - DNA, 737 bp, Homo sapiens
  misc_feature: GYAE6OF02JW328.46.67.G01.1.454.CMB.1.raw
  modified_base (151)..(151): a, c, t, g, unknown or other
  misc_feature (151)..(151): n is a, c, g, or t
  modified_base (336)..(336): a, c, t, g, unknown or other
  misc_feature (336)..(336): n is a, c, g, or t
  modified_base (344)..(344): a, c, t, g, unknown or other
  misc_feature (344)..(344): n is a, c, g, or t
tcagactagcagtacacgaccggtgctcgatttagagtatacatatggttgtctcctgctggtggcagctcccagatgggtcctgtccctggtgcaactgcaggagtcgggcccacgacctggtgaggccttcgggagaccctgtccctanacctgccgctgtactctggtgcctccatcagtagtggtttctgtgggctggggtccgcaggcctcccgaggggaacgggtctggaactacgagttcgggaaacgttgtccgtcttccgaagttacggtggtaaggttccctaattaccgaggttccgtctcgtacaaggtgtccgagttccaacntacgtctntaggactaccgtccgagctaaactcctacggttttcccagaagttctggtagttcctggtacgacccgtccgtataggaccgtacggggttctttaaactacgtggtacgtacggacgtacgggtcgtacttaagtcgttacggttagttttacggtagttcggtttaacgttccggaacgtaacccgttaggtacgtacgggacggggtccttaccgggacccggttaggggacccgtaggggaaattcccggtaggtacccgtacggtccgttacgttaccggcccgttaccgtaccggaaccggtcccgttaacgttcccgggttaccccttcccggtccggttaccctaccccggttacccgtaccggtaaaccggtccgtaaccccgg

SEQ ID NO: 142418 - DNA, 699 bp, Homo sapiens
  misc_feature: GYAE6OF02GBEHM.46.67.G01.1.454.CMB.1.raw
  modified_base (352)..(352): a, c, t, g, unknown or other
  misc_feature (352)..(352): n is a, c, g, or t
  modified_base (393)..(393): a, c, t, g, unknown or other
  misc_feature (393)..(393): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctcatcagtagttggtttctcgtgggctggggtccgcagcctccgaggggaagggctggaatacagttggaagtgtctctcagtgtggtacggttcctattacagtccgtctctacaagcgtcgagtcacctatactctntcggacacgtccagactaatctacgttttccctagaacgtntagtacgtttcgtgtacgacccgccgtcgtacgaccgtacgggttacgttttaataccgttggtcggacgtaacggtacggtaacggttactttaagtttaacgttggtttaacgtttttgggtacggttttaggttttacctttaccggaaacccttacccgttaaggtacgttacccggggaccggggttaccctaccccgggtccccgggttcggggtaacccggtaacgggtaacgttacccgggttcgggttacccgtaccccggttccttaaccccggtttaccgaccccgttaaccccg

SEQ ID NO: 142419 - DNA, 837 bp, Homo sapiens
  misc_feature: GYAE6OF02FQ4XG.46.67.G01.1.454.CMB.1.raw
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccagactggtgaggccttcggagaccctgtccctcacctgcgctgtctcgtggtcgcctccatcagttagttggtttcttcgtggggctcggggtccgcagcctccgaggggaaggggctaggaacttacgatttagggaagttgttcttcgtacaagttaggtgggacggttttaccctaagtttaccgacggttacccgtcgttaccttacgaaaacggtcggttaccggtaagttcccgtaaaccctagttaacgttccgttacccgtaggggaacccctacccggttacccgaaacggtccttaaaacgttcccgtttaaccggttttttccccaagggtaaacggtacgtttaggttacgttttaccgttacggtaccggtaccccgggtaccccgtcgttacgggaccgttaaccgggggttacgttttttaaaccgttaccgttggttaccggacgggtaacggtacggtacccgttacgtttaagtttacgttagtttaggtttttttacgggaggttttacggttttaacgtttccgtaacccgtaacccgttagggtaacgttccggggaccggggttccttaccccgggtaccccggtgggggtacccctaaggggtacgtaccggttcggacccgttacccggttcttacccgttaccgcccttacccg

SEQ ID NO: 142420 - DNA, 558 bp, Homo sapiens
  misc_feature: GYAE6OF02IIDNV.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtggagacagtgtcaccatcacttgccgggcaagtcggaacattgaccacctatttaaattggtatacaacatagaccgagggaccgacccctaagctcctaatctatcgctgcacttcctagtttcgacgtaaaggtcgggtaccctagtcggaggttcagtggctaggtggatcgtgggactagactttcactctcacatcagtatctagcaacgtgaattagtttcactaactttatacttagtacaaactaataacttaataagttcgtttaccggacaacggtacacgtaactaactaaactaaacgaatgtagctcgactactatacgttacgtcttacactcctttacccgacctacgttctatac

SEQ ID NO: 142421 - DNA, 686 bp, Homo sapiens
  misc_feature: GYAE6OF02H694K.46.67.G01.1.454.CMB.1.raw
  modified_base (201)..(201): a, c, t, g, unknown or other
  misc_feature (201)..(201): n is a, c, g, or t
  modified_base (234)..(234): a, c, t, g, unknown or other
  misc_feature (234)..(234): n is a, c, g, or t
tcagactagcagtacacgaccggtgctcgatttagagtatacatattgggtttggggagtctcggtcaggacacagcatggacatgagggtccccgctcagcctcctggggctcctgctactctggctccgaggtgccagatgtgacatcgagctcgacccagtcctccactccctccctgtcctgccgaaccggtggganacagtgccacctatctacgttcggacccggganaacggtacggaactagttacgaacctactttaattttaaagttcggttactaaccaacagtaacggaaccgacggggtacccgtacccctaagcccttacctaatactatcgtctcgtacgtactcgttagttacgacgtaacggtcgggtaccagtacggtacggttcgaggtcggtacaggtgagtcggtaggactacgtacttccgtactaccactacctagtaacgagttaactcgtacaaccggtaacgtaaggttacttagttaaccgactttaacttaagttacctaagtaacctaaagtaagttaactagtaacgttcggttaaccgaacgtacgaacctaacgtaacgttaaactaaagttaaccgagttagcgtactaccgtaccactagtcgttacgttacctcgttaccgtacctacccgtaccgtatttaccgattacg

SEQ ID NO: 142422 - DNA, 627 bp, Homo sapiens
  misc_feature: GYAE6OF02HY8K1.46.67.G01.1.454.CMB.1.raw
  modified_base (350)..(350): a, c, t, g, unknown or other
  misc_feature (350)..(350): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgacccagtctccatcctccctgtctgcaaccgtggagacagtgtcaccatcacttggccggtacaagtcgaacattgacactattaaattgtatcacatagacaggacggccctaagctcatctatgctgcatccagtttgactaaaggtcgggtacccagtacgaggttacgaggtcgcagtgactcgtgggaacngtagttcactctacacctatacctagtaatcgtgactaacgtgaaacgtagttttagacttaaacgtttactttaacgttacgtactaaactaagttaaaattaaccgtaagtttacggttttaccggtaaccgtaaacgggaactaaccgtaaccgtaaaccgttaaaacgttaaaaacgtaaccgtaggttacgtacgttacgaccgtaacctacgttacgttcgttaccttataccttccggttaccccacccgtaacgttaccttagtaaccg

SEQ ID NO: 142423 - DNA, 660 bp, Homo sapiens
  misc_feature: GYAE6OF02ILJOF.46.67.G01.1.454.CMB.1.raw
  modified_base (192)..(192): a, c, t, g, unknown or other
  misc_feature (192)..(192): n is a, c, g, or t
  modified_base (219)..(219): a, c, t, g, unknown or other
  misc_feature (219)..(219): n is a, c, g, or t
  modified_base (230)..(230): a, c, t, g, unknown or other
  misc_feature (230)..(230): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcgaaccgtgganacagtgtccaccatcacttgccggganaagtcggaacnttgacactatttaagtgtatacaactatacgaccgaggggaccgacccctaagccttacctaatccttatcgctacgctacgtcctagtttcgacgtaaaggtccgggtaccctagtacggtagttcgagtgacgtagtagtagtcgtaggactagtactttcgacttctacaccatacagttaatcgtacgacgtaacgtgaagttattacgaaccttaactttaacttacgttacgtaacctaacgtaacttaaagttacctaagtttcggtttaccggaaccgttaagggtaacctaaggtaacctaaacgttaaaacgttaaaaccggtaagttggtaccgtccgtaacgtaccgtaaccgtacttcgttacgttacttacccgtacctttacccgtacccggtacctacgttaccgtagtaaccg

SEQ ID NO: 142424 - DNA, 634 bp, Homo sapiens
  misc_feature: GYAE6OF02FH55R.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccatcctccctgtctgcaaccggtgggagacagtgtcaccatccacttgccgggacaagtcggaacattgacacctatttaattgtatcaacatagaccagggaccggcccctaagctcctaatctatgctgactatcctagtttgacgaaaggtcggggtccagtcggtaggttcagtggcaggtgatcgtgggacagtattacactcctcacctatacgaatatactgactaacggtagtaagttagttttacgacttaaacgtttacttaacgttacgtaactaacgtaagttaaacttaacgttaatttacggttttaccggaaccgtaaacgggtaactaacgtaacttaaactaaaacgttaaaaccgtacgtaggtaccggtactacggtacctaccgtaacttccgttacgttccttaaccgttacccttccgttaccccgacctaacgttctacgttaac

SEQ ID NO: 142425 - DNA, 652 bp, Homo sapiens
  misc_feature: GYAE6OF02GCBD2.46.67.G01.1.454.CMB.1.raw
  modified_base (172)..(172): a, c, t, g, unknown or other
  misc_feature (172)..(172): n is a, c, g, or t
  modified_base (211)..(211): a, c, t, g, unknown or other
  misc_feature (211)..(211): n is a, c, g, or t
  modified_base (293)..(293): a, c, t, g, unknown or other
  misc_feature (293)..(293): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggcctttcggagaccctgtccctcacctgcgctgtctctggtncctccatcagtagtggtttcttcgtggggctgggtccgnagcctccgagggagggctggaatacagttggaagtgtctctcagtaggtggacggttcctattacagtccgtctctacaagngtcgagtcaccatatctctggacacgtcagcaatctacgttttcccagaacgtatgtagttctgtcgaccgcgactcgacgtacggtactttattacgtgtgcgaggacgacggtctagttagtgttagttttggaggtttgtttattcgacctaccgtagacgtccgggacggggtcctaccggacccggtggggaccgaagggttaacgttacggtaccggttacctacccggtccgtttccgttacgtccctaccctaacccggaaccgggtacccctacggttacccggttcccctttcccccgtacgggtacccctacccccgttcctaacccgtaacggtacccgtaaccccg

SEQ ID NO: 142426 - DNA, 719 bp, Homo sapiens
  misc_feature: GYAE6OF02JEMNG.46.67.G01.1.454.CMB.1.raw
  modified_base (152)..(152): a, c, t, g, unknown or other
  misc_feature (152)..(152): n is a, c, g, or t
  modified_base (171)..(171): a, c, t, g, unknown or other
  misc_feature (171)..(171): n is a, c, g, or t
  modified_base (208)..(208): a, c, t, g, unknown or other
  misc_feature (208)..(208): n is a, c, g, or t
  modified_base (228)..(228): a, c, t, g, unknown or other
  misc_feature (228)..(228): n is a, c, g, or t
  modified_base (252)..(252): a, c, t, g, unknown or other
  misc_feature (252)..(252): n is a, c, g, or t
  modified_base (271)..(271): a, c, t, g, unknown or other
  misc_feature (271)..(271): n is a, c, g, or t
  modified_base (281)..(281): a, c, t, g, unknown or other
  misc_feature (281)..(281): n is a, c, g, or t
tcagactagcagtacacgaccggtgctcgatttagagtatacatattgggtttgtcctcctgctggtgcagctcccagatgggtcctgtccctggtgcaactgcaggagtcgggcccagactggtgagggccttcgggagaccctgtccctnacctgcgctgtctctggtncctcatcagtagtggtttctcgtgggctgggtccganagctccgaggggacgggtcnggaactcagttggacgtgtcactnatagtcgagttccattacngtctctctanaagtgtcgagtcaacctgtactcgtacgtcggactacgtccgagacaaattcgttaacgttttcccaaggaaatagttaggtaccctttcgtagtaccgtacccgccgtcgtaaacgtacccgaagggggttacttttaacgtacgttggtacgccggtagaacgtaccgggtacttattaagttcgttaaaggtttttggaaggtttccggtttaattccggaaccttaacccgtaagttacgtccgggaaccggggtcttaccccgggacgttacgggggacccgaaggggtaaacttaccggtcgtaaccggtaccctttccggtaacttccgggccttaaccggtaaccgtacgggaaccctgttaacccgggtacctttcccccggaacggtcccgtaacccctttaccggtaaccacggaaccggtaccccg

SEQ ID NO: 142427 - DNA, 552 bp, Homo sapiens
  misc_feature: GYAE6OF02HAXI0.46.67.G01.1.454.CMB.1.raw
  modified_base (436)..(436): a, c, t, g, unknown or other
  misc_feature (436)..(436): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttctcgtggggctgggtccgcagctcccgagggaaggggctggaatacactggaagtgtctctcatagtggaggttcctattacagtccgtctctcaagagtcgagtcaccatatctctggacacgtccagcaatctacgttttcccagaagtatgtagttctgtgaccgccgctgacgacgggtctttatactgtgcgagagacggntagttatgtagttttggagttgtttattcgactacctgacgtcggacggggtctaccggacccgtggggaccaagggtactacgtcggtcacccgttctaccgttacgcctacccg

SEQ ID NO: 142428 - DNA, 863 bp, Homo sapiens
  misc_feature: GYAE6OF02HLGNR.46.67.G01.1.454.CMB.1.raw
  modified_base (212)..(212): a, c, t, g, unknown or other
  misc_feature (212)..(212): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgaggccttcggagacccctgtccctcacctgcgctgtctctggtcgcctccatcagtagtggtttcttcgtggggctgggtccgnagcctcccgaggggaacgggctaggaactacgagttgggaactgtctactcaagttacggtggtacggttcctaagttacctacggttccgtctcctacaagtacggtacgaagttccacctaatacgtccgttacgacgggacctaccggttaccacggtaacctaaaactttccgttaacggtttttaccccgaggtaaagtacttacggtaagttttcgtacggttccgaaccggtccgtcgttacgggaaccgtaccggggttaacgtttttactacgttcggttacggcggtaacgaacgggtaccggtacgttaagtttaacgttaggtttaaggttttttacgggtaggtttagggtttttaactttaccgtaaacccgttaccgtaaacggttaacggtaccgggggtaccggggtacccgtttacccgggaaccccggttaccggggggacccgtaaacgggggtaacgttaacccggtacggggttacccgaaacccgggttttccctaccggttttaccgcccccgttaacccggtaaccccggtaaccggggtaccccttaccgggttaccccgtttccccgttacccccggtacggacccctaaccccgttcccgtaaccggaacgtaccgtaccccg

SEQ ID NO: 142429 - DNA, 580 bp, Homo sapiens
  misc_feature: GYAE6OF02HKTB3.46.67.G01.1.454.CMB.1.raw
  modified_base (246)..(246): a, c, t, g, unknown or other
  misc_feature (246)..(246): n is a, c, g, or t
  modified_base (434)..(434): a, c, t, g, unknown or other
  misc_feature (434)..(434): n is a, c, g, or t
  modified_base (444)..(444): a, c, t, g, unknown or other
  misc_feature (444)..(444): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctcatcagtagtggtttctctgggctgggtccgnagcgtccgagggagggcgtggaatactagttggaagtgtctctcatagtggaggttctattacagtccgtctctacaagagtcgagtcacatatctctgacacgtcagacaatctacgttttcccagtaacgtatcgtagttctgtcgaccgccgagtcgacgtacgggtcgtttagttacgtgtcgngagagacgtntattagtgttagttttggtaggtttgttacttacgtacctaccgtagtacgtcgggacggggtctcccggtaccggtcggggaccgtaaggtacgtacgtcggtccgtaccgttcgtaccgttacgtccctacccg

SEQ ID NO: 142430 - DNA, 657 bp, Homo sapiens
  misc_feature: GYAE6OF02F7LFM.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtcctccactcctccctgtctgccaaccggtgggagacagtgtcaccatcacttggccgggacaaggtcggaactattgacctaccttaatttaaagttggtatacaactatacgaaccgagggaccgtaccccgtaagcctacctaatctatcgctcgcactccgtagtttcgacgaaggtcgggtaccctagtcgtaggttcaggtggactaggtggtatcgtagggtacagttattacgtacttcctacctactaacgtcgtaacgttacttacgtacgaacgtaacggtagtaaagttcgtttaacactttaaacttcttaacgttaacgtaacaacgtaacgttaatttacgtaattttcgggtttaccggaacgtaaggtaaccaaccgtaacgttaaacgaaaacttaaacgagttgtacgtactacgaccctagttaacctgttactaccgttatccgtttaccgtaccctactacttacggtataccg

SEQ ID NO: 142431 - DNA, 726 bp, Homo sapiens
  misc_feature: GYAE6OF02H838N.46.67.G01.1.454.CMB.1.raw
tcagactagcagtacacgaccggtgctcgatttagagtatacatattgggtttggggagtctcggtcaggacacagcatggacatgagggtccccgctcagctccgtggggctcctgctactctggctcgaggtgccagatgtgacatcgagctcgacccagtctccatccctccctgtctgcaacggtgggacacagtcgtcaccagtctacgttcggccgggacaaggtcggaaactattcgaacctaaccttaattttaaagttggtatacgaatagtacgaccgagggaccgtacccctaagcctactaactcttatcgtctcgactactaccgtagtttacgacgtaacgggttcggtacccagttacggtacggttcgaggtcgacgtagggtacggagtcggtacgggaactaggttactttccgaaccttccgttaccaaccgtattacggtaaacgttacgtacgtacgtaaaccgtaacggtagtaaacgtttacgtttacgtaactttaactttaagtaccgttaacgtaactaaagtacgttaaactttacgtaaggttttaccggttttaccggaaccgtaaacgggtacctaacggtaaacttaaaccgttaaaacgtaaacgtacgttacgaccggtactacgtacctacgttacgttacgtccgtttacgtcctacgttcccgtaccctaaccgtcttaccgtattaacg

SEQ ID NO: 142432 - DNA, 894 bp, Homo sapiens
  misc_feature: GYAE6OF02H15QL.46.67.G01.1.454.CMB.1.raw
  modified_base (865)..(865): a, c, t, g, unknown or other
  misc_feature (865)..(865): n is a, c, g, or t
tcagactagcagtacacgaccggtgctcgatttagagtatacatattgggtttggggagtctcggtcaggacacagcatggacatgagggtccccgctcagctcctggggctcctgctactctggctcgaggtgccagatgtgacatcgagctgaccccagtctccattccctccctgtcgtgccgaaccggtgggagacctaggtacgtaccaacctagtcctaccgtttggccccggggtcaaaggttaccggaaacctagtttacgaaccctaacccgttttaaattttaaaacgttaggtacttaaccgaaacgaattaaccggaaccccggaaaggggtaccccggtaccccccttaaacggaccctttaaccccttaaacttacccgtaagtcggtaccgttacgacttaaccttccgttaggtttacggaccggttaaagggttccgggtaccctaggtaccggttacgggttcgaggttcggacggttaggtacggtagttccgggaggtaaccgtagttctttaaccgtaccgttactacccgtaccgactttacgtaaacggtttaactccgtagacccgttaaggaaggttaacgtttactttacgtaaccttaacttttacgtttaccgacgttacgtaaacgaaagtttaaccgttaacgtaaggttttaccggtttaccggaaaccgggtaaacgtaaccgttaaacccgtaaacgttaaaacccgttaaaacggttaaaaaccgttaacgggttaaccggttcgggttaccctcggtaaacccgtacccttaacgtttaccggttccttaccgttttaaccgttaccccttttaccgttaaccccccgtntttaaccccggtttagtcgtttaaacccg

SEQ ID NO: 142433 - DNA, 550 bp, Homo sapiens
  misc_feature: GYAE6OF02F2HK0.46.67.G01.1.454.CMB.1.raw
  modified_base (421)..(421): a, c, t, g, unknown or other
  misc_feature (421)..(421): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctattaaatgtatcaacatagacaggacgcccctaagctctaatctatgctgcatcctagtttgactaaaggtcgggtcccagtcgaggttcagtggcagtggatcgtggacagtatttcactctcaccatacagtaactctagacaacgtgtaagtattttgacttaacttattactagtacaanaagtaattactaagttcgtttacgaccgtaaaggacaacgtactaaacgtaaaattaaacgaatagtacgtactacgaccgaactactcgtagttacttacgtacttccttacccgctacgtctataac

SEQ ID NO: 142434 - DNA, 780 bp, Homo sapiens
  misc_feature: GYAE6OF02H76NS.46.67.G01.1.454.CMB.1.raw
  modified_base (194)..(194): a, c, t, g, unknown or other
  misc_feature (194)..(194): n is a, c, g, or t
  modified_base (252)..(252): a, c, t, g, unknown or other
  misc_feature (252)..(252): n is a, c, g, or t
  modified_base (471)..(471): a, c, t, g, unknown or other
  misc_feature (471)..(471): n is a, c, g, or t
  modified_base (500)..(500): a, c, t, g, unknown or other
  misc_feature (500)..(500): n is a, c, g, or t
  modified_base (741)..(741): a, c, t, g, unknown or other
  misc_feature (741)..(741): n is a, c, g, or t
tcagactagcagtacacgaccggtgctcgatttagagtatacatattgggtttgggggacctcctgtgcaagaacatgaagcacctgtggtttgtcctcctgctggtggcagctcccagattgggtcctgtccctggtgcaactgcaggagtcgggcccacgactggtgaggcctttcggagaccctgtccctnacctgcgctgtctctggtcgcctccatcagtagttgtttctcgtggggctgggtccgngcgcgtccgagggaaggggacgtaggagtactacgttggtaacgtagtctctctagtagtaggtaggttcctttaacgttactacggtccgttccttctcgtaagtacgtacgtaacgtactacctaataacttcctctaggacacggtcctacgtacaacttacttacgttttccttacgaacgtataggttacttacgtcgtaggacccgtacccgngttagaccgtacgggtcgttttattacgnggttaggcgaagacggtcgtacttaagtttagtttacggttttagtttttgggtaacggttaggttttttaacgttttaccgggaaaccccgaacccgttttaaacgggtcgtttacccggggggtaacccgggggttccctttaacccccggggtacccccgggtaacccgggggggtacgttaaaaccggggttaagtttacccgtttcccgggggtaacccttaaccccccgggtttnttttaaccccccggtttgtaccccccgtaaccccccggg

SEQ ID NO: 142435 - DNA, 642 bp, Homo sapiens
  misc_feature: GYAE6OF02F24RP.46.67.G01.1.454.CMB.1.raw
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatccctccctgtctgcaaccgtgggagacagtgtcaccatccacttcgccgggcaaggtcggaacattgacacctatttaaatggtatcaacatagaccagggacgcccctaagctacctaatctatgctgcatcctagtttgacgaaaggtgggtcccagtcgaggttcaggtgctagtgatcgtaggacgtagtactttcaacctctaccaccgtaatcctaagttaactcgtagacctaaacggtaggtaaacgttaattttacaacgttaaactttaactttaaccgttacgttacaaacgttaagtaaacttaacgtaagtttacggttttacgggaaccgtaaagggtacctaacgtaaccgtaaactaaaaacgttaaacgaaaccgttggtacgtactagaccgtaacctattccgtcgttacctttacgactttaccccgttacccgtacctacttactagttaacc

SEQ ID NO: 142436 - DNA, 703 bp, Homo sapiens
  misc_feature: GYAE6OF02IL8XL.46.67.G01.1.454.CMB.1.raw
  modified_base (253)..(253): a, c, t, g, unknown or other
  misc_feature (253)..(253): n is a, c, g, or t
  modified_base (345)..(345): a, c, t, g, unknown or other
  misc_feature (345)..(345): n is a, c, g, or t
  modified_base (407)..(407): a, c, t, g, unknown or other
  misc_feature (407)..(407): n is a, c, g, or t
tcagactagcagtacacgaccggtgctcgatttagagtatacatattggggtttgggggacctcctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtcgcctccatcagtagtggtttcttcgtggggctgggtccggnagcctccgaggggaagggctggaatacagttggaagtgtctctcattaggtggtacggttacctagttacgacggttccgtactctacaagngtcgagtcacctatatctcgtaggacaccgtccagtacaattctacgttttcccgagtaagngttagtacgtttctcggtaccgacccggtcccgtacgtcgaacggtacggggttacttttaacgttacgttggttcgacggtaaggtacggtaccggtattaagtttacgttagtttacggtttttaggtaggtttaggttttactttccgaaccttacccggttagaccggttccggggaccggggtccctccgggaaccccggttagggggacccgtaaaggggttaacttaccggttacgggttaccccttaccggttaccctttacccggtttaccgccccgttaaccccgg

SEQ ID NO: 142437 - DNA, 580 bp, Homo sapiens
  misc_feature: GYAE6OF02HLP46.46.67.G01.1.454.CMB.1.raw
  modified_base (173)..(173): a, c, t, g, unknown or other
  misc_feature (173)..(173): n is a, c, g, or t
  modified_base (298)..(298): a, c, t, g, unknown or other
  misc_feature (298)..(298): n is a, c, g, or t
  modified_base (322)..(322): a, c, t, g, unknown or other
  misc_feature (322)..(322): n is a, c, g, or t
  modified_base (345)..(345): a, c, t, g, unknown or other
  misc_feature (345)..(345): n is a, c, g, or t
  modified_base (350)..(350): a, c, t, g, unknown or other
  misc_feature (350)..(350): n is a, c, g, or t
  modified_base (455)..(455): a, c, t, g, unknown or other
  misc_feature (455)..(455): n is a, c, g, or t
  modified_base (467)..(467): a, c, t, g, unknown or other
  misc_feature (467)..(467): n is a, c, g, or t
tcagactagcagtacacgaccggtgctcgatttagagtatacatattgggtttgtccctcctgctggtggcagctcccagatgggtcctgtccctggtgcaactgcaggagtcgggcccacgactggtgaggccttcgggagaccctgtccctcacctgcgctgtctctggtncctccatcagtagtggtttctcgtggggctgggtccgcagctcccgagggaagggctaggaatacattggaagttgtctcgtcagttagtggtacggttcctagttaacagtccgtctctcaagngtcgagtcaccatatctctggacncgtcagctaatctagttttcccngaagntgtattcgtgtcgacccgcgcgtcgacgtacgggtactttattacgtgttgacgagacgacggcttaattatgttagttttggagttgttattcgactacctagngtcggcgggtcncgcccgtggaccgaggatacgtcgtcaccgtctccgtagccctaccaccgaacggccctacggtccgttcccgtaccccgtgaccctaccccgttacctaccgagcccgaccg

SEQ ID NO: 142438 - DNA, 717 bp, Homo sapiens
  misc_feature: GYAE6OF02GVYA6.46.67.G01.1.454.CMB.1.raw
  modified_base (385)..(385): a, c, t, g, unknown or other
  misc_feature (385)..(385): n is a, c, g, or t
tcagactagcagtacacgaccggtgctcgatttagagtatacatattgggtttgggggagtctcggtcaggacacagcatggacatgagggtccccgctcagctcctggggctcctgctactctggctcgaggtgccagatgtgacatcgagctgacccagtctccattcctccctgtctgccaaccggtgggagacagtcgtcaccatcgacttggacccgggacaagtcggaactattgaacaccttaatttaaaagttggtaactcgaaacaagtaagaaccgagggacccggacccctaaagcctaccgtaatctaatgctcgacactccctaaggtttacgactaaagggttcggggtaccctaggtacggtacggtttnaacggtgaacgtagggtcgtaatcggtagggaacagttacttacaacgtctaccaactatacaagtatctagacaacgtaggtaattacgttagtaacctaactttaactacgttacgtacgtaaacgaaagtaaattaacgtaaatttacgggttttaaccgaaccggtaaaggtaacccgtaaacgtaacgttaaaaccgtaaaaacgtttaaaacgaaaccggttagtacggtaccgtgtaaccgtaacctaagtttaccgttacgtttaacccgttacgtaacccgtttccgttaccccggtaaccctaacttaccgtacgttaaccc

SEQ ID NO: 142439 - DNA, 705 bp, Homo sapiens
  misc_feature: GYAE6OF02I57UE.46.67.G01.1.454.CMB.1.raw
  modified_base (235)..(235): a, c, t, g, unknown or other
  misc_feature (235)..(235): n is a, c, g, or t
tcagactagcagtacacgaccggtgctcgatttagagtatacatattgggtttggggagtctcggtcaggacacagcatggacatgagggtccccgctcagctccgtggggctcctgctactctggctccgaggtgccagatgtgacatcgagctgacccagtctccatccctccctgtctgccaaccgtggagacagttgtccaccatcacttcggccgggacagtccgaactnttacgacacttatttaagtgtatacaacagtagaccgagggaccgacccctaaagccttaccgtaatccgttatcgcctagcctaacttccgtaggttttcgacgtaaacgggttcgggtacccaggtaccggtaaggttcgaaggttcggacgtaggtacggacttcggagggtacaggttacttcgactctaccgtacagtctaagtaactcgtacgacgtaacggtacgtaagttacgtttactaccgttaaatttacgttaacttacggttacaaaccgtaattaacttaacgttacggtttacgttttaccgggaacccgaacgggtaaccctaccggtaaaccttaacgtaaaaacgttaaacgaaccgtttacggttagtcctaacggtacctaaccgtagttaccgtacgtttaccacgtttaaccgttcccttacccgtaccttacgtaccttagtaaccg

SEQ ID NO: 142440 - DNA, 796 bp, Homo sapiens
  misc_feature: GYAE6OF02GZVA1.46.67.G01.1.454.CMB.1.raw
  modified_base (241)..(241): a, c, t, g, unknown or other
  misc_feature (241)..(241): n is a, c, g, or t
tcagactagcagtacacgaccggtgctcgatttagagtatacatattgggtttgtcctcctgctggtggcagctcccagatgggtcctgtccctggtgcaactgcaggagtcgggcccacgactggtgagccttcggagaccctgtccctcacctgcgctgtctctggtgcctcatcagtagtgtttctcgtgggctgggtccgcagctccgagggaggctaggaatcattggaagtgtcnctcatgtggacgttcctattacgacgttccgtactctacgaagtagtcgagttccaaccgtattacttcctcgtaggacctaccggtaccaagacctaaacttccgtaccgtttttaccgacgtaagtacgttaggtaacgtttccgttggaccgtaacccgtccgtacgtacggaacccggttaacggggttactttttaacgttaccgttgggtacgtacggtaacggaacggttaccgggtaacttaagttttaacgttaggtttaacggttttttagggacggtttttaaggtttaccgttttaccgaacccgttacccgttaacggtacggttaccggggtaccggggtacccttacccgggtaccccgggtcggggtacccgtaaaggggtaacgtttaccggtcggttacccgtacccgttccttaccgtaccgtaccctaacccggaccggtaaaccgggtcccctaacggttcccggttacccctttcccccggtacgtacccccttaccccgttacccgtaacccgaacggttccgtaaccccgg

SEQ ID NO: 142441 - DNA, 684 bp, Homo sapiens
  misc_feature: GYAE6OF02JHQRD.46.67.G01.1.454.CMB.1.raw
  modified_base (216)..(216): a, c, t, g, unknown or other
  misc_feature (216)..(216): n is a, c, g, or t
tcagactagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctcctgtctgcaaccgtggagacagtgtcaccatcacttggccgganaagtcgaacattgacctacttattaaagttggtatcaacatacgactagggacgtcccctaagtctaccgtaatctatgctgctactcctagtttgacgtaaggtcgggtacccagtcgtaggttcaggtggacgtagtggtactcgtagggactagtactttacgactcgtaccaccgtacgttacgtaacgttaacgtctacggtacgtaaacggttagtaaagttacgttttacgaaccttaaactttacgttaaccgttacgttaacctaaacgttaagttaactttaacgtaacgttttacggtttaccgggaccgtaaacgggtaaccgtaaccgtaaacttaaaccgtaaaagtttaaacggaaccgtttaggtacggtacttaggaccctaaccgttacgttcgttacgttccttagttaacccgtttccgttcccctaagtcttaccgtacgttaaccg

SEQ ID NO: 142442 - DNA, 754 bp, Homo sapiens
  misc_feature: GYAE6OF02IYUUZ.46.67.G01.1.454.CMB.1.raw
  modified_base (97)..(97): a, c, t, g, unknown or other
  misc_feature (97)..(97): n is a, c, g, or t
  modified_base (190)..(190): a, c, t, g, unknown or other
  misc_feature (190)..(190): n is a, c, g, or t
tcagactagcagtacacgaccggtgctcgatttagagtatacatattgggtttggggagtctcggtcaggacacagcatggacatgagggtccccgntcagctcctggggctcctgctactctggctcgaggtgaccagatgtgacatcgagctgacccagtctccatcctcctgtctgcaaccgtgganacagtgtcaccatctacgttcggccgggacaacggtacggaactagttacgacctaccttaattttaaagtggtaatacaaactatagaccgagggaccggtacccctaaggccttacctaaactccgttaatcggtcttacggctaactccgtagttttacgacgttaaagggttccggggtaccccaagttccgggtaacggttacctagggttagggaccgtagggtacgggtactacggtcggggaactaggttactttaccacgttacctacctaaccgtagtacgtaacgtttaactcggtaacgtacgttaaacggttaggttaaaagttcgttttaacggaaccgtttaaacttttaacgttaaccgttaacgtttaaccgaaacgtaacgttaaatttaaccgtaaagttttcgggtttaacccggaacgtaacgggtaacctaacgtaacttaaaccgtaaagtttaaaccgcttacggacgtacctagtacctaacgtacgttactcgttaccttactaccgttacccgttccgaccttaacttcgtagtacg

SEQ ID NO: 142443 - DNA, 599 bp, Homo sapiens
  misc_feature: GYAE6OF02FZU0Z.46.67.G01.1.454.CMB.1.raw
  modified_base (307)..(307): a, c, t, g, unknown or other
  misc_feature (307)..(307): n is a, c, g, or t
  modified_base (334)..(334): a, c, t, g, unknown or other
  misc_feature (334)..(334): n is a, c, g, or t
  modified_base (462)..(462): a, c, t, g, unknown or other
  misc_feature (462)..(462): n is a, c, g, or t
tcagactagcagtacacgaccggtgctcgatttagagtatacatattgggtttgggggacctcctgtgcaagaacatgaagcacctgtggtttgtcctcctgctggtggcagctcccagatgggtcctgtccctggtgcaactgcaggagtcgggcccacgactgggtgaggccttcggagaccctgtccctcacctgcgctgtctctggtgcctccatcagtagtggtttctcgtggggctgggtccggcagcctcccgaggggaacggggctaggaatacagttaggaagtgtctctcatgtggngttcctattacagtccgtctctcaagngtcgagtcactatatctctaggactactcagactatctacgttttcccagaacgtagtgtagtttcgtagtcgaccgccgtgtcgaccgtcgggttcgtttacgtacgttgtcggcgagacgacggtntattagtgttagttttggtagttggtttacttcgacctacgtagacgtcgggtacgggccgtccggtacccggtacgggacgtagggtacctacggtcggtaccgtacccgtccgtttaccgtaccgccgtaccccg
